United States Patent 9,976,180 (METHODS FOR DETECTING A GENETIC VARIATION IN SUBJECTS WITH PARKINSONISM) - sequence listing, part 4

SEQ ID NO: 59 - DNA, 392827 bp, Homo sapiens
tgctgctttgattgcaataaaggttcatgcacaaagtaagagaaataacaggaacaaaaataaagaaaagaaaaaagttcaggctaggtcaacaagtccacgtttcctacctgaactgtgggctctgggatgggttgttggggacagaccttgaagcagagaggaccacagagccaggaccagggccacagggcttgaggaattgtctattcctgctgagggtggggagttcaggagagcaacgatttctgttccttgttgatgaccttggccaactcttcgactcctcaggctgctctttttcccgcccccaggtggcgctctttcctccttccttcccacccctccattggtgacttcatccaccatcgtggtgcagccctagcttctatctggacaacgcccacctttccctcccataccgatctcagtgacgtctccatgaagcccttctaagtttcacccatgcagaggtggaaatacatgattgcacttgttatttaaggaggtttcctgtgtgcccccgctgtgctgaggcctcgatatagaatctcagttattcctcaggaaatcttcgcatgcaagtggtttatttgggaaaggatcccaggaaacactggcaggagagatgggaagtgagacgggaagggaaggcggccagcaaagggggcatggatggatgagctggtcatagaatgtttgaagagacatggcttaggaaggaaattcatttgaatttttttaactttggacctgtgctttcaaatgtcttctcccttgcctggcacagtggctcatgcctgtaacccagcattttggaaggccgtgcaggaggattaattaaggccaggagtttgagactagcctgggcaacatagtgagacctcgtctctataaaaaaatcaaaaatattagtggggcatgatggtgtagacctgtagtcccagctagttgggaggctgaggagggagaattgcttgagcacaggagtttgaggctgcagtgagctatgattgtgccactgtactgcagcctgggtgacagcgcaagaccctttctaaaaaaagaaagagagagagagaagggagagagaaaagaaggaagaaaggaaggaaggaaggagaagaaagaagaaagaaaaaaagaaagaagaaagaaaaagaaagaaagatggatgaaagaaagaaaaagaaagaaagaaagagaaaaaagctcactgttagaaaaagaagattgacaaggatgaaataatgataaatcccagggggatgagcctcccagctcagtctctgctggaaaaaagtattgaaaagcacaggtccaccatgaaaagaaattaaaatgaatttcattcttaagccaaacatattccagagaatccattttaagccctcctgaacatttattgaaacccccttccatctccaaccccaaaagctccaaaggacctcacttcttgctccccttcccaagcccctgctctcagcctcctctcccctcttccccatctgtcccataaatttgatcccagcaagcaagaatcccttctttttatgagctagaaaactgaccagtgacagaagatttttattcacaggaggagagagaggatacttcattaatttcagtcctacctgttgtacatatgtgtgtcctgtaataaatcatttgtctgacccttgtttctggttcctaggaggaagcttctaattcttggaatttcctgagtgatgggattgcctgagtttatgctaacaaggtgactcgggatggtggccagccacaccagaaagaccaactgtgtgattagagagttgggactttgggccagtgacatcagcctgatgatgtctggggagtggaggggttgctggagattgagttcaatcatgtggccagttatctagtcaatcatgcctacataatgaaaccacaaaaaaacctctgaatgatgagactcagttgagctccccgggttgggagtcatacttctgtgtgctcagagggcgacacagaagctttgtgaattgggccctcccatgggttttttttgggggggttgttcctttataataaacaattatagaaagtacagtgcttttttagtgctttgagttggtctatgagttactgaacctgagagagtaatgggagcccccgaatgtgtagccagtttgtcagaagtgtgggtggcctgggagccctggcgcttgcagtgggtgcctgaagggaggacagtcttgtggaagactgtgcccttaacctgtgaaatgtgacccaagtccaggtggctggtgtcaaaactgcattgccttatactgtggctcagaccatatgacagagatgagaatctgtcatttctgcttggagaaatcagtttttggggtgtgactaatttttgctctgggacccagatttcaccccccctagagttgagagttctgcccttgtgttttattttctgcttttggctagagatgtgaatgagggtgagaagattattgcctggggattgaaaaccaggccacaatgaagtgggacccccaaggccaagagtcctgtctgtgttttcctcctatagggagattggcaggtggggtcagaggctacattcataaagcatctcaattttcctccacagtttgtgctacttaatggccctgcataaatacttctacaagagccaacaaattaatgactcataaggccctttaaagcattggaaagaaactaaaaaggagatctaatttgtttggttcaggattattggtatcaagctgggtttggtgtcttttgtttactcattggtttccaaaaataaattttgggaaaacagaccattaaggataaaagatgctccagtgtacttgaaactgtttgagaaacaggtaaaaaggcagtaaaatataaaatttattgtggctgagggtttttctaatgccaagcacaacagcagtagacagaagcacaaactgtggacaattgaccttggctggatcatgccttcttcccaatttcccagggcagagtgtcccattacgtagaaataaaaaagaaatgcattgtgtctagagcctggaatgtggggtcctctgggaatattcatttcagttacgcaacaaatatttattaagcctagattgcgcctggcctatcttgagctacttttattagaagccttctctcagaggctttaaatatctctaccacccacatatagcagctccaacgctttgatgtcatacaaaattaggccagagtcatacttccatcacccacaagctctgtgaccatgggcaacctcagcttcctcatttgtaaaaatgagttgtagtgggtgaaacagtatcctccaaaaattcatgtctactggaaactcagaatgtgagtgtatttggaaatagggtctttgcagataaaattagttaaggatctcaaggtgaaatcattctggatttagggttggctgtaaatctaacgatgagtttctatataagaaggggagaagatagagagagacagagagagagagaccgtgtgaagatggaggcagagaaagcagtgatgcatctacaagtccgtgaacaccaaggactggcaatgaccatcaggagctagaagagagtcatggaacagattctcctccagaaccagaaggaagcaaccctcccaacacctagatctgagacttctggcctccagaactctgcaagaatacatttctgttgttttgagccacacaggttgtggtcttcttttttttttttacagcagccctaggaaactaatgcactactccaaatagaattatggcctcgtaaatgaaaagatggatgcaagcatttgactgatacagatattcaaccagtgctaattcttctttcctttctaggctgattgaataggtaatgttgaagctatgggttagttttcagcttcatctatcatcttcctggtttattcattgaaaaaggttttcacgtagtaggcttaacctttttgccccagtttgggtatccgctttggagcttttccgtttatttttgtgtgtgtagcagacatcattgttgccctgcccaaatgccctcagcactcctcatttttatgcacatggactcatgcagaggtgtaactgcagcggctgcaactcttcctgagagctctctctggctgctggcacctgcttggctcacacacgagacagaaagttgaataccccctcctcccgcaggaacacccttaaaccagcgactgatgggagtcagtgcatacatttcccagctcccttgctcgcagctgggatgagtctgagccacgtttcacactgttttccagagtccccagcaggactgagcttcactttcccacagcagtgagctgcttggtaacacacacattactagttttcttcctgtgttagcttcctgtggctgccataatgtatgaccacaaacttggtggcttgaaacagtagatattattccctcctcgttctggaggccagaagtccaaaaatcagtatcagtgagctgaaataagtgtctacagagccatgctccctcaatagtctctaggggagaagccattcctggccttttccagtttctggtggctgttggctaatccttggagtttcttggtttgtggctgcatcactccagtctgtgcctccttcttcacattgccttctcttctgttacgcaacaaatatttattaagcctagatcgtgcctggcctaccttgagctactttttctagctcaagtgatcttcctctctcagcctctcaaagtgctggggttacaggtgtgagccagccgcacccggcgccctggtaagtccttcatcaaggtggagaagggtgaagattcctgtagtcaaatctctatttcccttttataaggatacatgtgatcgtattaaggactcattcagataatccaggataatctccctaccccaaggacttcaatttaactacatcagcaaagtccccttttttttccacctaaggtgtattaggtcattcttgtattgctataaagaaatacctcacactgagaaatttataagaaaagaggtttaattggctcacggttctgcagactgtacaggaagtacagcaacatctgcttttggggaggcctcaggaagcttccaatcatggtagaaggtgaagctggagcaggcatctcacatggtgaaagcaaaagagagttgggggaggtgccatccacttttaaatgacaagatctcatgagaacccactcactatgggtattagtctgttctcatgctgctaataaagacatacccaagactaggtaatttataaagaaaaagaagtttaatggacttacacttctacatggctgaggaggcctcacgatcatggcagcgggtgaaggggaagaaaaacgcatcttatactgcggcaggcaagagagtgtgtgcaagggaactcccctttataaaaccatcaggtcaaaaaaactgtgtgctgtaaaataattgtgcagtatccatacaatggaatattactcagccatgaaaaggagagatgcactgacacacactacaatgtggatcatgagacttactcactattacaagaacagcatgggaaagatccactcccatcattcaattacctccaccaggtccctcccatgacacatggcaattatgagagctaaaatggaagatgagatttgggtggggacacagccaaaccatatcactacagcaaagacagcaccaaggggatggtgcaaaaccattcatgagacatccacccctgtgatccagtcacctcccaccaggcctcacctccaatacgggggattacatttcagcctgagatttgggcagggacaaatatccaaactatatcatatggtaacattcataggtttcaggaattaagatgtgaacatccgacctaccacaattccctttctctccttacttcccattcacctatcaatgcttcctggggatcaatttaccaataaactccttactctcaactctttgccctcagcatgtgcatctggagggacctcacctctgactgtatcacttcatagggaatgagaaccaacctttcaaggaatcatttattaatttgttgcactcacattccactagcagttgtacttacatgagtctgaacaaggttgtcaaattctatgaaggtcgttgattagctcacaaccataatgccaagttggagggggtgattggcttgaacaggcttttgagtgataataacccaagaaaaagaaatgagggagaagcctactggggactctcactgctgcttgaaacatctctcagcctcactctgtgatttatgatttgatagatctagtgagagagaagttggggtgggagagtcactggccagagagtcccaaccctcatagctgtggacggtcacttgcagtgggttgggagggtaggtggtgaaatcttaggaacaggtgacacaggtgagctctttctggtaagtacctttttttttttgtttgcgttttttctttaagagacagggtcttcctgttttccaggctggagtacagtggtgcaatcatagctccctgcagcctctacctcctgggctcaagcaatcctcctgcctcagcctcctgagcagcagggactacgggtgcacaccaccatgcctggctaattttttatttttgtagagatggggtctcactacattaccctggctggtcttaaacttctgggctcaagcgatcttcccacctcagcccccaaagtgctgggattataggtgtgagccactgtgcccagccccctggtaagtccttcatcagggtagagaagaatgagagcacctctagtttcctggagctctgtaacctctgcaccaacgtaaaggtcaagactccctggttaaggctttcaactttcactggaggggctgaaaggccatgcactgtgcttggagatatttacttgtttattcacttgattgttcattcattgattcattcattcattccttttcccttctgtagaacaagtacctattgaatgtctgccatgtgcctggcagtgggggctcctgtagatcagaggagagagaaccagggaaggctgtcctgaggaagtgacattcaagtagagactccaaggagtgagttagccagaccaggagcatagggagccagagagcatctcccagcagaagacctccatgaaatgccctgaggcagaagaggaaagacctgggagggctgggaggggcggggaaaacaaagagtccagttgtcttgagcaccacgatgactggaggtcagagctggagatccaggcaagggccagctctggagctctgttggggggtttgcatcattcaaaactcagtgggaagtcacaggaggtctgggagagagagacaagagctgatggatgctttaagaacatcactcgactgggcacggtggctcatgcctgtaatcccagcactttgggaggccagggtgggcagatcacgaggtcaagagattgagaccatcctggccaacgtggtgaaaccccgtctctactaaaaatacaaaaattagcagggtgtggtggctcatgcctgtaatcccaactactcgggaagctgaggcaggagaatcgcttgaacccgggagacagaggttgcagtcagccgagatcacaccactgtagtccagcctggtgacagagtgagaatccatctcaaaaaaaaaaaaaaaaaaatcactcaccctggtcactacctcctgagtgctccaggaagggtgagggcaggaaccgatgaggctgctgtgggcatctgggtgtgatttggcgggagctggatggatggtactttggcttcattatctgtgataggttgaaagctgttccctgcaaattcctctgctgaagccctaactctcagtaccacacaatgtgactgcatttggagacagggtctttaaagaggggattaaggtaaaatgaggtcatcggagtgggctttaatccaatctgcctggtgtcctcatgagaagaggagattaatacccatttatgcctagtgttccattactggaacgctaagcatgtgagaattatttatatcctactgctcaaggtcatcgcaggggtctgattgcaaaaattcaaaaaattgcaacctcaggcataaatgttaagacacagacacacacagagggatgcacataggaggatgtggggagaaagtggctgtctgcaagccaaggaaggaggcctcaggagaaaccaaccccaccaatcgataccttgatcttggatttccagcctccagaactgtgagaaaataaaagtctgttgttgaaaccgccctgttcatggtgcttgttagggcagcctgagctgactcatgcaccctgtgtgagctaaaattgggccagcccaggtgatccagcctctctccttctcctcctgcttcgtccaaatgccccagcacctctctgttgttcacagcagcttcttagccataaaggccatatctcccatggacttgtctgctggagcatcctcccaccagcagacaagtcctggtctctggaaagcctgttggctctctgtcctctgccacctgcctcccagaattatgtgctgactctttccagatgaactcactgaaaaattgtgaactacccctctgctgccccaagtcgcctacacacttatggcaattccccaaccaaacgaatgtcacttttacattatgcagacagaccaaattagcatttagcagagaaaggggcttcttcttcttcttcttttttttttttttgcaaatcatataactctaaattaccttcaatttcccaaatggaatttggctcgagattcactctggtatggagtagtctgtaatgagattatattatgtttgggggaaaacattcaaatgaccaagataattaattttgcataacaaccaacatagagcaagctccagagctggaactcaaagcctgcaacctgcaggggcccctgggggtgatcagagttctttcaaaatacagcaacaaaggccattctggggacccgtgcaatgcccgggtttgaaagctggaaatgtcgggttctttctcctctggctactgtcttcatattttctcagcagctgtgatttgctgtaggagctgtcctgggtttggaaagacaaaaggagcccgatggctcaatagagcattctggaagagctttactgggaggaattttttgagaaaagtccctaagatttcaaaacgtttggtgctgtttcagggcccagcttagggtagggtggtgtgtgtgtatgtgtctgtgtctgtgtgtgtgtgtgtgtgtgtgtgtgtgtgtgtgtgtatgtatcttgaaaaggaaagaataagatcaaaccctcctcttgtctttgaatcttcattgtcaggtggctttatttgcatgatatcagacttgtctgaatatctgggaagaacctgacacagcggcaattttctggttctgattcattgtgaaaatcaccttggaaatagccaggacctggcatctccccacctccaccccttgcacctcttggctgtgtctcattctaacacagtttagaatatgcatcagcctgggagccagagaacctacattttcacttaggctctgcctctagctgcctgcatggtctcaaaaataaattcctgcacccaaacaaatccttgtccgtgaatgttcacagcagcactatttgcaataaccaaaaggtgggagcaaccccaatgtccaccaatgaatgagtggataaataattgtgcggtagccatacaatggaatattactcagccatcaaaaggaaagatgcactgacacacactacaatgtggatgaaactcgtggacatcttgcagagtgaaagaagccagacacaaaagatcacatattgtataattccatttacatgaaatactcagaataggtaaatccatagagatagaaaacagattagtgtgtgcccggggctgcagagcaggagtgcagaatgacagcttaatgaacgtggggcttcattttgtgctgatgaaatgctttggaactagatagtggtgtcggttgcacaacattgtgaatgtactacatgccactgagttgtaaactttaaagtgaattgtgcaattaaaatgcttacttttatattatctgaatttcacctcaataaaaaaaaaagttcctcccatccttgatctcacactggatcttggggtcttcatctgggaaaattaaggtgttggactagaaacggggattgcaaactcttactctatagaccacatttggccagcagatatttaattgggccttaacagtgttttttaacacattctaaatctgaattcctttttttgacggtcagtttccaaagatgagcctcccagcccaatgagctatccctcctggtatccatgcaatggggtggccacctccaacactgaatccaggctggccttttgaccaacagaatgcagcaggagtgacactacataattccaaagctggaccttaaggtatctgcagcttctgcctttatctcatgggatgctccctctctgaacccagaaaccatgctgtgagcaagccctcgctgcatggggaaccacatggagaagcccccacagagcagtccatgccaactgccagccatgtcagtgagcaatcttggacgttacagcccagctgagcctctgaatgatacagccctagctgatatgtattcatagagagagcagaagaaccacccagctaagcccaggcaacacacagaatcataagaaataatacaatgattattgtttaagccacgaagtttgggggtggtttctcacacagcaacagatgacaggaacagctttgactgcttctttggcttgtcacagtcctcatcttatctcctacacctgcccacttcatacatctgagctacctgcctggcccctgcaggcagctggctctgcagccccagatgtgatgatgatctctaggttcccatccaggtttgccaagtgcatattctccatgttccaatctgagcacattgagcattcatggccaagatctttcagtgggtggataagactgaattctccaaagacataggaccaacatgacatacatatgtatgtgtgtgtgtgtgtatatatatatctatacgtatatgtaggtatatgcacgtgtgtgatgtattatgtgagagagacagagtgaaagagagtgagatttattttaggaaatggcttatgcaattgtggagcccagtaagtccaaagtctgcagggaagaccagcaagcttgaggcccagggaagaggtaatgttgcatcaatagcctggacagtttgaagagagtctgcaggcagaattcccttttccttggggaatgtcagtcttttgtttctctctctccttttttttttttttagtcagaatctcgctctgtcacccaggctggaattcagtggcatgatctcggctcactgcaacctccacctctcaggttctagcgattcttgtgcctcagcctccccagtagctgggaccacaggcatgtgccaccaagcccggctaatttttagtagagatggggtttcaccatgttggccaggctggactcaaactcctggcctcaagtgatctgcctgcctcggcctcccaatatgctgggattacaggcatgagccaccacgttcgacctcttttttctgttaaaaccttcaggtggtaggatgagcctccacccacattatggagtggggtggtaatctgcttgactcaaagtctactgacttaaatattcatctcatctaaaaattctctttacagccacagctaggctgctgtttaccatatatctgggtaccatggcctggcccagctgacacataaaattaaccacgctggggggtaatgaaccaactcactgactcccatttggcttgcagattcccaaattaaacttctccccggggtcctgtggatcccttctgcatttccgggtgtacctgaccccactttagcatgctttggcccccagtgggcctgcacctcacctctccctcgggctcctggagatgatggcctggaaggcacaggtggctggagtacttgagggctgatgttccccagagggacacttggccaatgagtgaagaggttgggggcgggagggcaacttggagccctaattctccctccagtgctccctctccatgggcccaggctgaagccacagtccacagagccttcccggacctcacagccttgccgggctccaccccttccctgccagctccccgctctccctcactccctccccagtttctcctggggtgccccaatcctcatgtcagatccgtgtctgcagaacacaacacaggacagaccatcacgtgaagagaggaaaaacattcattaaggaaaaaaatcattgagcattgtcttctgtgccaagcatgatctctagacatgggagacagggcagtgaaccaagctgacaaaattccctgaactcctgaagctgacatccttccattcggatgggactccaaagtttttccaagcgaggagtagagtatatacgtctatgctgagagcgctggccttactctgttattgtcagtccggccttatccctacaaggacttggtgagaaggcaaccctctgcttcaacttgatttgtgcgttttgtgtctccccgtcaccatttcagtttcttgctcttacaaataaaggaataaagtgcacattacacgcagccaccagtgccatgcaggtctcactctttatgcagcataaccaagccctgaaggctgtctgtgctccccgtgctgctagtgagggtggattcgaggctgccagcacgtccagaccaccggcatgtccagaccccccttatctcctcatgccttcttcctgcagcctcaccccaatcctactgaagcaagatcaaagcacaaataactcccaatgtgggccttactgttccttcccatgatcagaggtcatgcgtgacccagagcgacacgcagtgtgatcactgacatcatagacacatgtagagatgcgttggtgtttggtgacgaatatggaaattcaataaaaggcaagttaattaaaacagaacaagctgtggcctggggcagggaaatgtaactgctgattgtgtgacggagagttcagctacaaggggagtgggacgttttctctctttcttcctgtgtttctttggagtctgtttggaaaaggcagattctgagtttgaggggtagggagtgaaggttccaggctgggatgcacgtgcgtggtgcacatgtgtgtggctgctccctgtgtgggttccagatgaagaagcactcacagcccatcagctccttgacaaccaggaggacaaacctggtttgtccttgcttagaatcccagtgcagacgcggtgcctggcactgactaagagtatttcttactcatgccaatagtgatgttttgaaacaaaacaccctggtatgggttgaattgcgtctcgccccttcccagttcgtatgttgacatcttaacccccaggacctcagaatatgactacattttgatatagggtcttttctgaggtaattaaggtgaagtgagatcattaggttgggttctaacccaataggactggtgcccttataaaaagagaagatcaggccgggcatggtggctcacacctgtaatccccacactttgggaggccgaagtgggcagatcacttgaggtcaggagtttgagaccagcctgggcaatatggtgaaaactcatctctactaaaaataaaaaaattggcgagcctgtaatcccagccacttgggaggctgaggcaggagaagcactcaaatccaggaggcagaggttgcagtgagccgagattgcaccactgcactccagcctgggtgacagtgtgactgtcaaacaaacaaacaaaaaaacaagaagaagaagaagagaagggaagatcaggccggtcacagtggcttatgcctgtaattccagcactttgggaggctgaggagaaaggattgcttgaggccaggagttcgagaccagcctaggtaacgtggtgagacttctctaataaaaataaaataaatcagccaggcatgctaccatgtgcctgtagtcccagctactcaggaggccgaggctggaggatagcttgagctcgagaggtggaggctgcagtgagccatgatcatgccactacactccagtctgggcaatagtacatgactcaaaaaattaaaaaaaaaaaaaaaaaaaggagatcaggacacagacacacacagggggacagccatgtgaggacacagggagaagatggcctctacaagccaaggagagagggctcaggagaaagcagccctgcagacaccttgatcttgcacttccagcctccagaattgtgagaaaatgaatttctatcgtttaagctgcccggtctgtggtatgttgttttggtggctctagcaaatgaatatataccccaaccatttatcattgctcaggggtctatgggtgggaggggtggctctgctgaaccgggctgagctcacctatgccagagcttgggtggccgttggcaggtccttgatgggctatgatccacatggcctcccatgctccagcagagagcccgggcttgttgtcatggcaacggcacggttgcaagacagagggttctagtgcacagacttcctgagacttagactcccaatggggatgtcataacttctgctgcctcctattgaccaaagcaaatcacatgatcagcttagattcaagaggatggaaacagaccccatcccttggtgggagttgctacacagtcagaaagcaaatggtttagaaggcctggatttagaaagggggctagagaaacagggttaagtttgccatcagtctagaggattactgagcatttccttttgaatgtaagaatctgaacttaaaatgtttgagtaatctggctaaaatgtttgagtaatctgggccgagagtggtggctcacgcctgtaatcccagcactttgggaggctgaggcaggcaggtcacgaggtcaagagatcgagaccatcctggccaacatggtgaaatgccatctctactaaaaatacaaaattagctgggcgtggtggtgcacacctgtagtcccagctgttcgggaggctgaggcaggagaatcacttgaacccgggagacagaggttgcagtgagccaagatcatgccactgtactccggcctggtgacagagtgagactccatctcaaaaaaaaaaaaaaaaccagcttgagtaatctggaagccaattatccacactaaaaaattatccacattaatcgggaagccaattatccacattaaaaacattaatggcaatttgcttggcaaaggcagactctgagtttgaggggtagggagtgaaggttctaggctgggatgcgcgtgtgtggtgcacatgtgtgtggctggtcctggtgtgggttccagatgaagaagcactccagcccatgagctccttgacaaccaggaggacaaacctggtttgtccttgcttagaatcccagtgcagacatggtgcctggcactgactaagagtatttcttacttatgccaacggtgatattttgaaacaaaacaccctggtatgggtggaattgtgtctcaccccttcccagttcatatgttgacatcttaacccccaggacctcagaatgtgactacatttcgatatagggtctttacagaggtaattaaggtgaagtgaggtcattagtttgggtcctaaccaaataggactggtgtccttataagaagagaagatcaggctgggtgtggtggctcacacctgtaatccaaatactttgggaggccgaagtgggcggatcacttgaggtcaggagtttgagaccagcctgagcaatacggtgaaaccccgtctctcctggaaatacaaaaataagctgggcatggtggtgcacacctgtagtcacagctgttcaggaggctgaggcaggagaatcacttgaacccgggaggcggaggttgcagtgagccaaaatcgtgccactgcactccagcctggcgacagagtgagactccacctcaaaaaaaaaaaaaattttttttttgagtaatttggaagccaattatccacactaaaaaattatccacattaatcaggaagccaattatccacattaaaaacattacaaattctcgctggagcccaaaagtttgaggctgcagtgagctgtgattgcactctagcctgggtgccagagcaagaccctgtccccaaaatagtaaataaataagtaaataagtaaataaataaaatgattcttggctttacagaaggattcaccataggatcacccagttacagaagcatcccagtgtgtctaagggatcactggcagggtattcactcctggctgggatcgaggagattggaagtacttacgaaggacagaaatgcttagaaacagagttaggaggccctgccaagcagccatcaatcagagaggaagatatgcctccctgaaattaagtccaaaggaaaacccagaactgacccacattctcagtgacagggtttttaaggtttatggtgtatcccaggaaatctatacatgttaaataacagaggtgggataagccctggtttgaggccaataagaaaagctctatctcggctgcaagagtcaagatttcaggccagtcactgtggctcacacctgtaatcccagcactttgggaggcagaggtgggaggatcgcttaagcccaggagttcaagaccagcctggacaacatagtgagatcctatctctacgaaaatattttaaaaatgagcccggtgtggtggcacatttgacctgtagtcaaagctacctgggaggcttaagcaagaggatcacttgagcctaggagttcagggctgcagtgagctacgattgcaccactgcactccagcctgagcaacgaagcgagactctgtctctaaaaaataaaaagatttcaggctgcagctgaaatgccacttcctcccaaagcccctgtctgggtcttcagccaaaagcaagtggccatgctctggtttctcagactcctgaactcctctccaaagtagtgcttctcacacagggccagtgcacgtgcccctgtgcgctttgccgtttgcggattgcaaaccgcatgagggcaggaagttactgggatcattttcccagcaagtgggaagcccaccatagacatctgtccattgacctccccgtgcccccttccttctaaatccctttgctttctgacttggtagcatctcctaccacgaggtggggtctgtttcccacctcttgaatctaagctgatcatgtgatttgcttcagccaataggagacagcggaagttatgacaaccccattgggagtctaagtctcaagaaggctgtgcactagagccctctgtcttgcaaccctgccattgccatgacaacaagggggaagcgctccatttgcttttggggaagaaactgagaataaccgcgttgagcaaagtacaacatccctcctcggcagccccattcctttaggaaagccttggaaagaagcagagatttatttacaaggaaataaaaaggtttgcatttataatgggctaggtaccatttaagtgggtgctgtcctcagcctgcctgccagggatgtgggagaggcagatggtgaaactgtgattggctctggaagctaaaactaatacaacactccctgcccaccccaccagctgaggtgcggcaccaaggaactcactctggggggatgtcctaaaccaaaccctggtttggtttatagcttgtttgaactcgactttgtccagccaaatgtttctcaacagctctgaaatatgtgagcacattccttgaatgctggtaatttagtcccaattgctacttgctggtggaacacagcaactgaaaataaacaagattcatacttattttcaagcacgttgcaatatgagcaaaattaactttggtaaacaagaccctcctgaaaaaagatcgagttggtagaaactgctctgtaccctgaaaactaattctgaggctgaaaagacccagtaatcaaaggcaagaatagcaattttcaggatggtaatatagcgggcagatcggagccgggccagggagcgcgccactctctcaggagtacaatacaatacgatgcaattaattttcctccaccatctttcatgtagaagtttaacaaaatgctctgcagctaattaccaacttcctatgcaaatataagcagagtgtgtagtttgcaattcatcaaatggatacagtgagaagacaccctagaagacacagagatggggagatggcccaaggagagtgttgatggcaccattaaccaggagctgttggtctcctggagggggcaatgtaggaaccagtgggggtctgggtatcaccaggaagctgagcacagacaggccaggatgccctggtgagaatgaagaatcagacatctcatggacacaaagaaggagtcagaagcaaggaagagatgccagtcctgatagggggtgtgtgagatgctgagctggttctggagggggtcgattgaaattctgatgtggacaagatgccaccaaggtctgtggtgacagcagatggaataggcatgcatgtctggatgaacatggaggtgaatgggtgtgggtgtcccgggatagggggcctgcagtgggacagtgcagagacgggggacaatgatgggccctagagagtccctggaggtggtagtatggaagcgggggcagagaagtgctgggtagagaagggcagtgtccctggcaaaagctccacccttggacctgggcctacggacctgaatgaggacaggtatttctgttttcacactcgaaaagttgtcttttggcccaccacgctgcccatcctgtgcccataaaaaccccagaccctagcgagcgcagacacaagtagctggacattaagaggagcagaatagcacaccaacagacaccagcagacgctggcagccagtgacagcagaactacgctgacgccaaggggaatttggccgggggtggctgcaggagagtccggctgctgggtggcctgactccaggaaaagaccaccttcccactccattccccttctttttccctatccatcttgctaggagccacctccaccactcaataaaaccttgcatccagccgggtgtggtggctcacgtctgtaatcccagcactttgggaggctgaggtgggtggatcatgaggtcaggagttcaagatcagcctggccaagatggtgaaatccccgtctctactaaaaatacaaaaattagccgggcatggtggtgggcgcctgtaatcccagctacttgggaggttgaggcagagaactgcttgaacccaggaggcggaggttgcagtgagccgagatcatgccactgtactccagcctgggcaacagagcgagactccatctcaaaacaaaaacaacaacaacagcaaaaaaccttgcacccattctccaagcccatgtgtggtctgatttttctggtactctaaggcaagaacctgggatacagaaagtagcgctctgtccttgcgataaggcagagggtctaattgagctgatgaccacaagctgcctgcagacagcaaagctgaaagagtgtactgtaacacacgcccactggggcttcgggagctgtaacccctcaacactagatgctgctgtggggtcagagccccaaaacgctccccacgaactgcctgtctgtatgctcccccaggggtttgggcagcggggcaccaaagaatcgagccgtactcctgtcacaatgccctgagagggggataagggaggttctcctgtttcagtgtcatcagtgaccctgtcccatccaacaccccttcatgttcctgacatcagaggaagacacaatcccggagttggagaagaggaccaagactgaactgggaattttaggtgacaatattctaatgacatgtcaggggtgacactggtgggatcctgaggtcaccaagtgatagatgggagcggtgaccagagctttacagcctacaaaggactcttagtggtcaggaggcaggcaggtatgaaggccccttgtcccttgtctcatctccaggccgacaaaatcagggctcagaatagaagactcattgggaaaaacatgtacaaggctgattcaggaattcaggtccctgattttaaatccagggttcttaggatgaaaacaacttccagcttaaacctgataaattgctctgaaatgaacccaatgaaagcaaaaatagaaattaatatacgaaaacccgagtgtgttcagaatgctaagcattctggaaataatagaggaaatcagtcaaatcagttgttggcatcttatagatcaaaaaggaaaaaaaaaaaaaaaaacaagaaagaaacaaacccaaacagaaacccaatgaatgaagtgatattttccctccgcgtcagctgttttggtgtttttgtttgtttgtttttttcagagcccattgtcaggagagcatagttctgactaatgtaggtttagcccatttttgtttcagaaattgtaaagaggatctcagagattcacggatggaggcctaggggtactgcctacttacctgcaaaccagcaaagagatgatacaggctcctacctcaacacttcaaagtccttcttctttgaaatagctgaaagatggagccaaaagcacgtgagagtcaaggtcagacttagctaatctcccgcaggtaatgcctttcaccttcataaagagaagaattacaacactgtcttcccgcatgtcctcagctgatggccagagaagaggaagataatatttactattttgtccttacaaaatgcacacagatgccgaccgtatatttgaaaagcaggggcttaatattttgagatgaggtgtgggaccgggaaaatgtggacgatctcaccttattcatttatctaaatttgacagtggaaccttcttccacagaactcaatgtcacacccgcagaatgccggggcgtgaaacaaggccactgttaacacgaggaagaattacttacgatgtattaacaagacaaaaaagtcaggagaagtggaagaaaatgatgagactatcagcattagttcctcgctggctgagtttagtctgaaatgacagctttgcccgcaggctacaaagcaagcattcagagagattcaggagtggtcttgctttcaaattttgctgagctgaagagtgtcatttttcattttcgtgtcttagaagcccatgtccacaccttctcatggtagccttgcctgcctctctccctgagaaatgtctaggcttcttagattgcagcggcaaatcaaggtgggctcctcttacctgggggagaaagcctagactccaaccccagtggaagcaaccaccgtgccatcagggtgccactgaacagggctgctggctgcaggagacgtgggttctctcttttcaccttgaggaagagctgcccagccccacaccttcccctgtggaattctctcgggtgatgctgtcattgtcctaccctggcagaccctccttggaacaggtgtgtgctttcagccaccgagttttgccagaagctcaggaaatctgtatcttcacttgctggcattgacggatgatcctatcggtagggggaaaatgctatggtcatgcactgatgatgtggtaggaaagaatttactgcataaacatctactttctgagaagggctgggaacagaaggccacagggggtgagaggggtttcttctccctgtcagccggctcttagtttgacctgccattcagggcttggacacaaaagacaaaacaagacaaaacaaaacaaaaacactcagagctccggaggtctttgtctcatgtccatggccatgcccggagccaggaataggagcaagctggtcattctgaccccagaccctgacatggggtaagcttccttcagagggctggtgaaagctttgtcttggtgtggcaggaactaagaatgcaaaaaagaaggagagtgaggccagatgtggtggctcacgtgggtaatcccagcactttgggaagctgaggcaggtggatcatgaggtcaggagttcaagaccagcatgaccaagatggtgaaacccccatctctactaaaaaaaaaaaaaaaaaaaaaaaaaatacaaaattagccgagcgtggtggcaggtgcctgtaatcccagctactcaggaggctgaagcaggagaatcccttgaacctgggaggaaaaggttgcagtgagccgagatcgagccattgcacttcagcctgggcgacagagtgagactctgtctcaaaaaaaaaaaaaaaaaaaaaaaggagactgagtgattgccgttggtgcaatggaaccaccagaggtttctggcagagacagccaaagacctggtgtgtcctcccctggggctcctcaggccctggctctacagaaagaccagcatcaagcatgcctttgccctaggtggaggctttagaaagcagggtggttgctaagggcagatgccaagcactaatacctgctgtcctgccttcttaatagaccttcaccctcaaaccctttcatttttacaagactcctgcctgccgcagttcccatgttggggagccagtactcacgggagacattgttttaatcttatttttaatttttgtgggtacatagttgttgtatatatttatgaggtacatgagatgttgtgatccaggcatgcaattcataataatcacattagggtaaatggggtctccatcccctcaaacacttctcctttgtgttacaaacaaccaattttagtgttttgattactttttttttctttttttggagacagagtctccctctgttgctcaggctggagtgcagtggcatgatctcggctcactgcaacctccgcctcccaggttcaagcgattctcctgcctcagcctcctgagtagctgggattatgggcacctgtcaccatgcccggctaacttttctatatttagtagagatgggtttttgctatgttggccaggctggtcttgaactcctgacctcaggtgatccacctacctctgcctcccaaagtacagggattacaggcatgagccaccgtgcccggcctcttttggttacttttaaatgtacgaattatttttgactacagtcaccctgttgtgccagcaaatactaggtcttattcattctttctaattatttttttgtgcccattagccctcctcactccccctcacgccccctcccactccctttcccagcctttggtaaccatccttctacttctctatctccacaagttccattgttttaaatttcagctccccagtgggcggctttcaagaagaccactaactgagtagagttcaagctggggcaagtcacttgacctcaatttacccatctgtacaattggagtgacagagcctacctcgcagggtggctgcaaatgtcagaagacaccgcacgctggagctcagcgcccatgcacagggacaggtgaggggtgccgacagtgtcagcgaagggtctggggaccagcaggaagcaggaatgatgggatgtggtgggaagggaatgattctgctgaaagtggggaggcaccagagggtacctcgttagcagcttgaccgggatcatggccagctccaattggtctacacgaatggtactctgagggtcatttgtcatgcaagtaacccctgccctcccaccttctggcttttaatatattagcccgggaaatgcccggcaggaacgcaaaccgctggaaaagatctctgggttgcattccaggcagacggcagtggtacccactccccgtctccaccaggagacccctctggagggaggtggccgggtcaggctcagcttggggcagcgcattctttctcggtccactagggggacatttactaaatccccacaacctgcaaattccatccttgctgggacaaatggctccctcgtgtctctcaagacccactgctgtttgttaacctgctggacagccaatctcttatagctttcaggggacaggaacatatcaagttctttccttttttatttttttaaacagtgaatgtgaatgtactgcagatttcccgtgaaatgctccatcgtgggagttactaactgatgagtgcattcattcgttccttcattcatgcgtagggtacctactatgggccaggcctgtgcaaggctcttgaaggacaactgggaagaaaaatcagacatggccctattcttatggcacttacgattcagtgggaagctagacaataaccaaataattgcataaacaaatgtaaaaaatcatcaatttaggccgggtgctgtggctcacgcctacgatcccagtgctttgggaggctgaggtgggtggatcacttgagctcaggagtttgagaccagcctgggcaacatggcaaaaccctgtctcttaaaaaaaaaaaaaattatccaggcgtagtggtgtggacctgtagtcccagagtctcaggagtctggggtgggaggatcccttgagcccaagaggttgaggctgcagtgaactatgatggtgccattgcacttcagcctgggaaacagagcaagaacttgtttaaaaaaaaaaaaaacaaaaaacaaaacaaaacctcacaaatgtatttatcttttgagacagggtctcactcagttgcccaggctgcagtacagtgacttgatcagagcttattgcagcttctaactcctggaccaagtgatgctcccatttcagccttttgaatagctgggaccacaggtgtgtgccactaaaagattgttttctgtagagaaggggtctccctgtgtcccggctggtcttggactcaagggatcctcccacctcagcctcctaaagtacggggattacagatgtaagccaccacacccagccacaaatttctacaaagaagagttacacagtgttctcacagtctacagtaggagggttggactcgctcaaaaggaggggagcttctctgaggaagtggcccaaaagatgagagagagtcaattaggtttttaaaaaaaaaaaaaaaaaaaagccatccaggctggggaatgagcatttgcaaaggccctgtggcagggggctcatggcaagcaggaggtcagagtggaaagggaggggcgcagggcaagaagagatgtggagggggcaagggccaggcttggagggtcaagttaagacactttagtctttatcctaagagtaatgggaacccctgaaggatgtaaagggagtaacttggtcaaatttgtgttttagaaagaccagctggggcatgcctggtggctcatgcctgtaatcccagcactttgggaagctgagtcaggagaatcacttgaggccatgagttcgagaacagtctgggcaaaacagtgagaccccagctctacaaaaaataattagccaggcgtgaaggtacacacctgtagtcccagctactcaggaggctgaggtgggagaattgcttgaacccgggagttcaaggcttcagtgagctacaatcctgcccctgcactccagcctgggcgacaagagagaaaccctatcttaaaaaaataaaaataaaggccaccctggctgctcgcagggggctggactgcccccaccacatggccctgcagaaatgaaggcctagtccctgggtggtgggagggctgctggcagaaagtcccggctccccatccttcagggatagtggctgtggggaacgtgctggctctgaggcatactccattccaggacagccagcagctgatgcatgatcaacgaggggtaaaaaggcccagactcagctctgagggtctccccaccccatttccagattcccttcagggttgtctgaagccttcacggaggctgcctcaaagctcaatatccttcctgcctaattctgtacttttcccttccccggatgccagtcctaagagaaccccttgacagatctcctgcacagtctcctccctctctgagtctgcttcctggggcacccacccctccaccctccggcaggagaagggatcagagacagtacagagtggaggaggggatgggctctctaagtcagatggagcgagctcacggcctgcactgggtggtgacggaagagacccaggcaaggagggcgcctgtcagggctaaatcatgtccccacaaacgatgttaaacctccaaaagatcatgtcctaacccccaatgcctgcaaatgccatcttatttggaaacagggtctttgcagataatcaagtcaagatgaggttcttagggtgggccctaaaccaagatgactagtgtcttcatgaaaagggaaatttggacacagacacacaggagagcacacgtgaggatgaaggtggagatcagagggatgcgtctacaagtcgaggatcactgcagattgtggagaaccaccgggagctggggagaggcctggggcaggttctctgcccccagaaggaaccaaccctaccaacaccttgatcttggacctctggcctccagccccatgaggccatacatttctgttgtttaagttgccctgtttgtggtactttgtcgtggcaggcccagcatactaatataggacccaagaggtagctggggaaagattgggcaaactgtgtgcatggcatcattactcaggtcaaaaatttgaaatgaagctcaaacttaaaaatattggtaagtatgaaaaaaaaagcatgataaaaaaaaaaaaaagaaaagctattgctgctaaaggaagaagggtagggtttccccacctccatcagcttgcaaaaatgaggctggtgacgtggctgtgggtctcatttcctgcacggcctgttggggtttgtgtagtttctgggcactcagcttgagaggctgacctcccaaaggcattgggagcctgcgggagccagccagggggagcacagctgtgcagccatgcctgtttgtcctgaccctacagcaggacgcaggcgccccaccacccagaaccccagaaccggatgtaggaggtggtgagagctgcattggttgatttcctattttcttccttcctatttttttttttttaattttttagagcaaggtcttgctctgttgcccacgctggagtgcagtggttcaatcatagctcactgcagcctctacctcccgggctcaagcaatcctcctgccttagcctcctgagtagctgagaccacagatgcatgccaccatgctcggctaatttttaatttttttttttttttttgtagaaaaggggggtcttgctatgtggctcaggctggtctcaaactctgaagctcaagtgatcctcccacgttggctgcccaaagtgtggggattataggcgtgaggcaccgcacctggcctgatctcctatttcagtaatgtatcacctcctgtgcaaagaaggaagattgttgcaaattaaacataaaaacatgaaagcttttcaagctgggtatctaagtagccttttcattcccaccaactccatgacagattcctatatgtgttgtgcataaccattattaaaataacaatatcgccctgttggaagaattcagaatgtcactagaacattctaaagataaaggccaaaaaaaacccaaaccccccccccacacacacaaaaaacacaaccaagctttatctttggaacagaataaggttaaaaaaaattaaaataatcacaaaggtatgatttaatctttacaatgttataaatattaatatgaaaaagactttatattgggaaacattattatacagtataacgctaattttatgaaaatcaattcatttagtgctcatacattttttacctctctctttggcttttgctgacgatttacgtcttatcattttctacttcaacacctaccaccttgcactggggtacagtgcaggatttggacatcacaattttttcttcagtaatgccccaaggtttcccacagataagaggagaaggttggccaggtgtggtggctcatacctgtaatggcagcactttggaaggctgaggtgggaggatcacttgagcctgggtgtttgaaatcagtctgggtaacataatgagacctcatctctattaaaattaaaaaactagccaggcatggtggtgaacacctatagtcccagctactcgggaggctgaggcaggaggatcacttgagcccaggaggttgaggctgcagtgagccatgattgtaccactgcactccagtctgggccccagagcaagatcctatctcaaaaacagcaacaacaaaagaataggatgttgccaaaataggacaaacaactgagctgaacgttggatgtttttaatcataagcatggcttgatttacatcactcccttcagaaatgcaaaggcttcagacatcgagccaaaggcaaaaccattgcaggtatgtggggccgggagagccccagcgaagtcagcttggtgcccactccaggcaggcacagggccagccctgctatgctccttatctcctttaatcccctagcaaccccagaaggtaggtttgtgatgatccacactctgcagatgaggaaactgaggttcaagagagttactaacttgcccctggacatgcccctgggaagtggccgggatgagttggaaacccatatctacttagctccatggtccggctctgtgtgcactaagacatcaattaccccccgggactggaaaccagaaggaggcgggcaataggttgtgtttgctgacggatcccacccagaactgatcctactggatctcccttagggagactcaggaatcctcactacagtgaattacatgcacagttttggtggccagaggggcatttagatgatggctacaggagtgcttttttgaaagcttcattaactatacaagtcaataccctattgcaatttccatgaaatgggtaattcggtgaagttcttttttaacaaaatgttgcatcaatgagggaattcagggtgggagatcaacaggaagttacagttggaaccaatttcaacccacatagaaagatccggaagccttgcaaggagaccatcacagtaatccggcgtgagagtgccgaggcgtagctgctggaatcatcgcccatttttctaatttgcagcctaggagctgatcgtgcaaccctgttagggagctaatataggatgaagatgggacaagttggtgtcgagagtaacacgccggctccttagcggaggtctgaagaacaatcgagttgaattaatttctaagagaccccatgacagattcttgatgatgatccccaattagggaaacctcggtttcgtttttgtttaatgtcaggaagttaagaggctgtgggcggatggctgtgaaagacacggagggtgaaagccttgcctctcttgaaacgtatggggccgtggctgcaggtcctttcatgccttctccaaagaggaagtcgtgaaatctgtgtgtctcagcccatgtccaaagagggaaacgctgtgatgagaagatacagcggttcaactcattctggagcccacagaggcttaaaagagggggagaatctgtttcatgaaaaagggaaagattcagtcttgaaccagatgaatgtgcctgggtgaaaatgcgtcagtggtaccagaaaatccagacagaatccttcctctgggtttttcccaaatcaacaagtgtctttggttgctgggacgcagggagagagctgttcatggaggagcgtgggaggtcacattcttgaggcctgtttagtttatcctgttaaaaggaggagatgtgaggccaggcacagtggctcacacctgtaattccagcactttgggaggccaaggcaggtggatcacttgaggtcagaggattgagacaagcctggccaacatggtgaaatcccatctctactaaaaataaaacaaacaaacaaacagaaacgcctggcgtgttggctcacgcctgtaatcccagcactttgggaggctgaggcaggcggatcacctgatgtcaggagttcaagaccagcctgaccaacatggagaaaccccgtctctactaaaaatacaaaattagccaggggtggctatgcatgcctgtaatcccaggtactcaggaggctgaagcaggagaatcgcttgaacccaggaggctgaggttgcagtgagccgagatagtgccattgcactccagcctcggcaacagagtgagactccatctcaaaataataataataataataataataataataataatacaccatatattagggaagagatttttgttttttttttaaaccactttcagtctcttgatatctcattgcaagtaaataaccaaagtacagcctggtctggacaggagatcacctcaatttggggcagctcacacaatacagtctaaaatgtggatgttgctgggggcgacctcattagtcaggcagtcacccctgtgagagggcgatgcgtcccactgccaagacgctcaagtaccaatatggaatgccagtcccttaaaagattttccctccctacgtccctgcgaaagagaggctgcctggataatagtctttcaatgtgttgtgaaaaaaaaaatagtgtttctagcaaaagtgttaaagttttatgggaaagtaaattactgtctacctggtatagatgcttttcgcgatgtagcaggcattaattacacatctgaatgtgacaagatcagtcttcggtttactgaattgaagacggtctgctcaccaggagggggttttcctgaatatcatcagggttcctcctcctactccatgtccggttttactgtgtactcctgggatgggatctgaggctggaaagagctagaaaacccctccgagtccccccagagagatggtagcctgtacacccaggtggattttggtcactgaaagaatcagtcttctttttttctcatcttaaaatatctggacaaggaagtggctaggattattgtgggagaaactagctcattggtggttctgggatatgaacccaggattctcggccagcattccagcaacagggactgatatgctttggctgtgtccccacccaaatctcatcttgaattgtagctcccatcgttctcacgtgttgtgggaggacccggcgggagataattgaatcgtgggggcggtttccccccatactgttctcatggtagtgaatcagtgtcatgaggtctgattttataagggggaacctcttttgcttggttctcattctctcttgcttgctgccatgtaagacgtgccttttgccttctgccatgattgtgaggcctccccagccatgtggaactgagtccgttaaacctctttgtctttatgaatcactcagtcttgggtatgtctttatcagcagtgtgaaaatgaactaatacaaggaccttcccaccctgcactccacaaacacctttcagcaggcttttgtgactcccaatttgaaagtgctgcattcgttcctgatgtgaaatgatttgcgtataaaggtaatacaaatctgaacattgcttttttgcatctcacagaagcagaaacattcttctagaagaatatgcaacggcagaggataaaaatggccttttgagtctttcagtcatgaaaagatctccccaccaaaaatacatgagacctcttaccctagaacagtgtttcccaaagtaagttcagtgttggtcacctgtagacaggttggcttccaataccctggctcttgaccctggaattctcctggatcacatggtcgtggaatgctttggttgtaagtatgccttggtgcctgtcttccctgatacatgcaagatgtctaagaatagaggctgtatctattgcgttcattatcatcattcccaggatccatcatggtgcctgccacaaagtagatatatgatattttgggattgaaggaaggagattctacatggaaaaaaggttccatggtcaagtacattaggaactagataaaaagccttccttttgggggctcacaaaacaccactggataagacacagatggaaaaaaaagaaaagcaggtgtttgctctggctttttgtcattcttgctgcaggacttatcagaaccttgaatatgctgatgtgtatggtatcatctccaagataaggctgcaatgtgcagtggcccctgaagtcacttgattgtgtagcctcctctcctgggatactcagtaacattcaaagggagcagctggtaggaaggcctggagaaacccacctaacggacccctgaattacagggatagccaaggcagccctagagaggccaggctgctgggaagggcaccagatagaagcaatctacagacagcccagaaagctgtcattccctcactcaatcagcagatgtttctatttctgttaaaacaggatcaattcattttccaatcataaaaataacaagtgtgtacagaagccccatgcctgtcttgttaagcattgaatcctcagtttgacaaatatttgctgaatgaataaacatataataaatggtaaagtagtattacaaagagaatacattctgctatcaaaccatcctgagcactttcttctgtgactacttaccataaataaaaattccgtggcgaaccttattaaaaatataccggggccgggcgcagtggctcacacctgtaatcccagcacttcgggaggccaaggcaggtggatcacctggggtcaggagttcaagatcagcctggccaacatggtgaaacctcatctctactaaaaatataaaaaatttgccaggcatggtggtgtgagcctgtaatcccagctactcaggaggctgaggcaggagaatcatttgaacccgggaggcggaggttgcagtgagccgagatcgcaccattgcactccagcctgggcgacaagagcaaaactccgtctcaaaatatatatatatatatacatacacatacagatgtatgttatggcagggatccccagtgcctggaccatggactggaactggtccatggcctgttaggaaccgggccgtacagcaggaggtgaccagcgggtgagtgagcgaaacgtcatctgtagttatagccgttccccatccctcacattaccacctgagctctgcctcctgtcagatcagcagccgcattagattctcataggagctcaaaccctactgtgaactgcgcacgcgagttctaggttgtgcactccttatgagaatctaatgtctgatgatttgtcactgcctctcatcacccccagattggactgtctagttgcaggaaaataagctcaggtctcctactgtttctatattgtgttgagtataactatttcattgtatattacagtgtaataataatagaaagaaagtgcacgataaatgtaatgcatttgaatcatccccaaagcatccccctaaaaccacccccagtccgtggaaaaaactgttttccatgaaaccagtccctggtgccaaaaaggttggggaccattggattttggattcatgggcctcactgcagaactattgaagaagaatctgacttttaaaggcctccagtgatagtgcttccagagtccttggtctgagagccagagagatctgagttcaaaaccaggctctggcatttacaggtactggagtttgggtggggaacaatgaggtagttggctatcagcataagcttcttccagcagagggttaagctcagatacgaaggagaagaaggaaccaggcaagggaaggttggggtatattggtttaggctcccctagaagcagactttgagccggaagtgggagtgtaaataagtgtatttgggagaggatcccaagaaacaccatcggaggagtgggaaatgagggggaagaggagcagtcattgaagggtgccgggtaaaacacgcatcttggattttggttgctgagagagtcagtcttttttctcatcttaaaatatctggacaaggaagtggctaggattattgtgggagaaactagctcatcggtggttctgggatttgaacccaggattctcggccagcattccagcaacagggactgatatgttttggctgtgtccccacccaaatctcatcttgaattgtagctcccatcattctctggggcttttctccaccagtccctgtaagcctttgctaaggaattacgggtgtggttggggctggagggcgcctccattccctgtcactctggtagcaaatggtggcctgagaacgttctctggtataaatgtggtcccagcggttggactctggaagcctgtgttcactgaaggtcatggaaagggggcagcatctattacagggggcaggagtactccatgctaaaggattcgaagacacaaaagtcctaattggccaggcatggtggctcacgcctgtaatcccagcactttgggagtctgaggcagatggatcacctaaggtcaggagttcgagaccagcctgaccaatatggtgaaaccccatctctactaaaaaatacaaaaattagccaggcatggtggcataagcctgtagtcccagctactcgggtggctgagatagaattgcttgaacttgggaggtggaagatgcagtgagctgagatcgtgccacagcactccagcctgggcgacagagcaagaatctgtctccaaaaaaagaaaaaaaaaaaaaaaaagaagtcctaattaagagtttgatgtgttcaaggaacaaaaagaaggtcagtgtgactagaccgtggagagtgatggggagaatggtaggagttaaggcagtggtgtgctgggaaatagttacaaccagctctaaaaaaagaaggagcactgatttgtcatgtttgtcaatttccatggtgtaaatactcccgtcatagccgacttcaagctgccaatgtcaaccctgaacacagagctgggaagagatgtgcacgttcacgttcagctcttacaagccagggcaagctgactccagcaaacactgcagggccggggcaagccgactccagcacacgctgaaggaccggggcaagccgactccagaacatgtgggacaagccgactccagcacatgctgaaggaggagttcagaaaggaaaatggaaaggtcagcctgggcaacacagcaagaccctgactctataaaaaatcttaaaaattagctaggcaaggtggtgctcacctgtagtcccagctccttggaaggggaccgctgtgtcttccccctctccaggatttactgcattgattggacgttccgaagccttgcagagtggctaccccaggacttggcggtacagcagtgagcaggacacacaaagctggcctctgggaactcacaggtccaagcgaagataaaagccccataggaagtggtgagatgggacagacacgctggcactggaggaagtgacctttctactgagtcctgaaaagtggcaaggagaagaccaggggagtggcccagagaaagaggctcacttgagcccaggagttcggggctgcagcgagctatgattgcaccacagcactccagcctgggtgacagagcaagaccctgtctcaaaaaaaaaaaaaaaaaaaggaaaatagaaagccattagaagtgttttaagcagaggatagaaggaatgatctaatttatgtctgtcaacgagctctgaggctggaaaacaatgggctgacctggagcatttcggcatagacctaaactctatccactttagaactttggtggtgggcaccccagacacacccggcttctgaagagcccagtttccgagcaaagagagagaaaatccctcgtcagaccttctcatgctgggccgagatccatgcttccatttagatagcattaaaggtcttctataaattaacaaaacaggaagagctgcaaataaaaatggacatgccacaccgccacgggcatgtgaatttcccagtggttcccattcgccggagtaagttaaagaccgtgtcaaccttaacacaagctttggtgacttttgtcagtttaagtaagacctttaatactccttaaacatatttttctgtaagtaatagaatcgtggcagagaaacgaagctatctgtcatggaaacgccggcaaaggaggaacaggcgtgtaataacaggggtgcctgactaccagaatacctgtgcaaatgaaaattgattttctcgagaattcttcgcctgatgaaataaattaaatctacatttacttctatttgtttaaaaacctctttgttaaaataagtacagcagtatatagacataatccaataaattagaggaggataaattatacccaagaacattctgcacagagaatacacacacagaggggacccacagaaggaaggcctgtgaaaaaccacttaaatgtttggcttaattccatttgtaatggtaaaactgacaaacagatacgtttgggtttcctagagcttgttttatttttttccaaatcagttttattatgattttaatttggaaaaaataatctacagagtttccacttagcctgaagaaatacaagtttaactaggtcttaaaatttaacacagcttggaaagtgcgccagtaggaacaaaaacaatccctaatgagaggaaacaacattacaagacttacatgaaaagacattatctgaggcctcatcttcctgcctgagcctgccatcctgcctctgagactctcactttcccccaacaaaagggaaatgttaaaagcacagagggggccgggcgcggtggctcacgcctgtaatcccagcactttgggaggctgaggcaggcggatcacaaggtcaggagatcgagaccatcctggctaacacggtgaaacccccgtctttactaaaaatacaaaaaattagccgggcatggtggcgggcgcctgtagtcccagctactcaggaggctgaggcaggagaatggcgtgaacccgggaggcggagcttgcagtgagccgagatggtgccactgcactctagcctgggcgacagagtgagactccgtctcaaaacaaaacaaaacaaaactaacaaaaaaagcacagagagtttattgagcatcatgtaagggcctggcacttgtttgtttgagatggaatttcactgttgttgcccaggctggagtgcaatggcatgatctcagctcactgcaacctccacctcccaggttcaagcaattctcctgcctcagcctcccaagtagttgggattaccggcacctgccaccatgtctggctaatttttgtatttttagtagagacggggttttaccatgttggccaggctggtctcgaactcgtgacctcaggtgacccacccaccttggcctcccaaagtgctaggattacaggtgtgaaccactgcgtccggtgctggcacttgttatattaggtgtgcctcccagggcggtgctgggagaggtgaggtggaagctttttagtgattggctacatttatttatttatttttgcgaatttagttttttttttttttttttttttttttttgagatgaggttttgctctcttgcccaggatggagtgcagtggcatgaactcatctccttgtagcctccatctcctgggctcaagtgattctcctgcctcagcctcccgagtagctgggaccacaggcaggcattatcacatgcagagatttttttttttttttttttttttttgtagagacaggggtctcactctgttgctctggcaggtcttgaactcctgggttgaaatgatcttcccacctcggcctcccaaagtgctgggattacaggcatgagccagcatgcctgtaaactggctgcatttactcacgcactattgtcccatggcagggtactggtgggtgcacagaaaaatgaaactgttgtcactgtggttgctctgatgtcactggagactgtgagaaccacacaataagggcagctcatgttgcattcaaacgcgtcaaggcaggtgcgtcaccccaggctctgagcacacacctcatttcatcccgagccaacactgctcccatttgacagatgaggacgttgaggcctaaagtggaaaattatagccagcaagtctgactccaaagcccgtgtgcccacatggcctttctgtcccattgctggaagaagccgctgaaggcaccatgtgtatctttttccctaaggattttcttgttgcttttaaagggatggtaaaagtgaacagcttgagttctgtttctaccaagtatgggtgcttacttcccaatccctgtttttgacttctgctttttggattccttctgagctgttcatagaaatgggaacattatgtactcttaacttccaagtcgagcccagtcagattggtgcatccagaaacctaacatcacccagcgtcatctgaagaacctgcaacttttgagtttttggaactgaaagcagactaggagctgtgcagagctaatggcctcctgcagaagccgaacgactttgttacattaggtgtctccacaccctgaccccaatccctcacccttctcctctagtacccctgtgtcttccccatctccaggatttactgtgttgattggatgtttcaaagccttgcggagtggctaccccatcccaggacttagctgtacagcagtgagcaggagacacaaagctggcctctgggaactcacaggtccaagcgaagataaaagccccataagaagtggtgagatggaacagagaccctggcactagaggaagtgacctttctactgagtcctgaaaagtggcaaggagaagaccagggtagcggcccggcaaagatgtagatttgagaaagagaggaattgctgggtgctctggagtcattccatagggttggaggagtgggaagaaggaatcccagggaatcaggaggatgctttgatgggtcaggctagggaaattgagcagcctttctcagcagggcaaaggggactcacggaggcttcaaagcaggggaggacttggttggatttgcgttttacaaagactttagaaagatgtctcttccattattaacaggccactccatgccagcctcttgtgaagggcctgtccaatgcatcagcccccaggtgctcaggctcaaactcagggttcatctttccttcctgtctcctctccctctgcaagtgcaattcagggaattagcaagtcctgagacctcaccttaaaatttcatccccatcctggtctgcttctccccaccccacaccaatgccttttcaattcctgtggcagcctcctccctatctacctgccttcatgtgtccgccctccgctcctcccactgcagcccatgggcctcctaacatgaacatccatccctttgctcccctgcaggaagccccgccctgatctcctgctgctcccgggatgaagcccaagccccttctctggccccaggggtctgtgtggcctggcttctgcccaccccaagccacattttcctgcccactccacccgaccttcccactctggccaccggagcctccatttctccagtggccatgcccttccctgccctcctgacctggcacatctgtttgttttgttttttgagagagtctcaccctgttgcccaggctggagtgcagtggcatgatctcagctcactgcaacgtctgcatcccaggttcaagcgattctcgtgtctcagcctcctgagcagctgggattacaggtgtgtgccaccacgtccaggtttttttttttttttagtagagacagggttttgccatgttgcccagactggtctcaaactcctgagctcaagcaatctgcccaactcagcctcccaaagtactaggattacaggtgtgagccaccacacccagccactttttgtttctcttttgaaatggagtcttactctgtcactcaggctggagtgcagtggcaggatcttggctcactgcaaactacgattcctaggctcaagtgattctcatgctcagcctcccgaaaataacactcacttgaccactcccccatcaagatgtagagtctaattcttttcccttttaacttggctgggtcttaaggacttgtaagcaatagaatatgatggaagtgatgccatgtgactccaagcctagatcaacagaggccatgcagtgcccacctgatttcttggaatgcacactctcaggacacccatctcagtacccctgctgggctctcagccaccatattgtgaggaagcccaagccacatggaggggtcagtcttcaagactttccagcccaggggccagacatgaggagagaaacctctcaatgattccaaccctaggcatttaagccacctcaaatcacctccccagctgaacccccatacttcagggagagagacaagccatccctgctgtgctctgtccaaatttctggcccacacagtctctgagcatatacaattattttatatccttatgtttgggggtggtttcttacataccagtagataactgtaacagctggctatgaaatacccattccccacattccctctcccttgctaaaaggttttgtttgaggtggccatgtgcctagctaaatactggctctcccaacctgtcttgcagctggggtggccctgggacacagtggaagtctctgagaaaatgctttctttcctgtgaagagggaacagtgcagcttgtaccctctgtccctcccttttctgcttagaatgagaacacagtggcacagtggctggagctgcagccatcactctgtgatcttgagggaaatgtgggtttcaaagttaccaagtggctgattcaacacagggagctatgactcgacctttctggttaggtgagaaaaataacccccttttggtttgagcctctgtagccaggattcttgttgatcagttccacgtttctcatgtatgctacacttgtattctcagaagccatctccccaccagaccacaagctctgtgagattagggacagggtctgttgtgttcaccatcacatgccctcaccctgaggctggtacattggaggttttcacgtatttgttgaatgctatcaaattctatcaaatgctatcaaaggacactgaaggttttctaggtggttagacacagagtctcagagacatttccagcctgacaatttcatggatgaggaatctccaggaggaagggttgggtcagggtttctcagtctcattctggcacctgttcccaaggtcgccagggtccctggaatccttacttctctgtgcacttggactgggttgaggtggagaaatcgcctgccgttggaagcttcctctgcggcatttcttcccctggtattaacaaatgttaattggaggcaatgatcactggcctttcgtgtgccctttaggctaccgtaattctgtgacttcactgcaaaaaaaaaaccaaccttgtaattttacttggccttacagaaaaatccttagaggatgcattctaagacaagaggaagtccagacaattttttttttctcttttgcttgtggggttgattctgctctgcatacagatttaggtcgcacgtgtgaaatcgcgtacttattttaaaatggaataaacacgcagccggcttttatggccatcttcccccactgcatttcattctgacgtcctttggttacaaatgaccagtcacatagctggtctaacactcacactctttcctgtgaagagggaacagtgtggcttgcaccctctgtccctcccttttctgcttagaatgagaacccagtgactggggctgcagccatcactctgtgatcttgagggcttttagggcttggtgtacttgtgactttgtcatagtcagtaaaaagctactcatttactttcctttgcctggtggcctccaagttgtctgtgtgcattcttgggcataggtcggactacctttgggaggaacttagtttatagtttgaaacaaagatgataacagccctttcccaaaacaaacccccttcctgcctggggatgagagggcctttgtaggactaacaaattagccacaagattagaaataagggtttaggagtcacacaggcggaggctgcaagattctaagcctccccaaattgtttttggggataacgtcactattgtaaaacccaagaccagcgcttgagatactttgcaaaccctgcacttgatggatcagctggcaccacccagatcgatagactggctcatctggtcttgtgggccccacccaggaactgactcagtgcaggaagacagcttcaactccctatgatttaatctccttcctgaccagtcagaactccttattcaccggccccctacccaccaaattatccttagaaactccgatccctgaattcttggggagactgatttaataataaaactctggtctcccacacagctggctctgtgtgaattactctttctctattgcaattcccctgtctggataagttggctctgtctaggcagcaggcaaggagaatctgttgggcacttatagctttgtgtccttgggctatgttcttagccttcctgtgactcattttatccactgtacacagggatgtaactgaattgaggatgaattttttttttctttgaggcagagtcttgctctgtcaccagggctggagggcagtggtgtgatctctgctcactgcaacctccgtctcccaggttcaagcgattctcctgcctcaacctcctgaatagctgggattacaggcatgtgccaccatgcctggcttatttttgtatttttagtagagtccgggtttcaccatgttggccagactggtcttgaactcctgatctcaggtgatccgcccgtctcggcctcccaaagtgctgggattacaggcaaaagccactgcgcctggccaaggatgaactttgttaatgcgtgaaaggcgctgagagcaacacctgacacgcgttatatgaaaacaacaaattctgggtgtctttgcatccatctgagcagagagacggctgtgtctggagccagcccagggaggcaggaggcgttccctgacatgacatctcaacagtgtcttccagccttgatttctccacttgtaaaatgaaagagatcatatactagttagtgaaacctttggcaatctcagatgaaatgtgtgatgaggatgcagagtgttattgtaattccacgattacaatctctgcagagccgggaggcaggaggctggcgggataccactgcctacacacatacctgaggagttttctgtgtgtctgtgaggtttctattgaaaacaagattcacaaagggaaaatcaccaccagtcctggccccgcataaaagataacaaggagaagatagagcctgaaataccagggaggtgagacacaaagagtcagttaataaatccatcgaaagcccgtccccaaacactgaagccaaatttcatcttggaacactttgcataacaagcaatttaaggtaaggcggacccccgagagctacagaacgtttaaatgatgggcaaatatttctgtttggttgttaggagaaatgactttttgaactccagtctttgagtaaaacatgtttgaccagctataaacagattcaaactatttgcttttgcggggctcccatttcattttcatgaggttagagagtggcaggagatcacttcgtgagacaacaggttgtaaaggttgaagctggtagctacggtactgaattgactgaaaaatacaccacaacccacactgctgttgagcccattccgttggatgagaggacttgcaataggagtgctggcttccatccctgtctgcaggggaatgttggcaccagagatgaacagtgggccgttgggaatagagaattgcaattttttaaagagataagatcttgctctgttactcaggcatttgaaaatgcttctcaaaagacatcatgaagataagccacagaggctgtcatcccagaactttgggaggccaaggctggaggatggcctgtgctcaggagttcaagaccagcccgggcaacatagtgaaaccccatctctacaaaaaataaaaaaattatctggggatggtggcacatgcctgtagtcccagctactttgaaggctgaggtagacgatcgcttgagctcaggagtttgagaccagcctgtgcaacagagtgagaccccatctctacaaaaaatacaaaaattagctgcgtgtggtggcacatgcctgtagtcccagctactccaaaggttgcggtgggaggatcgcttgagctcaggtggttgcagctacagtgagctgtgatcacaccactacactccagcctaggggacagagtgagaacctgtttcaaaaaaattaaaataagccacagaatggaaagaatattggcagcacatgtatctgacaaaggacttgtgcagaatatgtagagaactcctacaaattaaccctgaagagaacaactcctaaaaaatgaacagaagatttgatcaggccccctcacagaagatctaagaatggccaatgaatacataaaagattcccagccgggcatggtggctcacacctgtagtcccagcactttgggaggccaaggtgggtggatcatgaggtcaggagagtgagaccatcctaacacggtgaaacctcatctctactaaaaatacaaaaattagccaggcgtggtggtgggtgcctgtaatcccagctactcgggaggctgaggcaggagaatcgcttgaacctgggaggcagagcttaaagtgagccaagatcatgccattgcactccagcctggtgaaagagctagactctgtctcaaaaaaaaaaaaaaaaaaaaaaagaaagattcccaatgtcttgagtcatcaaggaaatgaacgtgatcaccatggtagacacagtggctaaattttaaaagatcgacagtcccaaatgctgacaaagatgtggggaacatggacggctccatgctgctgtttggaacatggaatggcaccgtctctctggagtgctgctgattacaaagagcaacacgtacctaccctatgactcggcaattcccctttggtgtttagacaagagaaatgaaaacgtacgttcataaaatgacatgcactaggatatggatagcagccttgttcagaagaaccccagagtgaaaagagcccagatggataccatgcatctgggtccatcgtggtatgtttatgcagtggaatactatgcagcaataaaactactgatatgagtaatgatgtggatggttcttaaaaactatactgagactgggcacgatggctcatgcctgtaatcccagcacttcgggaggctgagggagcagatcacatgaacctaggacttcaagaccagcctgggcaacatagtaaaacctcatctctacaaaaaaaatacaaaaattaaccaggcattgtggtgcatgcctgtaatcccagctacttgggaggctgaggcaggaggatctcttgagcccaggaagttgaggctgcagtgagctgtgattgcaccactgcactccagcctgggtgacaaagcaagaccttgtctcaaagcaaccaaacaaaaaactatactgaacaaacaaagcaggagacaagagtataggctgcataaacccatttatatgaagcccagaacaaacaaagcaatctgtaatgatagaaagtggtcacctggggagagggaggaaattgactgaaaaaggggagaaagaactttctgggctgatggtggcatctaatctttgctatctgatatggtggccactaacctcataaaatgtgacttgaattgtggctggtatgactgagagactaaatttttaattttatttaatttttccttagaggcagggtcttgttctgtcatacaggctgcagtgcagtggcatgatcacagctcactgcagcctcgaactcctgggctcaagcaatcctcctgcctcagcctctggagaagctgggactataggtgtgcatcaccatgcccagctcattttaaattttttcgtagagaagaggtctcactgtggtgttcaggctggtcttgaactcccagcctcaatcaaccctcctacctcagcctcccaaagtgctaggattacaggcactagccacagcactaactgttaaaaattaacctccaaattgagatgtgctgtaagtataaaacaagcacaaagtttcaaagacttgttactgaaaaaagagaacaatttcttatcattttgtattaaaatcatgttttaaatacactgggttaaaaatataatattaaagtaattttcacttgtttgttttacttttccaaatgtggctcctagaaactttaaaattacatgtatggctcttgctccattgctatcagacagagttggtctgtgttttgtttgggtagtggctacctgggagtatgtaattatcaaaactcgctgaacggaatgcctaaaatccgcgcattttgtagtgtgttaattatagttcaattagaaaatgacacacacatgacccctgcttgactcagacacggtaatagaaattgggaggcagaagtgcaatgactgtgagggagaatgaaaggtgctgcaatgttctattcctttccaggagtttaactctaaaattgaacctagctttatgatacgttcaaggagtgggagtctgttgaatttaagaggcaaatttaggcagaacagctggctaattagtgtgctgccctgggagccattgtgttttacaagtgagaaggttccatagccccaggactggtttctctaagccctaatctccccctgagggcctggacttgccctactggagagggctcgactgactcctcccctgaagcagctcacacactacactgtctccccgtccctcagaccttgtcctcaaagaaaaaccccagtgccaacctgcttaggctcaagtgcattttcaggggagcaaaatcttttgaccaagaagatacctttccatctgctacaggcaggccaggagcctggtggcatgagggatgttgacttcctgaacccaggtggcaacgtggcaaagggtggggttaaccactccatctatctgccctgaccagggtgaccacagctttgggctggttcaggcaggaagcacagatgcatgctaagagtttccactgtgggtatggaggggcaggaagtcaggagtagtgggtgaggagtgggagaggaccctgaaaacagggttggatggatggttgtgcgaagaattgtggtcaacatcagctccatccccatctgattctatcctttgttgggggggggtggggagtcagacgtgcagacacagcttggcagcaggtgcagagaatgaccaaaaagcaaacacaatgaaagtgaaggtcatgagctttggaccttccagatgtgggttcaagtcatggctctggtgctagcaatgcaaacttgtacatgttacttaatttgcctaaatctcagtttcctctcctgtagaataaagacaatagtagctgctataaaggatgagttggaagttatgttaaatggggtgatgtcagctgagtgtttggtaaagggtatcattggttctgggtggtggctgtattctaatggggccctagccaatgacttttgagacaaaggagagaatgaagcccccatggagtgggtcagggccacagccaaggagggtgaggctcacagcagtgctcccattccagcagaaagccagagggctaatcagaaaatgggtgggctgctcatctatattttatgtcttaggctgtgttctctagaagcagatctttggggaagaattcatgtgaaagtgaaaatcccctggtagaaactgctcttaggaaaaactaattggaaagtagggaagcaggaccaggaagagaaggtggccaagggagggcacaatatcaagcaaagtctcacagagaaccatagtagccaccccaagatggcacccaaggatgctcccctcatggtatttctgcctttgcatatccctgctcccactttgaatacgatggacctgtttaacaacagcgattgtgaaacagatggagtgtggcttccaaggctagatcacaaaagactgcagtgtctcccttgctctcttggttcactcactctggacgaagccagccaccatgttgtgaggatgctcaagtagtctgtggagaggctgatgtggtgaggaactgaggcctcttgccaacaaccactccaacttgctggccttatgagggagccttcttggaagcagatccccctgtctcagttgagtcttgaggtgacgcagcccagctggcatcttgactgccacctcatgagagacataagccagaatcacccagctaagccacccatgaattcctgacccacaaaaactgtgctttggattgaatatgtcccccaaagtccatgtgttggaaacttattcctcaatgcaacaatgctgagaggtaggacctctaagaggtgattatgtcatgagggctctgccttcataaattaatgttattatcatggagtggggtttttatgaaagcaatttcacctccctctcccccctctctcatccttttttgccatgtgatgccttctgccatgttatggtgcagcaagaaagtcctcatcagatgcagacctttgatcttggacttcccagcctctagaaccatgagccaatagatttctgctctttataaattttcaagtctcaggtattctggagaagcagcacaaatttgattaaggcaccctcttagtggcattaatgcccaaagcatatgcatacatttccagaggtcagagccccctagaactttggtgcttagaaataggaatggatttctgaattcagaggtaacacgctgcctcatatcacacacttgcagcttcctttatgtaacgtaccttattgatttctatttaataatgactgatgcagctcttgggcctttacctgatgaatcaaagctgtctgtcaaataggagagatagggcaggagtgaagcattattattccaaagcacagtcattagattaatagtaagctccagcaacaccattaacgtggggagaatcgatgaaataacagaggcaaggctgcctccagataagatcactgcttctctagcatgtgtcctatttatagatcatatgtgttcactctacctttggctctttcttccatcgagggctcccaagtgagctgattataatctttaagactacgtgtcagcagcataaaccaccatcaccatcactccttatccttgacccatcgtcttccacctgcccaccaggaaaattagacaacactctgttgctttgttttggaacaaagacatttttcacaactttcccaaaagaaatttttgtctcaccatgatcaatcttttcctagaatttgggaaaataaaaactttaaggccataaatagtaaactttgaaaatcatttccccaaatggatttccctgtgcccttctgttcacaaacagttagctctcccaattcatagcttgtcagcaaagtgactttattttaatgtctttagtttttatcttctcgatttattattcagaataggtggagagaaggggggagaagaccctttctctggaaggtactcctttctgaatctaaggaaatgattctctagttctgtactagagagttgagtgagactaaagctggtggtgttaggaaggtgggcaaggtcgtcactgacagctctcttaagaatcttaagcatgtatgaagggatggacaaagaaagaccaccagtggatgaaacagagtctcagtgccatgtgaaaagtggccagccttgagagatcccttttagccatcacatccatccctgcaacctggacagcacctcctccactcaggacctcctccacctcctccactctgagatccaccccctgtccatggctcattctgaaccacaggcttcttccacgcctcactctgcctgccatcttggcttgaaccctcccagcctctgagctcactgatcatacattgattatttttctgtgtctagcctcatcttgcccttcggacttgatgctttgataggattccagtttttatcttgagctattattgacttagttcaacttccctcttggttcaactaagccacagcacatttcctctgccctcagtgtctgcccctaccccaagaagagtcatcttgcctttcccttgcctttccccacaaataggaccttaatagagagatatgggacctggagagagacatctagagtcaagtcagaacagattagagcaacctgtggcccaagctggcatctctttctcttggatgttctctgtgtaccgctgtccctcgataactttacacgtgtgaaggtaacatttaagaaaataattttcccccacatcccgctctgtgcattgccaatggtttctaatcagatggcttgaggtctcccctccacccccaattttcctttatgcttcatattagaactatggactttctactgatggcctattaaaatgtatcttttgattaaaatcatacagctcatcaccaaacatgccaagccatgataatacatgaagggtaaaacttgggcacgtaactcataaattctaaatgatgatgactccattcttctctccctttgaaaatttaagatcaaaatcctgtaaaagtggaaataatctgaatgctcaacaacagggatgggtaaagaaatggactcgccctagtaaacaattaatgatcgagttcgcaaagaccacttggtgactgctgcgtgaaaaagatgggatacgaagacctgtcttccatgtaagccccattctgcagtggcctgcagcctcacctggggcactggcctgcaggtctgggaccatctctatcttccttccaagtcttgctggggagggcaggccaagtcagttgtgagagtgcagtctcgatgatgttagaagcgtagggtccttagcaggacgtcaactaaggttgcagtgaagggctgcaattttaagccaggcgcaaggtggaaaaagcctgtggtgctggtgggtggtagagagttggtggtgaggaggggagtggggcaggggaggataagaggagagtggggaaccacagggatggagttggggaggactggtcgtccacaatcaccgtaatgagaacctgaactagcaatggcaagtctcctcaggagatggtgttcaagccctatctttactctttggagcctatcttgattgttttttaaatgtgatttttacagaggcacagaatgaatagaatctgtgtcatgctgacagttcacggggctgagttcctgtctgttccatttcgtgtcctgctgtgtcctaagcaggaacacacatccagcccacagagactggggagtgaccacagaatgggaggtggggtgtctgtggcaggctgtagctccctgggctgaggttcactggattaaatcaaataaacaacaaataccttttcttagtataaatatttgtattgactgtttctggcaaccatacctggacccttcatttatcagaagaaaagattaggttagaatttaccactttcatggaaggagggggagaggggagaggagagatgagaaaggggaggggagagaggaaagagaaaggagagagaggagggagggagagaaagaggagagggagggagggagagagggggatgttgagagataaagagagggggatgttgagagataaagagggagggagagagagagagggagagggaagaaggagggggagaagagagggaagaaggagggggagaagagagggaagaaaggggcggtgcagaaagacggagggggagaggagagagaaagagggagggagagagaggaaagcagggaggaagggaaagggagaggttaaaagagagattgagagaggagaggcttcctagcacttctctcctccgagcgcagagccctgttagaacagcctgtctcctttcatgaagcttctctgccaccttctctcccaccctcctgcatttgtcccttttggagacagcactggaatttacctggaatgagccttctctctgctccccttgcacacgggctggctgccagcagctttctccaccagcctccgacagaaaccctgcagagcttccattctgcgttcagccaccatcgcctcccacccagtggtttctaaacaatctctgagcaagattttggttttatcagcctattaacttctccctttttcattttggggaaggggtccaccaacattcatcttgtgctgaacaggagctgttttctgctcagctcttgttcttgggtgacctggcatggagggatatctccagaccttggggagtcgtcaaataagcctggatctgagaactgagggatgctaggggtgacatccacactcaggaggggtgaggcaaatgcccccttcattgtgttctcatgaatctggttcttccaaagattttgtttactaagttgcatttattaagaaataatgcttgttttgaagaatattattattatttttgagacagggtattgctccattgcccaggctggagtacagtggtgcaatcatggttcactgtagccttgacctcctgggctcaagcaatcctcctgtctcagcctcctgagtaggtgagaccacaggtatatacaccaccatgcctagctaattaatttttttttttttttggtagagatagggtcttgctatgttgccaaggctggtctcaaattcctgggctcaagcgatccacctgcctcagcacccccaaagtgatggtattacaggcatgggctactgcacccaaccaaaattattcttattaatcaaatatgtacatcaggcaatcggctcttccactagccagagctaagcagtgttttccatgaagtggatctgattccagttgaaggaatctaattaggctctgtattctaattaggctgagtggcatcaagctctgtaaaaacacaggggcttccattagacttttggaaatacagaggtaagactaaaagtcccattgctgtctgtatggatgctggggtggagcccagcttgggatagaagatgttagtgactctggaagacagaactccagaagaaaggcttaaaagccagagttattttgcagttgaggacttgaaacctccaccagtaagcacactattttggtacaactgagtgattaagttctaaggtttaacatccaacttactgggtgcaaatctcacgcttgccccttattagttatgtacccatgacctccctgaacctcagttttcccctctgtaaaatgaggctgataatactgcaacttgaaccagctggggtgcatgcggatgcaaagaacataaacactgacgcaaacggagacagcaccttgtatatttccatttctaggcagtagtggcttcatcatcacatcaaattattattattatttgagacagagtcttgctctgtcacccaggctggagtgcagtggcgtgatctcagctcactgcaacctccacctcctgggttcaagcaattctcctgcctcaacctcccgagtagcttggattacaggcgcccgccaccacgcccagctaatttttgttttttttagtacagacagggttttactgtattggccaggcgggtctgagactcctgacctcatgatctgcccgccttggcctccccaagtgctgggattacaaccgtgagccaccgtgcctggctgacatcaaattataatgtggttgtcaaccagaactgaagtgagaaggcaagcatgtgtcacttctggaaacccacacagaagctaaaaaaaacctcctttcctagaagcttccattaaaaccctcctcagggctcattggtctattttgcaaagctcatgtggtcatctctgaatccatcacagtctaggggatgagactacattggtcagattaggcctgagctatctaccccttctctagagccagaggtggagttagctccaaagaatgtgcctgaatgaaggttgggagactcacaaagatttaggaagataacactgcaaagcactagacacacagggagcactccataagtgtgagctaattactggccattattgtcatcctggtgaaatctggttaatcaagagtcttattctactgaaaatgtttatgtccatatgcctccatcatcctcaccatcatgatccccatcattatcatcatcctcaccatcttcttcatcatcatcttcaccgtcatgatcaccaccatcatcaccatcatcttcatcaccattccctcttcatcatcatgttcatcatcatcctcaccatcatgatcatcattatcatcgtcatcttcactggcaccatcgttggccaagtgcctactgtgtgctgctggcaccatttcagacacattgcaaacctatatctaatccttgggacaacttgtgaaacaggatatcactagttgcctacccccagtgcattctcccccttgttccttacgatataaaatcctgagatttcgcttaatgtggcatgataccaaagatctaaaacctacactaataaaaacaaacaaaacctactcatccagttgggcatgatgatgcaaaattgtgaaacagttagaaatagatgtaaaatgtcctatgcaatgaatagacaaagaaaaaaaaacccatacggtaccagcttcctttgcagttatgtgtggtcatgtgacataatctagccaatgagataagagaagtctgccagagacttctgagaaaacctcacctctctgctgcaggcaccatccgttcctcagtgctactttccttttcttcctgctcgcaacacaggccctcaaagctgtggaagagaaactctctcatgatcatgaaggagaaagacacccactaagaaggacaaaaaggggaagtttgggacattgaggctaccatggaccaattcaccagccctgggatgcatcctccagcacctcattatgtgttgaggggaagaaaggcaccctctttgctgaagtcactgaagttgggtttctgctgcagacaagtgaatacagcttctaaaaggagattgctggacaaaatgagccctgtcatagatgaagaaaccaatgcacagagagggaaagcatttactccaagtatgaaattcaggctcccaaaccaatgctcccaccttaaaaagcagggaaattctgacacaggctgccaaatggatggatcttgagaacatccatcttgagatggtgcaaagtgaaacaagccagtcagaaaggacatataacgtatgattccacttacgtgagggacttggagttgtcatattcatagagacagaaagtggaatggtggttaccaggagcgggtggagggagagcaggagtgagtggctaatgggtgcagaatttcagtttgagaatatgagaaagttctggagatggatggtagtgatggttgcagaacactgtgaatgtgcttagtgcctctgaactgtgcccttagaaatggctaagattgtaaggtttttgttatacgtattttattgcaataaaaacatatgatgtgggaaaactttactaaaaacaaaacaaggggcggagccaagatggcccaataggaacagctccggtctacagctcccagcgtgagcgacgcagaagacgggtgatttctgcatttccatctgaggtactagattcatctcactagggagtgccagacagtgggcgcaggacagtgggtgcagtgcaccgtgcgcaagccgaagcagggtgaggaattgcctcacttgggaagtgcaaggggtcacggagttccctttcctagtcaaagaaagtggtgacaaacggcacctggaaaatcgggtcactcccaccccaacactgcgcttttctaacgggcttaaaaaatggcgcaccaggagattatatcccgcacctggctcggagggtcctacacccacggagtctggctgattgctagcaaagcagtctgagatcaaactgcaaggtggcagcgaggctgggggaggggcgcccaccattgcccaggcttgcttaggtaaacaaagcaggagggaagctcaaactgggtggagcccaccacagctcaaggaggcttgcctgcctctgtaggctccacctctgggggcagggcacagacaaacaaaaagacagcagtaacctctgcagacttaaatgtccctgtctgacagctttgaagagagtagtggttctcccagcacacagctggagatctgagaacaggcagactgcctcctcaagtgggtccctgacccctaacccccgagcagcctaactgggaggcaccacccaggaggggcagactgacacctcacatggctgggtactcctctgagacaaaacttctagaggaacgatcaggcaccagcattcgcggttcaccaatatccgctgttctgcagccaccgctgctggtacccaggcaaacagggtctagagtggacctctagcaaactccaacagacctgcagctgagggtcctgtctgttagaaggaaaacaaacagaaaggacatccacaccaaaaacccatctgtacatcaccatcatcaaagaccaaaagactacaaagatggggaaaaaacagagcagaaaaactggaaactctaaaaagcagagcacctctcctcctccaaaggaacgcagctcctcaccagcaatggaacaaagctggatggagaatgactttgacgagttgagagaagaaggcttcagacgatcaaactactctgagctaaaggaggaaattcaaaccaaaggcaaagaagttgaaaactttgaaaaaaatttagatgaatgtataactagaataaccaatacagagaagtgcttaaaggagctgatggagctgaaagccaagctcaagaactacgtgaagaatgcagaagcctcaggagctgatgcgatcaactggaagaaagagtatcagtgatggaagatgaaatgaatgaaatgaagcgagaagggaagtttagagaaaaaagaataaaaagaaatgaacaaagcctccaagaaatatgggactatgtgaaaagaccaaatatacatctgattggtgtacctgaaagtgacaggaagaatggaaccaagttggaaaacactctgcaggatattatcaaggagaacttccccaatctagcaaggcaggccaacattcagattcaggaaatacagagaataccacaaagatactccttgagaagagcaactccaagacacataattgtcagattcaccaaagttgaaatgaaggaaaaaatattaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccagcccagccctaaaagagctcctgaaggaaggactaaacatggaaaggaacaaccggtaccagccactgcaaaatcatgccaaatcgtaaagaccatcgaggctaggaagaaactgcatcaactaacaagcaaaataaccagctaacatcataatgacaggatcaaatccacacataacaatattaactttaaatgtaaatggactaaatgctccaattaaaagacacagactggcaaattggataaagagtcaagacccatcagtgtgctgtattcaggaaacccatctcacgtgcagagacacacatagactcaaaataaaaggatggaggaagaactaccaagcaaatggaaaacaaaaaaaggcaggggttgcaatcctagtctctgataaaacagactttaaaccaacaaagatcaaaagagacaaagaaggccattatgtaatggtaaagggatcaattcaacaagaagagctaactatcctaaatatatatgcacccaatacaggagcaccaagattcataaagcaagtcctgagtgacctacaaagagactaagactccgacacaataataatgggagacttttacaccctactgtcaacattagacagatcaatgagacagaaaagttaacaaggatacccaggaattgaactcagctctgcaccaagcagacctaatagacatctacagaactctccaccccaaatcaacagaatatacgtttttttcagcaccacaccatacctattccaaaattgaccacatagttggaagtaaagctctcctcagcaaatgtaaaagatcagacattataacaaactgtctctcagaccacagtgcaatcaaactagaactcaggattaagaaactcactgaaaactgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaatcaggaaatatccaaaattgacaccctaatatcacaattaaaagaactagaaaagcaagagcaaacactttcagaagctagcagaagtcaagaaataactaaaatcagagcagaactgaaggaaatagagacacaaaaaacccttcaaaaaattaatgaatccaggagctggttttttgaaaggatcaacaaaattgatagaccactggcaagactaataaaaaagaaaagagagaagaatcaaatagacgcaataaaaaatgataaaggggatatcaccaccaatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggagcagatggattcacagccaaattctaccagaggtacaaggaggaactggtaccaatccttctgaaactattccaatcaatagaaaaaaagggaatcctccctaactcattttatgaggccagcatcatcctgataccaaagctgagcagagacacaaccaaaaaggagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaatgaatgtaatccagcatataaacagaaccaaagacaaaaaccacatgattatctcaatagatgcagaaaaggcctttgacaaaattcaacaacctttcatgctaaaaattctcaataaattaggtattgatgggacgtatctcaaaataataagagctatccatgacaaacccacagccaatatcatactgaacgggcaaaaactggaagcattccctttgaaaactggcacaagacagggatgccctctcacaccactcctattctacatagtgttggaagttctggccagggcaattaggcaggagaaggaaataaagggtattcaattaggaaaagaggaagtcaaatcgtctctgtttgcagatgacatgattgtatatctagaaaacctcattgtctcagcccaaaatctccttaagctgataagcaacttcagcaaagtctcaggatacaaaatcaatgtacaaaaatcacaagcattcttatacaccaataacagacaaacagagagccaaatcatgagtcaactcccattcacaattgcttcaaagacaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcacatggcaccaaaaaagagccctcatcgccaagtcaatcctaagccaaaagaacaaagctggaggcattgtgctacctgacttcaaactatactacaaggctacagtaaccaaaacagcatggtactggtaccaaaacagagatatagatcaatggaacagaacagagccctcagaaataatgctgcatatctgcaactatctgatctttgacaaacctgagaaaaacaagcaatggggaaaggattccctatttaacaaatggtgctggaaaaactggctagccatatgtagaaagctgaaactggatcccttccttacaccttatacaaaaattaattcaagatggattaaagacttaaatgttagacctaaaaccataaaaaccctaaaagaaaacctaggcattaccattcaggacataggcatgggcaagaacttcgtgtctaaaacaccaaaagcaatggcaacaaaagccaaaattgacaaaggggatctaattaaactaaagagcttctgcacagcaaaagaaactaccatcagagtgaacaggcaacctacacaatgggagaaaatttttgcaacctactcatctgacaaagggctaatatccagaatctacaatgaactcaaacaaatttacaagaaaaaaaaaacaaccccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacctagtcatcccattactgggtatatacccaaaggattataaatcatgctgctataaagacacatgcatacgtgtgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaagaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacctgtaccctaaaacttaaagtataataataataaaattaaaaaaagtctgtttgtatggaaataaaacatgtcatttgtgaaattaacaaaaaaatcaattcttccttcattaatgcctcagaaaaagtgtgttttgttctgtcttgccaagggtttgaaactcttgtttctatccctgtcctctcatcctaggctctcttggatccagtcaacactcagggtggctgaatgagtgcagttgaagtggcttctgctattggggcatgaacctctctgcccatggcaaggacttgggacaggtatggcttctactcatggcagttgagataaatgctgaatttctagagtctcaggagttaacagttacagggtccaagtcataaactcagaaatgaagataagtagcagccccagactgggaggactaggtctaacatttctccgggaatgaactatttccaaagtatatatattaacattcaagactcgctgaaaatactcacagtgctaccgaggtcctgactggggagattctctcccttcccctaagtgaaaatgtcagtgttcagcttcctgagcgaagtttgcagctcacatctcctctgacccagtatcactgagcatcttaattaggtgaaagggtctacatatctttctttctggacttgaggttgtcctctgtgttgctgtgtgtgagggttcaagctgtgagtcacttatttccttcttagcaggcgagggaattttgtatggaaggctaaacaaagacagtttctctccctggtgtttaaagcaaatctctccagtatggggacaggtagagaaagagacccaggcttatttaggacagtgattctcgatcctcactatctgtcccttagagtccctgaagaactttgacaaatgctgatgtccaagccaaacccacaatcaattaaaggacaacctctggggatggaacctaggcatgcgttttttttaaagtgcctcaggggattccaataagcagtccaatgtgagcaccagtgttttgcaatctgtgtcattccacttgtgttctgtggagcagcagtgcaagtattacctgggagctggccgggaaaacagaatcttaggtcctgctccagggctcctgggtcatccagatcacctggatcagaatctgcatgtcagcaaggttttcagtagagctatgtgcaccttagagcttggaagcactgggttaagtccccgttggaaggaatcttcatgactgctgacagttccaagtcttctcaccctccactcctgtgagttgctttccgactcctcccacatttagggagatatagaccagtgatattgtccatcccaggggtgacgtggtgcctaaaagtcaactctgacttcttcaccatcacgtgacacaaaagggttgattgcagagctttacaaccattctagtaccaaacgctgcccatcaggctagctaatgacaagatgataatgattagtaataatcgttgcatttattgatgacctactgtattagacagggttctcgagagggacagaactaataggatagatgtatacataaaagggagttgatggaggggtgactcataagatcacaaggtgaggtcccataataggccatctgcgagccgaagagcaaggaagccagtctgaatacccaaacctcaaaaatagggaagccgacagtacagccttcaatctgtggtcgaaggtccaagagtcctaaagctgaagaccttggggtctgatggtcaagggcaggaagcatccagcacaggagaaagatagaggccagaagactcaggcagtctagtcttttcccattcttctgcctgcttttattctggccatgctggcagctgattagacggtgcccacccagattgagggtgggtacgcctttcccagttcactgactcaaatgttaatcttttttggcaataccctcacagacacacccaggaacaatactttgactcctttgatccaatcaagttactaaccatcacacctactatgtgccaggcacgtagcatagagtgcttcatttaattcttctggtaaacgtgtcaataatactgtcctcaacttacagatgaggtagcagagactcagagaatgaagtcacttgtccaacaagtttacgcagctggaaagtagcgggtggtaagtggctggtttccttttcttcacctcatcgttcttagaaggctaacggtagggtgataaggaaggagagaagggaaaatagcagaggaagtgaggggaaggagggagggaggagaagtgcgctcagattaattagaaacagtgagagagggccaggtgcagtggctaatgcctgtaatcccggcactttgggaggccgaggagagtgaatcacataaagccaggagttcgagaccagcctggcccatgtggtgaaaccccatccctactaaaaaaaaaaaaaaaaaaaaaaaaacaaaaattagccgggcatggtggtgcattcctgtaatcccagccacttgggaggctaaggcacaagaatcacttgagcctgggaagcggaggttgcagtgagctgagatcatgccactgagttaggacttgtggttgcaagtgatggaaacctaacattccctaatgcaatcacaaagaggtattggctcattgaacatgtccatgggcaggtggacttcagtttcttcctgtcttttcttcatctttcagttctccttttctctgtgatgactatctcccgacaggctttttctcgtagtggcaaagatattccctatcagtatcagtcctatgctgtattagtccattctcatgcagctatgaagaaatacctgagactgggtaatttataaagaaagaaggtttaatggactcacagttccacgtggctggggaggcctcaggcaacttatgattatggtggaaggcacctcttcacaggatggcaggacagagcatgagtggaagaaggggaaatgccagacacttataaagccatcagatctcgtgagactcactcattatcacgagaacagcatgagggaaactgcccccatgattcctttacctccacttggtcctgtccttgacatgtggggattatggaactacaactgaagatgagatttgggtggggacacagagccaaaccatatcataagcgttgtcagcttagaaacctagagcagtaactccctaaactctcctaaaatccttcatattgacagtggttggccaggccctggtcatccatttctgaaggcaggaggtgatgatgccgtgagagagttggaggggcagttcccccaaggacaattgcagtactgttaccaaaaagggggaaagaatgcaggccagacaggaatccttaaactggacattctttgctttcccctccagatctactctccacctgtctcctccctcctctctgccccaagagtgatttctatggctaacatatgtctgtttgatatggtttggctgtgtccccacccaaatctcaccttgaattgcaataattccttcgtatgaagggcacggctaggtggaaataattgaatcatgggggtggtttcccctgtactgttctcatggtagtgaacaagtctcacaagatctgatggttttataaatgggagttcccctgcacaaggtctcttgtctgccgccatgtaagacatccctttgctcttcctttatcctctgccatgattgtgaggcctccccagccatgtggaattgggagtccattaaatcttttttttaaaataaattacccagtctcaggtatgtctttattagtagcatgagaacagactaatacactattatttccttagctttaaggtataatatacataccttacagtccatccgttacaagtttgcaattcaacaattttaagtaattttataacgtgctgcaaccatcaccacagtccagtttcagaacacttctatcaacccccaaaattcacttcagcctgcttgcagtagctcctggcaatgtgcagaatttgccttttctggacatttcataaacctggaatcacataccatacagtactctatatagtgtgtggcttctttcactcaacgtaatatttttgacgtttgtccctactggaacatgtgtcagtatttcattccttttcattgctgcattatattccattgtatggatggaccacactttgtttatccattcaccagctgatggacatttgggttgtttgcagtttggggctattatgagtaaaactgttatgaacatttgtttacaagtctttgtgtggacatgtgttttgaattctctcagcttcctaggagtggaattgctcgatcatatggtaagtttatgtttcaactcgtccattgctggtgaaaatgcaaaatggtacagtaggtttggaaaatagttttaagaacctgccaaactgttttccaaacctacggaaccattttacattttcaccaacaatggacaagagttctgattcctgcacatccttacctatatttagttatcatctgattttcaaaaattatagccacttactaggtacataataatatctcactgtggctttaatttgcatttccctaatgactaataacggtgaggttttttttttttttttttttttttttttttttttttttttttttttttcctgggacagaactttgctctatccccaggctggagtacaatggtgtgatctcggcacactgcaacttccgcctcccaggttcaagtgattctcctgcctcagcctcctgcgtagctgggattacaggtgcccacccccctgcctggctaatttttgtatttttttgtagagatggagttttgccatgttgggcaggctggtgctttttagtcatttgtatagattggatatcatatacacacacgaaaaagttaggcccttaactcacaccaaaaataaaaattatctcaaagtgaatcacagacctaaatgtaagagctacagttataaaacttctaggagaaactttagtgaaatgtttgttcaagtcttttgcttattttttatttgggttgtttgtcttattatcagttgcaagagttctttatatattctgggtacaagttcttcatcagatacatgactggtacatattttctcccagtctgtagcttgttctttcattttcttcaaggtgtcttttaaagcttttaatttgaaattaaaatgacatccactttataattggctcatacttttggtgtaatgtctaagaactctttgcttaacccaaagccatgaagattttctcttgttggtttctcctagaaattttttaattgtagctcttacatttaggtctgtgatacattttgagataatttttatttttggtgtgagttaagggcctaacattcttttgtgtgtgtgtgtttagtatatgatatccaactgttacaatgccatgtttgaaaagagtatcccaccccattccattgtcttgacatcattatcaattgttttgacatcattgtcaaaaatccgttggccatatacataagcgcttatttcttggctttcacttctgtaccattatcaatatatgcctatccttactccaatgccacacggtcttgattactgtagctttagagtaagctttgaaattgggtaggataagtcctccagctttgtttttctttccccaaattgtttcagcaattgtatgtcttttgcatttctgcattcattttagaaccagcttgtcactttcttcaaaaaatcctgctgggactttaacagggattacattgcatctatagatcaatttgatctatggattgacatcttaataatatttaatcttccaatccattaacatggaatatctctccatttatattttctctcatttctctaagcaatcctttataatgctcagtgtaccaatttttcatttttcttgttaaatttattccaaactgtttatttttgatgctattgtgaatgaactttaaaaaattcattctcaaattgttcatgactagtatagaaaattccattaatttctatatattgatcttgtatcctgcaaagttgctaaatttactagttgtaggaggatttttttttttggtggattccttaagattttctacatataggatgatgccatctgtgactaaaaaagttttacttctttctttccaatctggatgtctttattttatatatttttagctttattttactggctcgaatcttcagtaaattcccgaatggaagtggtgagaatgaatgtctttgcttcatttccaagctttgggaaaagcattcagtctttcaccattaagtataacgttagctgtgggttttctgtggtgcacttcatcaagttgaggaagttccctcttattcctagtttgtggatggtttttgtcatgaatgggtgttggattttgtcgattgctttttttgtgtctactaattcactatctgaacgtgccatctgtttcctgccaggaccctaaaaaataaaaaatgctcgctgcaaagtgaaaatttatgtgatgaaggtggattccctagtccctactcaatgaattattgcactgacttgatgcccattctctcagctttttagcttcaagagatttggttttaaaatatatccactaggccgggcactgtggctaacgcctgtaatcctagcactttgggaggccgaggtgggtggactgcctgagctcaagagttcgagaccagcctggacaacacagtgaaaccctgtctctactaaaatacaaaaaattatctgggcctggcagcgcatgcctgtaatcccagctactcgggtggctgacgcaggagaaccccttgaatccgggaggcggaagttgtagtgagccgatattgtgccactgcactccagcctgggcgtctccaaaaaaaacatatctatatatctatatatatctccactagtaatttgatactccttccttccaaaatggagcctaattctcctccttctgagtgtgaactagactcagtgaattgcttctagggaacagaatatggcagaaatgatggcgtatggtttctgagactaggtgataggaggcgttgtggtttctacctcatgattcactctgagagaaaccagccgccatgttgtgacatcactcaaggagctccatgggaagttccaccaagtgaagcctctgtgactgagtcactttggaagagaatcctcaagtcttctgactgtagccccagccaacatctgactgcaaacccatgatacaaatccagccagaaccacccagttaaactgctcctgaattcctgacccccgggaaccacaaggtaataaacgactattgttctaagccactgtgtgttggagtgatttgttatgcagcgtttgacaatacaaaagacattgccaccttctctcagaatttgttaagctctaaaaatgacaaagatgggtctgaaggaacaaggatttctggacctggaggctctttcagaagttagatcccatgaggatggggcattgctctaagaagaggttggtgagcattgtatgtgaaaacacttcgtaggtgataaatacggcataaacacattattgttactggaaggtttgttatagccttcaagcttacactcgatgtcatcttagccggcatccttctttctatcccaacacatcaggtctttgataatttgtgttcttctaagaaaggacccccagggtcctgccctcccaggaccgacatgctgaccaggcacttgatgtggacatgtcagaccacccacattctacttccttcagttgctttttctagaatgccagccaggagggacgggtacactctgaattttgatctcatgtgggtgggtgatctgctttctaattaaagttccctgcccggccccttctgcggaacgtttcacccaggagaaaagacctgaagcaattgtgtcaaagggtaggaaagcatttacacagcaagggagatcttgcttagcaattgggggagaaagagagagaaagatttgcctccagctgccattctgaactgtaccgtttgtacaaagtggaacgtaagtttctgttttctgaaaaggggacaagttgctattgataaagcaggaggtcacatccatctccatttgcatacaaattactttctcatctactttccaagggggagaaagagctgctttatcgttctcagagggagcaaactctccacgggttgccttgtatatttgtcagaactttttggatgcaagtgacagacactcaacccaaccctgagtagcttatgcaaaactggtaacttttttttttttttttttttttttgagagtttcgctcttgttgcccaggctggagtgcagtggagccatctcaattcactgcaacctccgcctcctgggttcaagcgattctcctgtctcagtttccagagtagctggtactacaggcgtgtaccaccatgcccagctaatttttgtatttttagtacagacggggtttcaccatgttggccaagatgttctcgatctcctgaccttgtgatccacccacctcagcctcccaaagtgctgggattacaggcgtgagccactgcacccggacactaaactggtcatttttgatctatctcatcaaatcacaaaagtagaaaagtctttcacttaataggggatgcaaatgccatcttccatcttatctcctcttttatctaatcaactgcctttattctctccccagaagctaaacccatggccacatggatatctccaaacttgaactcgagcctgctgtatccggctctgtacgtgctatggctatttggatatctggtagggctgtcaagctgagtgtgttgaagctgtttaggatcttgctcttgtaacctgctccccctcctccagtgttttcctgtcagagtagatggctccacttgccacctccttgggcagctgcataagccagaaacctgagcatcacctctgacccctccctccctcatccccacacagccaatgagtaaatacgactggggtccaggtgcctctttcttaccacaatttttatattttatcttaatttttatttttttgagacagggtctcactctgttgcccaggctggagtgcagtgctgtgatcccagctcactgcaacctccgcctctcaggctcaagcaattctcatgcctcagcctaccaagtagctgagattactggagcacaccaccacacccctgctaatttctgtatttttcgtagagacagggtctcaccatgttggccaggctggtcttgaactcctgacctcaagtgatccacccatctgagcctcccaaagtgctgggattatatgagccaacgcgcccagcccaggtggctatttctagtccccctgccactccctagtccaggccatcatccctgcagtgtggactagggtaaccatgttccaacgagttcctttcccatctattcctgcctccctctgatttgttctccataggattgccataaatgtccagaaaaatgcaaattagatcctggcaagcccctactgcatgctctcctctcaccattaggataaaactccaactcctcaccatgacgtgatcccagccctgcctgtcttacgccagtggccactttcctctctgccgtccgcacagcagcagctctgctcctgtccactccatgacctcgaagcatacggtttcccctgcccaaatgttctttcctcctgctttacctgcctagctccccttcacacttcagagctagaatcccctaggaaacttaggtgagaggatggcttgaaaccaggagttcatcagcctgggcaacacagtgagagccctgtccctacaaaaacaaacaaacaaacaaacaaacaaacaaaacaacaaattcactgggtgtggtgacacaggcctgtggtcccagctactctggaggctgaggcaggaggatcccttgagcctgagagttggaggctgctttgagttgtgatagcgccactgcattccagcctaggtgacagagcaagaccccatctctttaaaaaaaaaaaaaaaaaaatttcagtgttggccaggcttggtggctcatgcctgtaatctcagcactttgggaggctgaggtgggcagaccatttgagcccaggagtttgagaccagcctagacaacatggcaaaacctcatctctacaaaatatacagaaattagccaggtgtggtggaacatgcctgtagtcccagctacttgggaggctgatgtgggataatgacttgagtccaggaggtggaggttacagtgagccaatattgcaccatacactccagcctgggtgacagagccagaccttgtctcaaatctacagataggcaataaatttaaaattattacatgaacttgttgacattcctctctccaaaatggagcccaattcgcctcccattaaatggggatggacttagtaacttctaatagagtacttctaataaatagaagtggcaaggtgtgacttctgaagctaaattataaaaggcattgtgtgaattcctctttgtgttctctcttggatcaccggctctgggaagagccggccgccatgttgtgagaacactcaagcagccctctgaggaagcccccatggtgaggagctgtggcctcctaccaacagccatgcgagtgagtttggaagtggatcctctagtctcagttgagcctttggatgatgcagccctggccagcatcttgattgtatcctcatgagagtccccgagccagaaccactcagctaaatcacttgcaaattcctggcccaaagaaactgacataataaacgtgtatttttttaagccattaagttttctagcaatttgttatacagaattagacaatatagcaacttcttagatcattcttacagcctttatgacatttatattcaaataattaactgtggaatgcatggtttggaaatgtctgttgcagtccctgctgtaccctcagggtcctgacctggtaaatgcttatagaactgaacttcatgctgggagacagtggtatgccaggcaaaacagacacctgaagcccattgtttctaatatgcctctcctctatagacaaaatcattttctatcaccatgatgcaacagatactgtttgaatgcagtaaaatctctctcgtatacactaacatttgcacatatggaacaaaacatgacacttctctgttcttttgttttgctgttttaattgtaaaataaaaactccaagtggtcacaaggaaaggcagaattaaagtaattcaaattctctttgtcttcataatgactgtgctattgtttattttgaatctactaaacacagttgatatgtaatatgcaatgccacaggggatggggacctgaactccacaccaactgagccctagtgattcagaatcttggcagacttcctcttcacatgaacacgtgcttctgggtccctgagtgttggggtcgattacacaacagggacgtctccaaattaacctccgcatcgaagactattttagaggacaagtcattcaatgtgctaatccatagcgatattattaaaactcaacagtaactgtggcaattgtccagaaattagaccaacaaagagattgagggggaggcatatgttatccgtggcactgtgtagaatcacatgtggtgagaatgaaaagcagattgattttgagttggttttgttttaaaattctctacaggccacgcactcccgatcacaccctctccgacccccaaggtggacgggctcctactctttgtatgccacttctggaagagcagggaaagatggatccatttgtgagctatgagcaagacaccgtgctgggcacctgcttttttttgagatggagtctcgctctgtcacccaggccggagtgcagtggcgcgatcttggcttactgcaagctccgcctcccgggttcacgccattctcctgcctcagcctcctgaacagctgggaccacaggcatccaacaccatgcctggctaattttttatttttagtagagacggggtgggcacttgcttttaatggaacagggctagcatccgccatctagtgatttctgtggcatgcttgcagacatactcaaggacagtggtccaggcagcagttcctctgggataacactgggccccccagtgacagcccagggtggggtaggtccatcccccgatccagctgtagttctgcagctcctgctgctctgacggagcctgggtcccgaacggcagagccctcccggagcagagcaggggttgttaaagacactttggatcttgtgaggtgacagctccatttcccacgcacaggctttaaaatgcatttaaatatttcaaatagtctctcaattttttagaattcataaatctggaatactaacaagatcataaaaaagcccactcccaaccaataggaaacagaatcgatgtattcgtatgtttatcatttatttccatttcccacctggatagtccccggagatttgatttcttgtttcctagagaatctgaagacagaaaacagaacttggtgttaaataatctttaacgtacacctgttcaaactatcggcaagacactaatcatttgtcctgatgcacaaacatcaatccagggcacatgaaattttaactatcaataaatattccgacatctgcacacatgcagcatctaattccagcatcaaaatgcagataagcacgaatagatatttggatttatagcaaaacgagtctcatctggaaacccctcccaggaaggtctggcaggctgggtgtaaggaatttgggacgatgcctgcatttcctctgcccgtttctaccaagtcggtccagtaatcctgtttaattaataataaacattgcaggattttttccccccatttgaattatgtttgaaatgtgatggctggatgcttcttataaaaatgctttgaaaaataaaccgtgtcagaaatgagtgatttatcatcactcagaatgctggcaggggaaatctcagaaaaggagagaattgatgttgcttcctgccggcatttctactacagagctggtccaatttgctttcttcctgtgcccatgcatggggcagcttttgcatgaggcactcccctcacttgtttcgtgtcttttttttttttttttccctctctcccaggatctgcccaggcctttggaggccagacctccctgatggcacagtggcaggcatctgggtccttggggaactccccacgatgcacaccaggcaccagccaacgtcaaaggtcaggagaaaggagctcttgaggtctggatgacttcaaatgagctgcatcccactgaagcgttcagtctgccgagctttcaggccaaggttcctgatcagattctgttcaatcacaaggtacagctctgccgtccataatctgctctgttaggaatacagcaattattgagcacttactatggatcacgcctttttttttttttttttttttttttttgagagggagtctcgctctgtcacccaggctggagtacagtggcacgatctccgctcactacaacctctgcctcctggactcaggaaattctcctgcctcagtctcctgagtagctgggattacaggcgcccgccaccacacctggacaatttttgcatttttagtagagacagggtttcaccatgtcgcccaggctggtctcgaactcctcacttcaagtgatccacctgcctcggtctcccgaagtgctgggatttacaggcctgagccactgcacccagccctggataatgccctgttctaagacctttgtatgcacaattgcacttgatcttcaccaaagttggtattcattgcatccccattttgcagatgacataaccaagatacacacacaacaagcaagaggccaaagccaggaaagtaacccaaacagtccgattccagaacccagactcttaatcacttcactgtgttatttattattattaataatagaactaggtgtggtggctcctgcctgtaattgcggcactttgagaggccgacacaggacgatcacttgagttcaggagctcgagtccagcctgggcaatgtagtgaaatcccattgctacaaaaaataaaaaacttaaccaaggatcgcaggcctgtggtcccagcctcaggaggctgaggtgggaggatcacctgagcccaggaggttgaggctgcagtaagtcatgattgtgccactgcactacagcctgggcaacagaggaagggcccgtctcaaaaatagtctttctcagcactctataccaagtgatatgccgggccctgcgtagatactatgtctttactcttatatgattgagatcattgtccttgtttgactgttgaggaaactgaggttaccagagtgaagtgaattgtctaaagaaagtcttgaaccaacacaaggacccaggtcctcccagatccatagctcattttcaacgtacttacttagtgtcagtctgctcgactgacatgacagatgggtggtggggactgcggtcttggtggggagatctctggagatccaccctttggaacaacatagatgctccagtttcagatttctcacgtccagtgtctgttctgtttttttgtttttgttttttttcctttgctgaatttaagcagccccagcagagaaagccaacgaatggcgatgtgaaaaaagccgtgtggacccgttcctctccatcacccatcagatggtttccaatcaggaagcaaagctgggccagagtaaatgttggagtatgtggagcagagggagtgctcatgccctgctgatgtgaatgcagattgatccggccttggagcaactgggcagtacccagtgaagttgaacctgtgcgcccccatgacccagaaattccaagggtacatgtagaccaggagacatgcatggcagactcatggtttataaatgggaaacagtgggagacaacaccatgtccaccaatgggggaaggtggaccagacgtggtgcatccataagatagacttctacaggcaattgaaatggagagactagatgtgcattgataacacaggtaattataaaaaaattcaatgtcgagtgacacaaaacaagttctaggaacctcaaagcagcccaaactttattataatattatagattgttcatgggtacacctataagagggtagaggcacatccccgatttgagagagaggggagagggactgaccttgcaggtggggctgaaagggacttcacttgatctgtgatgttttgttcaatacatatattttttattttctatttattttattttgagatggagtcttgctctgttgccaggctacagtgcagtgatacaatctcggctcacagcaacctccacctcctgggttcaagcgattctcctgcctcagcctcccgagtagctggaactacaggcacatgccaccacgcccagctaattttttatttttagtagagatggggtttcaccatgttagccaggatagtcttgatctcttgacctcttgatccacctgccttggcctcccaaagtgttgggattacagatgtgagccaccgtgtctggcccactttatatttttataaatataaaaacatgaaatgctgggtgtggtggctcctgcctgtaatcccagcactttaggaggctgaggcaggaggatcacttgagccctggagtttaagaccagcctaagcaacaaagaagaccctatctctacaaaaacacaaacaaaaaaccaaaacaaaaaacaacaacaaaaaaacaaacaacaaaaaaacaaccaccaccaccaccaccaccaccacaaacaaaacttagccaggcatggtggcatgcacctgtggtcccagctacttgggaggattgcttgagcccatgagactcatgttgcagtgagctgtgatcgcatcactgcactccagcctgagtgacagagcaagactctatctcaaaaacaaaaacaaaaacccaaagacagaaaacgttggcatttgtcaattttgggtggtgagaacctgggaacatgttctgttattctctgcacttttctgtgttttgaacatttctaaaaataataataaaataaaataacccatgtgaaactacatactgaatttctatggtcctcttcttccgtgaatagtgaatgtgttttggagtgggtcgggtggcagaaggaggctgaagccagctccttaaacaagttaatttcctgccaacacgctttcctcagctgtagcacagagggaaagcagagagctggctgtgtttgcagcttcatctgggagaccttttaaaaaaaatctggacattgtaggcaatattgattaacatatacatagaggcatggggtggggggagcaaatcaatcaataaatgcatttcttctgttcctgaccttagataatgtgtgctgattaaggggcatgtcacttgtttttaaaaccagtgttaaatattaattacaaatcatatggcttgaccccaggaggggccactgtcccccctccctcggggctctcccagagctctgaaagcagcccaccctcctctgcctccgagaaaccaggcagatttacattaggaatcaccatgattattgttctttttatggtggctactgtggacaagacaattatggaaacagaattcattgttcgaacaggctgagctcatgatattactgtggatttaaaaaaaatcatttcttggccaggaattaaaaatagctcattctcccccccccacccctctctttctcttgccagatttagaatctgagggaaccttgatagtttccctcctagttaatattcctgaggcaacttgcatttgcaacacggttgagaatcattttattttaaacaccagttcttcccactattcctgtgagggagttccaagttattagctcagttttaaatacaaggagatgggagtggagaggcttggggcctctcccggggaccaggtcagagaagtctgcatgctcaaggagagcggaatctcagtcccttctcatcagctgccttttcatctgtcctcaatgtgttctctgccactttagcatgtaagatttcaatgaccaggcaggcacggtggctcacacctgtaatcccatcacgttgggaggccgaggcaggcagatcacaaggtcaggagttcgagaccagcctgaccaacatggtgaaacactgtctctactaaatatataaaaattagccagacatggaatacacctgtaatttcagctactctggaggctgaggcaggagaattgcttgaacctgggaggcagagattgcagtaagccgagatcgcgccaccgcacttcagcctgggtcacagagcgagactccatctcaaaaaaaaaaaaaaaaaaaaaaaaaaaaaaaaaaaaaaaaaaagatttcaatgacaattttttttttttaaaatgcacatggaaacagaaccccctggagtagccccagccaggagcagaactcaggagtcctgatgccctaaggttcttgctaatcttctcctctgcactgggttaaatgctgtcttctcccaaattcacatctacttggaacctcagagtaagatcttgtttggacaaaaggtttaattgcaggtgcaatgagataagacaaggtcatgctgctcacagcctcacattccagggccacctcttgcctgacaattcctacccctctcttggtttgatttcttcaaaagctgtttcctaaacctctgcttctcaaacattaacgagcacacgggtcacctgtgcatcttgttcctcagcattttttttttttttgagatggaatcttactctggcaccaaggctggagtgcagtagtgccatcttggctcactgcaaactctgcctcccaggttcaagtgattgtcctgtttcagcctcctaagtagctagaactacaagtgtgtgccaccacacctggctactttttgtattttttagtagagatggggtttcaccatgttagccaggctggtctcgaaccgctgacctcaagtgatctgcccacccgggcctcccaaagtgctgggattacaaatgtgagccaccgcacccggcacccttagcagtttctgatactacaggtctgggtggccttattctgcacctctcacaagctcccagtgacgccaggcagctggtctggggacactttgagtagcctgggtctcaccatcacctgtgactctagccctggcccatcagtgactttctggcctctgggctcacctccatctaatcgacaggttgctaacaccacctgatgtcctcagagcaaagtacctattgacggccggtgatgcagtaggcaagcacttcaggcttggggagtttaagctcttttattgccatggcttttatgtgctctctgcatttgagagctttgcaacttcattagtgtacagagtactgctgaaagaattccttggtcgcccctcagaccttttgataaacaaacattgtaaatgtaataatcaggtcaccaccattaaaaattattataattaaagatgatacaagctgcccgaacccttgatgaacccactgcctttgtttggagctgttgttaaatgaatacataggtatttttcttgcaaagcaatgttcttcctgcttagctggtttgagacggagtcttgctctgtccccagaatggagtgcagtggcgctatctcagctcactgcaacctccacctcccgggttccagcgattctcctgcctcagcctcctgagtagctgggactacaggtgtgtgaccacacccagctgattttttgtatttgagagagatggggttttgccatgttggccaagatggtccccatctcctgacctcgtgatccacccgtctcggtttgtagctgatcttcctatttgctttcttcctagaagatctttctacaagtctgttctattctgctgatgtcatttgttttgcatgtaacattgctaggagtccaggggaaatctttatgctcaagggctgggggacgacgttagaagctatgatacaactccgaaattataacaggaaataattattacaagagaagaaatatcacacttgtctacactaatgcacttgactatcaaacaaagagatctttaagatgatgaagcacgcaccacgcaggagaaaagtgaggaaaacgcggctacaatttgttctgagtcatatctcttatagaagggattgcattctgctttgtcatcatttactaagaaagttgtttgcaaatgagaggaaggattcaggctatggaaaccggctcgaggtcaggcggcgtggagttgccagggctgcggttctaagacaagtgtctcacccagttcgcacccatcgcgaaacagattcaaggcacaattcagacagaaggtgaaaaggagatcctcactctggcatgggctgaatatttaatacctccaaagtcaaaaataagaacggctataagaagacagacaattatagccctagcagagaaatttcactgggccctaatacaccccgtgggatagtttgcattgtattttagagctgggaaaacaagctaagaaaggatatcttcatgaggttgctcaactcataggggcagactttttttttttatttttattttttggagacagggtcctgctctgtcgcccaggctggaatgcagtggcacgatctcggctcactacaacctctgcctcctgggctcaaacaattctcctgcctcagcctccaaagtagctgagactacaggtgcacgtgaccacacctggctaatttttgctttttttttttttttttttttggtagagactgggtttggccatcttgcccaggctggtctcaaactcctgggcttaagtgatcctcccacctggcctcccaaagtgctgggattacaggtgtgagccactgcacccagtctcgagctttatctctcacatgtgcctctattcaggattccaccctagttttgaagaaatagattcacattctgagtagtaaagttaaaaacaaggatctcaataaattttatgtcacctacaattattgccaggttttccttaatgtcatgtgtaggctgcccaatactcgatgctcaaaacagattttagggagcagaaaaaagacagggagacagaaatggagacacagaggaagggagttgtttgatgaggttggcctatgttggtgagaatacagcacaggtgctttcaagcttccccttcactaaattcaggatgcttttctttgttttttgagatggagttttgctcttgtcgaccaggctggagtgcagtggcgtgatctcggctcactgcaacctccacctcccaggttcaagcaattcttctacctcagcctcccgagtacctggggattacaggtgcccgccaccacatccagctaatttttgtatttttaatagaaacgtggtttcactgtgttggccaggctggtctcgaactcctgacctcaggtaatctgcccacctcggcctcccaaagtgctgagattacaggtgtgagccaccatgcccggcttttttttttttttgaaatggagtctctctttgttgcccagactggagtgcagtggcacaaccttggctcactgcaacctctgccacccgggttcaagtgattctccttcctcagcctcccaagtggctgggattacagttccctgccaccatgcccagctgatttttgtattattactagagacaaggtttcactatgtcggccaggctggtcttgaactcctgatctcaggtgatccacccaccttgacctcccaaagtgctgggattccaggcgtgagccactgcacccggcctttttgttatttgttttgagacagggtctcactgtcacacaggctggagtgcagtggctcaatcatagctcactgcagccttaacctcctgggctcaagcaatcctcctgcctcaccctcctgagtagctggaactacaggcatgcaccaccatgcccagctaattttttgttgttgttattttgtagagatgtagacgtcttgctatgtttcctagtgtattagtctgttcttgcagtgctgtaaagaactacctgaaatcaggtaatttataaataaaagaggtttaattgactcaccgttccacagactatacaggaagcatggctagggaaggcctcaggaaactcacaatcacggtggaaggcaacggcgaagcagacacgtcttacatggacagaggagaaggaagagaaagaacggggagatgctacatacttttaatcaaccagatctcgtgagaactcactcaatatcatgagaacagcaagggagaattcctcccccatgatccaatcacctcccatcaggccccacctgcagcactggggctaacaattcaacacgagatttggctgggaacacagatgcaaaccatatcacccaggctggtgttgaacccctgggctcaagcaatcctcgtgccttggcctcccaaagtgttggaattacaggcgtgagcagctgcaccgggccaggatggcttcttctcacaaggagtgtctactcccaaacccagtgctgaccttgtggccctgctccatgaaatgctccaacacccacccaccttccaagccagcaccaggggagctgcctggcccattgctctcccaacacacatttcggccaccaagccctggctccaaacttgtcccttcactttatcccagatgcaacacctgcaaatggcagccgtccattgatcccgacaacaaaaacagtgaggcattgacttctcccaatctgcccccagccacagaccagattcagctgaaactggcatcagctgggtgggatcctcttgagtggctccttttgcctaacgggcaggttccagacagcctagcacgtttcatcagggttgccacgaccaggccctgtggatatcagcaggctttcctattctcactggccagtctctggaccggccctggtctcccagccacagcacttcctcctgcatcacctttgtgggtgcccttaacagacgtctgcacctttcccaccatgtacttgcaacctccctcctctgagaagccctccggtctctctctggcttgcagcaggggggctgtggctcctctaggcccccagagctcctgcagctgcccctcccctgttgcagtccgcacctcaccacgctccacttcctcctttccaaacctgttgttcccacggccctgtgagtgccaggaaagatgacacacatctcctgtctctctccccagccaagactctgccccacaaacaggcctgatgttttcacacacctgggagttactttaatctgcgatgctgagacatgcagacatgggcatccctgccaggaaaaaaggagtttacactcactgacccctgaaaaccggagcagcccccgcagggctgcaggcggaagcacctgggtgggtcatgagttagagagataggggactagtgcggctgtccccttattcagacagctctccaatcaggaaaccactgttattaaaagtccccttgcttatttcattttgctaagccttacttgcatgcatcgtgtatctttcacataacatttccccatttgcttatgtcacagggttcgctaactacaggcgagaaagaaaacattcccaatgagtgcagacacacgtgccctctattgtgttcattccgggttaaataattaggttattgggagtctctgtttttgtctttggtttttttttagagacagggtctcactctgtcacccaggctgcagtgcagtggcacaatcacagctcactgcagcctcgacctccctgatctcaagcaattctcccacctcagcctcccaagtagctgggactacaggtgtgcaccaccacactcagctaattattattattattattatttgtagagacagagtttctccatgttgcccagtcttctggtctcaaactcctgagctcaagcaatttgccggcctcggtattggtgttttaaatgctcaatgttacgcaaaaatgcttggtggattcccaccccccaccccaatacaatgaaacatggtatctcattcaaaagcgttgccctacttgtgactcctttcaaggagtgggttaggttgatttttcactcagcaatcagcaatagagtttcaattcattattttaaactgctacatagtattctataatatggatatacctaaatgcatccagctactctatagatgaaaatttactttgtttctattttcccccactccagacaatactataccatccttgggttgttgttttttcctccagtataaaccacgcagtaaaaatcattcattttccggccaggcttggtggcttacacctataatcccagcactttcggaggctgaggtgggaggatcacctgaggtcaggagttcaagaccagcctcactaacattaaaaatactctattaaaaatacaaaaattagccaggtgtagtggctcctgcctataatctcagctacttggaaggttgaggtaggagaatctcttgaatctaggaggcagaggttgcagtgagctgagatcttgccactgcactccagcctgggtgacagagcaagactctgtctcacacaaaaaaaaaaaaaaaaaaaaaaaaaaaaaaaaaatcattcgttttccttgtcccaaacagtgctgcaataaacatcctcctctatgtttttcatgtgtcgttggttttactagtgtaggacagattcccaaaagtgaggtttcttgctaaagagcatgcattttaaattttaatagacattgtatggttaatttgtgtaaagttgaaagcaattcacactcatgaacaaggaatttgagtacccagcttcgtgtattgttgaggcattggaagttactgttcattttctagactaagagatgaaaaatagtatcccataattaattttatttgcaccttgaatgtgaggttgagcaactgtttctaagcccgataggcaattttgatgcccccttctgtgaactgtctgtttatatcttcttgaactatttttctctaaagtctcggttttctcatccataaaatggggaaatgagagtacgtatctcgcgggagtcatgaagatttaatgaatcagtggccataaggagctttgcgaagcagcttgcaacagagaaaacattatcattttcattacacgctgggtgccagacacatggtggctatcaaatcttttatcttttttctccttccctccttcctttttattatcattattattattattattattattattattattattattattttggtgttctccatacagagggttgggcttgggaaagaaaaaggcccacttaagagaaagaccacatgttgggctggctggaggcaggagccagacaggaccacacagtggcaggggaaattgtcaggagctaaggctggggaactcaaagggggagtcactttgacatgagtggttttgggggttgagaaaaggggtctgggctggacatagtggctcatgcctgtaatcccagcactttgggaggccgaggcaggcaggtagcttgagcttaccagttcaagaccagcctggccaacatggcgaaaccccatctctactaaaaaataaaaaatacaaaaattagctgggtgtggtggcatgtgcctgtagtcccagctactcgggaggctgaggcaggagaattgcttgaatccgggaggtggaggctgcagtgagccaagatcgcgccactgcactctagcctgggtgatagagcgagactccatcgaaagaaagaaggataagaaagagagagagagagagagagagggaggaaggaaggaaagagggaaagagggaagggagggaaggaaggaaagtgggtctgatcttgagtcgtaaccatgggaatagtgaggatggaccacctcccatgttcccagcactttgcctggacaacatgccagtgatatgggaccgatcatttctctccatcttatggctcagaggggctaagcgatttgcccaaggttgcacagcacgtgaacggcaggtcagaaatgcgaacccaggattgtctgacccccagcccctgcatgctccactaccccatcttaagagattgcctggcttctaagcagccctgccctttggtggaggaacctctgaacacctgggtcaggccgtgaagcccaaccattggcatttctagattcctctgctagaattttaggaagaaagttggaagcccccagagtcattgtgcacccttctgcatttctatatcaagtaggagatgcatttgttaccacgctaattagggcagaaattaactgaaatgctgagttttagcagagagcgaatcggctgcaggtgtcagtaattagcgaaaaatgagtcatttgatgtttgtagacacacagccttctcaactttgattcaaaaataaacttcgtgggcacattgttctgaatcactcctgctaatgcatgtgtctatcttaatgctgtaattcagtataaatattttaaataaatcagtaatgttgcttttcagtggcagtacacacatgaaattttctgtacaaaaatggagtaagaataaaatatttttagtaagatcggtagaaacctgaaaaacagccatacagaaattactgtttccttgctcttggtttttttcctctctctttcttttggtttcttggaatataaataattcacctccaatatcctgtcctgagcagggactaagcaagtaaaataaacagcatactggtgaatacctgcagggtttggaaatggaattaaaaatcccccttaaactagacattctcctgttagttcactgcttgggaacagcctgagttctgaggtgggtggagtaaaaaggaaacttacacagaggtagatgtagctgtgtcttctaaagcaaaatctatttccttatcaaactagttaagttggccaattatgagatacgagagcatctgtgtgtggagcaggtgggaacagaagcttggaaattatttttcctcatgaacagcagttgtgtgcacatttgtgtgtgtatgtgtgtgatgtgtatgtttgtgtgtgtgcattttaaggcttaggatcagtgattgcattaaccatagcccaacaggagacgtccccaccatgaaaaattgaatgcaagtgtctcattgtctcctttttttttttagagacagggtctcactctgtttcccaggctggagtgcagtggtgcaatcaatcgtagctctctgcagcatcaacttcctgggctcaagtgattctcccacctcagcctcccaagtagctgggactataggggcacaccaccatgccctgctgactttttacattttttatagagatgaggtcttgcctgtgttgcccaggctggagtgcagtggtgcgatcgtggctcattgcagcctcaaactcctggcctcaagtgatcctcctgcctcagcctcctaaagggctgggattacagatatgagcccctgcatcctgcctggtgtctcactcttgagcaagagaggtgctggcccctcccaccccctggctcggttctagagcgtcctgctgctctgtctctgaagcacgcatctgcacacgagcaagtcttgggttgaccagggtggggtgtaggaggagactctcctatggcctgtgacaaggtgaggggactctggccccagccagcctgacagcttttgtggtcagaagttggctggtcagtgatgtaggaagagttgactcaacagattctcttccataccatggcatccttgaggttaactagttgaatggtttgaaacaaagtgaatgggttaaagttggtgaattcatgattcgtaaaaaaagaagaaaaaagctctcattggtcacctttggaggtcagcaggatatcccctcattattttgaaaactggtcagtaaaagggaaaaaatttaagcatttatcgacctttcttatggcaacgatacatcagcgtgaccaagtggttgataaggggaaggtccttgttatagaagtattctagctaattaaggaagaggaatgtagactttgaatatcagcattttacatctcataatgaactaatggatctaagcaatcaccattacaaaccgtgaacaacctctaaaaaagacacaaaccaagcactctgtgccccccagtggaaggacaggacactacaccatgaaatattcttgtcaaatccccaaaactgaatgtgatcaaccctagatccaactactgatctatagaaaatgaagaggacagaagaacctgtcaaatgacaccatggagatgtcatcatcaaaatccagactgtggcctgtaatcccagctctttgggaagccgaggtgggtggatcgcttgaggccaggagttggagaccagcctgggcaacatggcaaaattccgtctgtacaaaaaatataaaaattatccaggtgtgttggcatatgcctgcagtcccaactattctggaggctgaggtgggaggataacttgagcccaggaggttgaggctgcactgagccgtgattgtgctactgcactccagcctggggcacagggcaagaccctgtctcaataataataataataataataataataataataataataattcaagattgtgcaagctgtggctagctctataggacaaataatccaattttttcattaagtgaattgtaaggaaaagagggaaagggtaataggttaaagaaggcagagacccaacagcccatcgcaacatacggatctgatttagatccccaggcagatgttagaataatacaagaaaaaatatctatgagacaaattagggaactttgaacactgcacatttgattaaggaattattgtgaatatctttagctgtgatactggtatcgtatttatgtttttgagagatgcctactgaaatatttacatgttaagtgatactggtatcgtatttatgtttttgagagatgcctactgaaatatttacatgttaagtgacagaatgactgaaatctgcttcaaaagattccagggctcatctaaagtgggtagaggaacagatgaaatgagattggccctgaattgaaaattattagggctgcgcgtggtggctcatgcttgtaatcccagcagtttgggaggtcaagaccagaggatcacctgagcccaggagttccagaccagcctgggcaacacagtgagaccctgcctgtactaaaaataatttaaaaaaaattaaccaggtgtgacggctcgtgcctgtagtctcagctactggtggggctgaggcaagaagatcatttgactatggaagtctaggaggtcgaggctgcagtgagccctgatcataccactgcactccagccaggggaaaaagtgagaccctgtctcaaaaattaaaaaaataaagcactacatttcctttctagaaacacacacacaggcagatgtgttccatgaatcccaataactgggacaaggagaggcgggatgtctgcagtgtgggatgattctgggcctctgaatgacactgagcggtctgggtggaaatccgcagattttccatcttccagggcagaagtcggcatgctttctgtaaaggactggaccgtgaatattttaggtcttttgggccatatcatctcggtcacaactactcatgctggttgcacgacaggggccaaagacaatatatgaagaaatgggtgtgtccctgttccgacaaaactttatttacaaaaacaggcagcagaccgcatttgccctgaggtggcagtttgaccagccctgtcctgttgctggacagaagaactttctgtgatgacggaaatgttatttctgtgccatccagtataggagccattagtcacacgcagttactgagcactttggatggggctagtcggactgaggaactagtttttaatttttatttagcttaaattagtttaactttaaaaagtcacatggagttagttgctaccacgttagacagcacagttctagagagcccagcccagcaactaaaaaggaggagaggctgggtgcggtggctcacgcttgtaatctcagcactttgagaggctgaggcagcaggattgcttgaggacaggagttttagaccagcttgggcaacacagcgagacaccgactctataaaaaaaatttaaaaattggagaagtgtagtggtgtgagcctgtagtcccagctactcaggaagctgaggtgggaggactgattgagcccaggagttccagaggagcctgggcaacacagtgagaccctgtctctacaaaaagtacaaaaattagccatgcgtggtagcatgcacctgtagtcctagctactctggagggtgagatgggaggatcacttgagcctgagagacggaggttgcagtgagccaagtctgtgccactgcccagtgagcctgggcaacacagtgacaccctgtctcaaaaaaaacaaaaagaggaagaggagatgcagcccagggagaagaactgatttgtctaagacgtggctccaacctttgggttcatgcttctccctgcgccacggtatgaagttgcctgaactccagaaccactaagcaatgaggcaggtgacctgggctctgatcctcaggctgggacctggggaaagccattcacctttagtgttctgctgtgtctccatgtgtacgaggaccacaccccaacctcctcgtccattcacctgtgggggccaccagggggatcacaggagacaatgtaggcagaggccctttgaaaacttcaaagcgccccgggagtttccggatgttctgcattaatttatctaatccaaggtaggaaagtgaaacgtgggctatgaaagacaggagggaagtcgggtgattcatcgctcggctggaactctcgcgggttaaatctctgtttcagtgaatttcctggggagaattcagggccgtgttccagctaacaaattcatccctttgctttgactctgaaccatattctgggacggcatcaaagccagcctcccaagagtcgcttggggactgtctgggccccgagctctccgaccctcctgcctccactctgcagatgctcctgctcccatctccccagcacagaccccaccacagcctcctgcctggccccatctgccatccctgcggctgagcccgactgagagtgaagtccttcattaaatcagtgcctacctcgtcctgcggatggaggtcattctcagcctcattccccttgccagagaaggatgtggggggaggcaggcagggcaaaggcagggagacatcctctggtccagaattgattcctcttctgaaagaaagaaaagcaaagatgtccctaaaggggacattaaaactctcaacaagaccctcaggctgggagtcttcttcccaaggccagggtcaggcctgagaggtgttctcaaagacccggagtgaaatcctcttcctagacaaagatgattccaaggatgattccaagtgggaaggggagagaggggccttgcacgaggcaagtaactaggcctgtgggagcaagttcgtaccgtctaccctctgtcaaactctgtacttgaaacggttcatgttttttaaaaggatgggcgttttaaatccctccattccgctctgccccgtgatgtaatttagaaatcacgagagctctcaaaaaaaaaaaaaaaaaaaaaaaaaacaaaaaccagcgagatgtgctcacagaccttggtccgcaaatgtttttgccagatgctgagaacctaggcagaatccagagcagcttttatagaggatttgatgtttaactcatcatggagaggtccctgatctctccctggagaaaaaggaagtcgatggggtcgtttgtacggcgaaaactacagcatgatgttggagggatcagggagcctccttcaagggtttagggggctctgggtcagggcctttctggacggttcttcccttgggaataggaagccaggatcacagaggggaagggtccagcccagatttggagctggataccctagtgggtatcccttaaacaggagcaggtgagcctgtgttacaggacccgatctggaccccaagagagggttcttggatcttatgcaagaaagaattcagggcgagtccatagagtaaagagaaatcaagtttattaggaaaggaaaggaataaaagaagggctactccacagacacagcagccccaagggctgctggttgcccatttttgtggttatttcttgatgatatgctaaaggaggggtggattattcatgcctctcccttttagaccatatagggaacttcctgacgttgccatggcatttgtaaactgtcatgatgctggtgggagcgtagccgtgaggatgaccagaggtcactctggtgtccatcttggtttttgtggggttttgccagattcttcactgcaacctgttttatcagcaaggtgtttaggacctgtatctagtgctgacctcctatctcatcctgtgacttggaatgccttaaccatctgggaatgcacctagtaggtctcagcctcattttacccagctcctcttcaagatagagttgctctggttcaaatgcctctgacatctgggtggtagggttgtgctgcctggcttcttaacttcctggctcagaacccaaacctgttgcctctggctgcccagccaatgggactgtgacagctgggacaggagagccactgagcttataaacacctgtgagcaggtatccggtagccagcggggggagaagcggtggatagacacagggcttcccagcttaggcaggaaaggactggcttccccacccaccctgtccccatacccccctaccaccaccactttctggaactttccttaaacaactgctgggctgttgcaatttgctgcttcccttcttttcttgttaaaacattttatattttaaatttgtttgcagacaatttccggaaaaaaaaataatatgtgtgtgggccacattcgtcatcctgcaaattttattattttttattattagagattgcaacgtgtgcctcaccatgcctttttcttcttagtaaaactaagttgagtttaatttggctaattaaaagacacgtaactcagatatctgaggcatatagagttaccacattcacagagtgtgaataggttacctattacctaaatagagtagaaaataggttaccaggagctgggaggagggtgcgatggttaatactgagtgtcaacttgattggattgaaggatacaaagtatcaatcctgggtgtgtctgtgagggtgctgccaaaagagattaacatttgagtcagtgggctgggaaaggcagacccacccttaatctgcgtggtcaccatctaatcagctgccagcatggctagaataaaggcaggcagaaaaatgcgaaaagagagactggcctagcctcccagcctccatctttctcctgggctggatgcttcctacccgccaagttcttcagttttggaactcggactgactcttcttgctcctcagcctgcagacagcctattgtgggaccttgtaattgtgtgagttaacacttaataaactcccctttatatatatatatattccattagctctgtccctctagagaaccctgactaatacagagggggagatgagaagttgttgaatggggacagagtttcagtttggaaagatgaaaacattctggaggtggatggtggtgacggttgcccaacactgtgaatgcacttaatgccactcaaatgtgcacttagaaatggttacaatgggccaggcacagcggcttatgcctgtagtcccagctactcaggaggccgaggcaggaggattgctggaacccaggagttggaggctgcagtgagcatcactgcactccagcctgggtgacagagctggaccctgtcttttagaaaatgaaaataataataataacaaagaaattattaaaatggtaaattttatgttctgtatattttagcacaattaagagaagaaacataactaacaggcattttggtgccttattaagatgctgtgtgtttaagcttttgtgaggctagtgtgtgtgtgtgcgtgtgtgtgtgcccttgtgtgtttgttgttgctgtgttttattttccctggctgacttggtgagctcttcattgaaaaatcagtctttccatgcctattaatatattctttaagtctgagggagaaattatcttttttaacactgtattttttaaaaggaaatttttcatggctcatgagctggacagccaaaattcacacaggggctctttggaccactctcctttatttttttgaaatggagtcttgctctgttgcccaggctggagtacagtgccatgatctcagctcactgtaacctccacctgctgggttcaagcgattctcccgcctcagcctcctgagtagctgggattacaggcacctgccaccacatgcggctaatttttgtatttttagtagaggtgaggtttcaccatgtgggcttgaactcctgacctcaggtgatccaggtgcctcggcctcccaaagtgctgggattacaggtgtgtgccactgcacctggccactggaccactctccttgaaacagttttgctcaatcccttttctcctcctggcagcggccacaaaatggagtcaaaacgttctttgccgcctgccttgttgactcacacttgtaaacccagaactttgggaggtgagaggatggcttgaggccaggaatttgagaccagcctgggcaacatagtgagatcttgtctctataaaaaaattaaaagttttttaaaatccaaaaaaataaagactccagaatagagtgcctggaacataagtgtcctcagtaaatgttggctatgatggttaatcatagtctgtattattattgaaattatcactgtgactgggcatggtggctcacacctgtaatcccagcactttggtgaagctgaggcgggaggattgcttgagcccaggagtttgagaccagcctgggcaagattgggagaccccatctctcgaaaaaaaaacaacaaaaaaaacaagttaaatctaaaagaaaagaaaagacatgctggccaggtgcagtggctcacacctgtaatcccagcaatttgggaggccgaggcagacggatcacctgaggtcaggagttcgagaccagcctggccaacatggtgaaaccatgtctctgctaaaaatacaaaaattagctgggtgtggtggcaggcgcctgtaatccctgctgcttgggaggcggaggcaggagaattgcttgaacccaggagccggaggttgcagtgagcagagattgcaccattgtactccagcctgggtgacacaatgagactctaactcaaaaaaaaaaagaaaagaaaaaagaaaagaaaagaaattccgtgtggtcacatcagacctagtgatgatttcttttcttctccacccacccacccaaccagttgtatttcccatggagcccagtagagggtagagggtagcagcttgagcacatcctgcatgggtgggaggatgatgcaggattaaggagcttctcttttttttgtcttgtgttctcaacacacttgctttctctcctggagggtatcctctcttacccacgctgtggagtacatgcctcactttaccctgtaagtagcccagctcaaaaggcagccatttctttcccatgagcaaggggcctcccctttcgggaattttcctttagattgggcagacctggacattcctccccttctgccctccttaggagggagtgctgtttagcttgggtacatgaaccccagtgatatggtttggctgtgtccccacccaaatctcatcttgaaatcccacgcgttatgggagggtcccagtgggaggtaattgaatcatgggggcgggtccttcccatgctgttctcatgatagtgaataagtctcataagatctgatggttttataagggggagtttgcctgcagaagccctctctttgcctgctgccatccatgtaagatgtgacttgctcctccttgccttccaccatgtttgtgaggcctccagccacgtggaactgtgagtccattaaacctctttcctgtataaattacccagtctcatgcatgtctttaatagcagtgtgacaatggaacagcacacccagagaagctcttctcaagtcatgagcagcatgcacatcagctgaaagtcccaagggcatatgcggattctgactctggaggtgcaggttttaaactaagttccagggaatgcttgctggtgcatggacaaccactcctccagctgcaagtctaagaccttcagagtatcactggccaagaccccacagaacctcgtgtgtggggaagacacaagagtgggttctgaccccagacgctacccaccgggtctgatggggaacattggcaggcttgtcacagctcccagtcagcggagaaacccctctggctacgagagccatatgctctagttttatggtgagagaggagccggtaaccagggatgatggagtggactggctcagaagcatgcaggaccaattacgggcactcctcagatcccatgcaacgtgaactgcctagggcatcagtaaggccccagggagcactccgggcaatagaaagttcaggacacctcacaaaggcctgtctgctttctgttctttgaaatgttcccttctaacaaggaaacagaagtgacttttgccttctctctctgctcagcccaagtctaaccagaactttttctttctttctttcttttttgagatagggtcttgctctgtcgcccaggctggagtacagtggcataagcacagctcactgcagcctctacctcccaggttcgagtgattctcctgcctcagcctcccaagtagctgggactacagatgtgtgctacctcacctggccaacttttgtattttatttatttatttttttggtagagataggggtctcactatgttgcccaggctggtcttgaactcctgggctcaagtgattctcctgcctcggactcccaaagtgctgggattacaggtgtgagcctgtaaccctgagttggggctgtggcgagctatgattggcctaatcaggacttccttgggttcacatacgccttgctcctgggaggagtgagatgaattcttatctgctgtgggatagaggaggggcaccagagcctgtgtttttacaccaaggactgcgtggggccctacagacctgcctttccctgcccaacctccttctctgaccaagacaaaactgcaggttcactgtggcaggtgattacaacggacagagggtttgttcccatactccatctaccagtggtgacacttcctttcccttcagctcacctgctcccccaactctttgaagaaatctcagtaattcactgagatcagagtctatcacacaaacatccgaaattgtagcacaccggggagcctgccaggaaggcctataatcagataacacattccagcccggagacctttccagaggaagggttaagctcccaaggtagttagtggaaatcaaagaactgcatgctctcattatctcataacaaacataccaggttaatagctgtcgctgccgctctaaaccacgtgtgttgtgttttgtgagtgctgacatggggcgttctttctcccaccatatctgcaacttgacagtgtcatcgtggttgggtgctggagtctcctaaagtgttttgcatactgtctcctgcacgttgcctcgaaggatttttaaataattgctgtgtttaatgggaactccttcccctctctaatcccctccagtagaaaagctggccagtgtgccagtgtgcccggggggcatttatttatagcaggaacgaaagtggagcgtcccaaaagactgtctgcttgtcctgagctggcaaggagcaaggttggatgcccagctgtcctggaccaccccttcccatggctcctccagcctcctctctcctgcttgcaccctggagcttccttccaagcaggatgggggtgggggtgacagagacagccccagaaggcagggactgactgtgggggacccacaaggcttgtcaggcccctcccttcccatcaacccctgagtgatgccagggcccctgggcaggtgctgccagggcttaggacacaaggacctgtgtcctgtgtgaattttgtgaattctgtgtgaattttgtgaattctgtgtgaattttggctgtccatctcaggaccactttgttcttggataggacaacgtggttgtgaggacaggtgtgagcaaggcagccagtagacctggaggcaggggctaggcagccccctcgacagaaccccatgaaattcttgcacgtggagatttatttgcacttgccctgaaatcccacaaaacagcgatgacaaagatggtagcacctctgtccatgagagaaggctggagcgtcaggctcctgggtgtcaaccaggtctggccagtgcctgtcatgcttggtctgggtggctctgggcctgcctgatgtcctcctgctgactggtcttggctggctccaggactgggaccctcctgggggtggcagaagcccctgagcctgaggcctagagggcacacctctgacagcaaggcagcaggagcctgtgctgaggtcagacctgggtgggaaatgcagctcccatttttaccagctgtgtgaccttgaactaccttccaaatctctccttgctcttcttatgggtggcattgctttgcccaacaagataagttggagtcttaactctaagaccttactcggagatagggtctttacagaggtaattcagatgaggtcatttggccaggcgtggtgcctcgtgcctagaatcccagcactctgggaagccgaggagggaggatcgactgagcccaggagtttgagatcagccttagcaacatagcgagacctcatctctacacaattttttaaaaaaattacctgggcacggtggcacacatggcacgcacctacagttccacttacttgggaggctgaggcaggaggtttgcttgaacccaggagtttgggctgtagtgagctgtgatcatgccactgcactccagcctggctcacagagcgagaacctgtctcaaaacaacagcaacaacaaaaagatgaggtcatcaggacggatggacattaatccaacataaccgtactctcacgcaaaggagaaatttggacagagacgggcaggcttagggaagaagagggcgtggagacacaggaagagcgccacgtggagatcacagtgatgtggctgcaaactaaggaaggtctgcggctcccagcagctggaacaagcaagggagagtctttccccgcaggcttcagagggagcatggcacttgactttggacttctggcctgcagaaccatgagaaaataagcatctgggttttttttttttttttttttttgagacagagtctttgctctgtcacccaggctgcagtgcagtggcatgatctctgctcactgcaatctccgcctcccgagttcaagcgattctcctgcctcagcctcctgagtaacagggattacaggcacctgccaccatgcccagctaatttttgtatttttttgtttctttgtggtttttttttttgttgttgttgtttcttgagacagagtcttgctctgtcacccaggctggagtgcagtggcgcaatctcactgcaacctccgtctcctgggttcaagcaattctcctgcctcagcctcccgagtagctgggattacaaatgcacgccaccatgcctggctaacttttgtatttttagtagagacagtgtttcaccctgttgtccaggctggtctcaaaatcctgacctcaagtgatccacctgccttggcctcccaaagtgctgggattacgggtgtgagccactgcagccggctagtgtctgttcttctaagccaccacgtttatagtacatggtgatgggatccctaggaaatgaatacagacacaggtgggtagtgctaaggagatgataatacaaaccccagggtggttgtggaatgatgtgagatcacaggacgcacttagcatgctgctgggcactagagacaggctctggaactgacagcgtctattccccagggaccaggggcccttttcgcaacctgctgaatattagcttgaccttggagctgcactacttccattttatttcatgatattttattttgctgactgggagtgagagaagggcagggaactcagagaccctgcaagtaaatgtatgtaaaatttgaaacgcaatttagcatgtggagccgagagccccgaaacgcgaaaagcactccgccccacacccatccccatccccatccccacacacaggggttgccattctgggtaggaacctggctgtggctgccagccaaagctcatgagagaggcgcggaacaggaccaggtaggtggctctgatcacaggcagcaaagcagttacagattcctttgcaaataagccaccctgtcgtcttttgctgtctcctttctggtatctcttccctccccgacctcatccacctccccttcctaacagatccaacttgcaaagattcctggcttctatgcgcctcttgcagcaatactaattaaatgtttcaaatgcttcttatccatggttaagtgaagataaaattttaatgatttaattagcaagctctaggaaaaaaaattcataatgaagaaaggcgtttgcaactgtcctaggctttacacatttctgcgtaatgctgcactggagttggaggaggctgggcctgcagtgtgctttgccacactgcctggaaacagagacacccccaacttgctccccagagagggagggtgtctctagccagactggctctcatcttttgagggggaaatggcaccctggaaacgagggacccattaactcagaaatgaagtggaaatgcttgaaaacggatgctgttttccaaagtagactctcgaaattggtccatttttcacacgtcctcatgactttttttcattttccttttagtgtgtggctctcttcgtttcaacatgggtaactgatttacttccagccacgtgaatgttcagagtttactaagagaaaactctcatggcttcagggaggatgggatttaaatggaaaaattaattgccttgtttgaagacttttggtgtttggagcctcgggaggctcccaccattcaaagtggttttttgtttgtttgtttgtttgtttttgtttttaatgcaaagtggttgacattgagtgaccccatgtggaacgatccttctccgagaggcgctagccttccctgagcaccttgacttccaccatcgggatcctctatgcaccctgttctgttcactgccaagtggcctcctgtgcagatccacaagttccctaaatggccttggaagacgcagggtgtgccatgttggttcagcagaaaatatcatgtcccgagaagccagtggacggcatcaccctggccaagctctggcacagggagctgcaatgtgtgtgccaagctgcttggagaactggctctggaagcagagcccctggtgcccagactggaatgcgggaccagaaacacgtacttttcgtcctctggggcgcggatgacgctggcacgcactggggctcctgctccacctgccctgaggtgagaccccatgtccatgtgccacacaccatgcaggcagcaacgagtgtttaccctatttcccctgcatgtgggacaggactttctaaacaggttgctaataagtagttgaataaatgtgcagcagatgccatcagtgctcgcccctcgagctacctctttgtcccctctgtcctgactatttgtactcaccacgactttcctttgctgtgttctgacgctttgatgtcttgggtcttgctgaccctggagggactgcgcctcccagggctagcggatccccagagatagtaaatgactcacttgtgagtatagctttcatctgcaaaccaaccaacccatctctgaccacttcctctgtagggctcttacactctggtcacccatccaacctgccctgaccaccccagggccaggtactggataacaaggggcagctcctgtgccccggagcccgctgaaatgatccaaacagccaacctgaagcctgctcgccctgcctcacctgtgctttccctcggaaaccaccacaaaggctctcacacgcttcctcccgcccctctgtctccggactgaccccggggctgctttgtgtggccccgtgtgacacgtcctggaatctgtgagtataaaaagccttttatcatgaccatcatttctgtgtctgtgtgtcttaccatacctgaattaagacaaatcctaagaagccttaaaacaccggccaggcatggtggctcacacctgtagtcccagtgctttgggaggccaaggtggggcggactgcttgaggccaggagttcaagaccagcctaggcaacatagtgagaccctgtttctataaaacgtttaaaaattagctgggcatggtggcacgctcctgttctaggtactcaggaggctgaggtgggaggattgcctgagcccaggaggtggaagctgcagtgagccgagattgcacaccactgcactccagcctgggtgacagagtaagaccttttgtcaaaacaaaacaacaaaaaaccatcatcgtagtgcactgccctgacttccagctgcctgggggccctctctggcccctagggtccaaaagagcctgagaatggatggccttctgcattcagtaacactgagccaatgactgacatatataaatatatgtatgtgcaatataactgatatatacatatatatatatataatataaatataacatgtatcaaaatacaatgtaaggctgggcaagcaataatcccagcactttgggaggccaaggtgggtggattacctgaggtcaggattacctgagggtggattatctgaggtggattacctgagtttgagatcagcttggccaacatggtgaaaccttgtctctactaaaaatacaaaaataagctaggcatggtgtcaggcgccgtaatcccagctactctggaagctgaggcaggagaatcgcttgaacatgggaggtggaggtggcagtgagctgagattgcgccactgcactccagcctgggcgacagagcaagactctgtctcacaataaaacaaaacaaaaaaataccaatataaatataactatacatatccacatattccacacaccacgccagagttggaatcactctgaggacatggtctacactgagtcactaattccgaacccagcaggatgaagcccaggtgccatggtggcggtcggctcggtaacacactctctattagaggctcctcccctcccgcctcacttctctactctcctatctatgcttccctgggccacctcccaaataaaccacctgcattggcatcaacatcgcaggatctgctcctgggaaatttcaaaatcaggcagaatgaaagaatgagaatacatcattcccagacacgtatctcctcatcccccatggaaggaagcgtgccacctgcctggccggagcagcccagaggctctccagcgtcctcttgtatcatgtattttggttcccaaatctgaaattcggtcaatcagattctctctttctttggaattcaaacaaagaaacaaggacttgatttgacacttggtggtgagaccaaaaccatggagagaggctgagtcatgtccgtggtggtgctgttaccaagaccccttctcagatcagactgtgtggaggccggccctgagagctgtgttgggtgtgcttaagagctacagatatccaaccctgtgatccatctgctccttttgactctcagcccacgaggctgatctgcacggacagtatcaatggcctaccctggttttggcttcccactgggctcacccaatggggatgcccagaagcaattcagagggacagaaggagcaaggccagggtgttgatgtccagctctttcctcatggggtcgccttgggcctaccaaccatgggccccaccaaccatgggccccaccaaccacgggctccaccaaccacgggctccaccaaccacgggctcaccaaccatggggcctgccaaccctagatcaaaaatatttaaaagaagaaaatacaacaataaaaataatacaaattgctaaaacaatgcagtaaaacaactatttacaaagcattcacattgtatccggtattataagtaacctagagatgctttaaagtatacaggaagatgtttgtgggttacaagtatataatatgccctttcatatcaggaatttgagcatctgcagattttggtatctgtgggggatgctgaaaccaatctgccatgggtaccgagaaaggactctaatctctttcttcagcccttcttggactatcttaatccaaatttaccatctttcctgatagatcctggtggggaccttttgcttgggcaagcctgtgtgggtctctgtttcttgcaatcaaaggcatggctttggggctcaacagatgagtgtcatccccagagagcccacattccaagacagcatgagaacgggggatcctctccagggggtcttggctcttttatgtctgctttaactcctcaaagaaccccattccttttttccagagaggaggactcaaggataagatatttctgccaaaaaccctttttctgtcattaatatgttaacaaatgctgtcaagtaacagtcgcggtcgaccgaatttgctgttggcagaggctgcgcgctgccacacaaggctgtgtctattccacacaagcccggctccctccaccaggagatcttggcattggaggtcaccagggcccacagtgggacctacctaccctgtcaacagtgacaatgtctcatgtatgaataatgccttcacggagcatttctaaattccttccttcaagggtggcagcagagattacaggagcagcgcagtgggaggtaggcactagcccatgcccggaggcagggagaagtggggagaggagggagcaagagtggatatgaacgccaagcacaggggagaggggatgagggcaggacaagccagatccagatgcaagagataacgtgtactgaagaaaaattcaaaggagatgaaaacgtcatacaaaggaaataggtattgaaaaatcaatggtggtgctcaagggtcttaagaatcaatattagaatcacatgcagagaaacaatgggtggaggtgttgtgggaggtgcagatgagccagacatgtcgaccagggaagactgaaccatccacaggaatagggtgtattggttagccacctctataaaactgctgcgtaacaaacgaccccaaaactcagtggcttaaaacaatagttatataggccgggtgtggtggctcacgcctgtaatcccagcactttgggaggccgaggcgggcggatcacgaggtcaggagatcaagaccatcctggctaacatggtgaaaccctgtcactactaaaaatacaaagaattagccgggcatggttgtgggcacctgtagtcccagctactctggatggaggctgaggcaggagaatggtgtgaacccgggagacagagcttgcagtgagctgagatcgcaccactgcactgcagcctgggtgacagagcgagactctgtctcaaaaaaaaaaaaaaaaacaccagtagttatttactctcattggtcagagggccagcagaggcttggatgtgcgaacctgggcttggccagagaggctctgatccacgcatctcttgtcttcctcctgagaccgtgggctggccaggcatgctctgctcatgatgatggcagaaggatcagagaacaagtacaaaggcgtgggtgctcttgaagcctaggtgcaccatcacacccacttcattccactgggcaaagtaagtcccatgggtaaacacaaagccagggtatggagaaacagatcccattcctttcatggaagaactgcaaagtcaacagcaaagggcatggatacggggagggcagagatgcagtctgtaacggtgggccaaggggagagaggcaggcaggaagatgacagctgggggctcatttgcaagcgtggatttgcctggttagctctggttctctgctcccttctttctggctctttctttttctggttactgggctataaattcgcagagcaggacttgatgacatcctccttatggccagtcttggcaccccaatgggcagctgttcaggcagtccacagatatttactgtggaccttcttggtgctaggttctgtggaacaggaggacaattcctcattcctttattggttcaattatttagtattccctaagtgtgtggatgaccaaaggaaggaaagatggggtcctaagttttaaattcttttaaacactctcagggccgggatcggtggctcttgcctataatcccggccctttgggaggccaaggcaggtgaatgacttgagttcaggagttggtgatcagcctggccaagatggtgaagccccatctccactaaaactacaaaaattagccgggggtggtggtgcgagcctgtaatcccagatacttgggaggctgggcaggagaatcgcttgaaccttggagacggaggttgcagtgagtggagatcgcgtcactgcactccagctttggtgaaagaacgagactctgtctcaaaaacaaaacaaaacaaaacaaaacaaaagaacccccaaactctcagtatctgaaacgcctctaatttatttatttacttatctctttctttttttcataccctgtgacatagaaggcaacggcctctaatttctaaaaacaaaaacaaatacaacccaaaaacttggtgtttgtggaaattgggaggtggggaaatcaatctactttcaaatttaaaccttcagacttttccaggggaggttaatatggcttcctcgatttaccaattgctctgagaccttccatctaaaatatcctgtccccctactgtgcatattcccagaaaacatagttccagtttttgtgctttctctacgatatctctctgacttgcatttgtattctgagacccagaatagctcaagtcagataaggctcaaaccctggacttcacaagcccagagccaggaggtcacggtataaaaacgctctctgcccaggtccacgctgggtacaacacatttgcaccaggacccggctgcagccccccaacccggctgcagccccccaaatgcaatccaagtaactccccattccccacaggggtccaatcagtgtagaatcacgttatcagaaaccatccattacatgacagtgaaaaataatgccaacgttggattattttatcttaaaatattaaaggagaaaaaattgtaactaataagaggactttaaaaaaaaatcaataacaaaaaccttcatttttgcttccctgtgtgaaaagaagtctcctattttcctacctgtccgctcaccttcctttcccagacttgcctgggctctcagccatcaggagttcttccgcccatcagcaatggtggctgcttccccaccttccctctggcctgctgggtagctctaggaaggctggaggactcactcgatgctccctgctcctctcctccctcatccccgagagtcctcctgggaagggttgttctcccatcactctgacccactccaccctccccaccctgcccccttgaaatcctccagggaaacttctggctaataaaattcctcgccttggtacattgatcaagggctggttgggagccctgagtgtgtttggtgttttggattcaccgtaaacaccccgcagtaaattcagctccgggatttgtatctgagtgttgcaaggagcaggtaatgtattccagggatgacaccctgttttctgagcatcattcggaaacattttcacatggcttccaatctgtccacctctcgctttgcagccccatgtggctccctggcgggaaattgactgggagaagcgagtcaataaatcagggatggtgcacaacatttgtgtttactccacttaaaccgatatttactggggagtccacctcccggggcccctgcctcctctcacacaagggtgggtctttaaatgtcactcacatggggcgaaacacttaggatcctcatcatgagaaaggataattggacggagcagatggggaaatttcccaaagcaaacctcctcagtccattacatattttatcgatcggacccaggggttctctgcctctctgccagaaccctgggaggggctcctttttcctgcttttagacttccccaagtcacggtcatcatctttctggattagcaagcaggctgacagccctgttcctcattttcctcctcccgaaggctgaggacacaggcctcattacaggagctactggcccacagaaaaattctttgcccccactgatagaaaataaaaagggggctttagaggctgcccagataattggaggcatccactgtgtccctgggggtcactggtcgcctctgcaccattcatcttgctgacagaccccagctagggtgtctatgtaggctgagcccacacgcccagggaattgtacaatttcagatctgttcgcttgcaggctctgctgcagggaagagggaaggctggggctacagaaatggggctagagagattgtgctgcctcttgtgaggtagagttcaggttctcagggcttctcttggacgagagggtccttccccaagtgcaggggaaatgtatcccaaagcccggccacacaacacaggggctgacacagagaccccaagctagaccttgacctccgccgcccctgagaaagctcgcccaaatgcaaagacaaacaaaaggaattgatcattggcttttgaacttcttaaggtcctttccaagcatcatattgactgtacgtgatttttactgtgcagaactttagtttttagaatctgaactccagtgaaattttggctgggtgtggtggttcacacctataatcctagcactttggaaggccgaagcaggaggattgcttgagcccaggagttggagaacagcctgagtaacatagcgaaatgcgatctctacaaaaaagcaaaaacaaaagcaaaacccacacacagataaattagccaggtgtggaggcacatgcttgtaattccagctacctgggtggctgaaatgagaggaatgctgaagcccaggagtttgaggctgcagtgagctatgattgcaccactgcactccagcctgggtgacagagcaagaccctgtctcaaaaaaaaaaaaaaaaaaaatagagacagaaaagtgtgactttactgtactgattattagttagcagcaaagtcgcctcaagcagtgccctggtttgggaaatgtgggagaatagcttatgatatccccaacctatcccctactccctaatcccccacccccaccagcgagtgtgctttggaggcctctgatcagggctgacaaactccaggtgtcagcaacaggggatgaggcaggtggggggtctggtgggagctgccaacttactgggatttccaccatcagcctgacaactctgctatgcaaaagccttcaaaacgttcgataacacctgtgtcgtgggttaaatggtgtcccctcaaaggggaagttgaagtcctaacctccagtacgtgtgcatgtgattttatttggaaacagggtcttgcagatgtcatcgggataagatgagttcacaccacaatgaggcaggccctaaatccaatgactggtgttcttatgagaagaagaaaatttggacacagggagaattccaggtagagaaggaggcagagattggagtgatgtgtgtacaagccaaggaactcacgtgacagcaattactggaagccaggagagagccatgaaacagctcctccctcagagcttgcaggaggaaccgaccctgccagcaccttgattttgggcttctggcctccagaactatgacagaagaagtttctgttaagccacagcccctggtaaattgtttcagcagccccagaaactgatacaaccttcctctgaggaattccggcccccaagcattgggggcaaatagactcagagaatatttggaaggtgatctgggggtacctgtccagatgtcatgttctcctaccttctgaccctgtggttcctctaccaggaatttatcctacagatggattcacagagatactcagaagcatttcacagcatcatctttccagcagtgtagaaattagcaaaacgaccccaagtccataggaatgtgcctaaataacgataatatgttcactctgtggaatattatgcagtcatgaaaaagaataagaaagttatttctgtgccaatatggaacaatatccaagacatattgttaagtaataaaaaaaaaaccccacataaaacaaaaaacaaggtaccagagaacagtatgttaaccattattttgaaactaaaataattatacacaatagatttgtgttgtttctagtagctatgttctataaagtcactaggaacactgaattagcaaatcctgaaccattgctctttggggaaatacaggattatgttctttcaagcctctggtcacatttttatcaacccaacaatacctagccccgctttatgtgtgtttctctttaatgacaccttatttcatagatattgttggttcattcacactgaactcatggccagcaacactataactcacgcctgcacaaagcttctctaacaaaaataatttctccgtgggacacatcacagccttctgtgcgtaggaccctagacagcacttcagtgctatgttcgaggggcatttacacagcaaaatcgctgacagaaagcatgaaaataagaaaaatgtggcattaaacagtcctcgaaaaggacattgaacaagaaggcagggtgtcaccttgctcagcctcagatgggactgtgtatggaggaagactcaaatctttcgtttctttgtgcatgtttgcaattgacctggaaaaccctaagagcattaatttcggggttacaaataagtgttagcgagtaggtgaattcccaagtacaaaatccacaaatatgaaagacagactgtatgtgcccatgtgtataagcaggacatgaaggcatagctacaggtatagatagctcttctgaaaggacacacacattggtaacagtctctgtttccttgggcagaaggaaaagggaacgggagaaggagggtgacttacctcttactctattgccccttttgtactgcttgaaatttttactctgtgaaagcaatacctaactttttaaaacctaaatgttttaggctgggcgaggtggctcatgcctgcaataccagcactttggccaaggcaggaggatcacctgaggccaggagttcaagaccggcctggacaccatggtaaaaccgtctctactaaaaatacaaaaattagctgagtgtggtggcgggtgcctgtaattccagctactcaggaggctgaggcaggagaatcgcttgaagccgggaagtggaagttgcagtgagccaagatcgtgccattgcgctccagcctgggtggtaagagtgaaacttcatctcaaaacaaaacaaaacaaacaaaacctaaattttttaaaaaagttcttgcattttacagttggtcatattctcactttatgagctgattttcagcttgcacagtttgaagatgactctggtgattgttaaatgaaaaagaaaaaaactgatttcttgcaagtcgctagctgcagggggtggggagttccgggtggatcggggggacattccttggtgagaatagtactcaagtcatccgtctcgtgacactgtccctgttcagcctgataacttgtagctccacacacgttccagatggtgtcttgtgttgggtgaccctgggtgctgtctcatctggaattgttagctgtctcctgctggctgcaggcctgtggaccatacccttccccagcttgcactaggggatcctggatgagaagtgttgacttcatccccgggacctaagagcctaaaagcatctttactttcaaagtcttgcatttccgtcatcttatctcatgctcaacacaagtgagggagggagagaggactgccgtgactgtccccatttgacagggaaaccgaggcagtggggtttggacaggctattggtgtcagtgtgaggtcttccacccgggtctcctggctatgacttcgtactgtctctacagggtcctaaatggcactggcaaaccagagattaaggcaagaactcattgagttggaattctttttaaggttgtcttaagctttcctctgctgcagaatatcatccggcaagcagcagagtgggccttgtaaaatgtaaattggatcgtgcactgctctgctctgaacccctccacggttcctgtctcacccagagtcaaggccaaagtccttgccgcgtgctttagtgtccccatagcctgtccctgctatgtggtctgacctcgtctgtcctctcttaactttactgccccatcactccccagaaacctggtcttcttgctgctccttaacaggcctcagtctgcactttcagttcctggtcactggagctccgtccccagatccctgcatggctgcgtggctgtgggctgcagtctgcatggctgcagggctgcggggctctctctccaaatgtcacctctctgtgaaggcttcttccaagtcttcgccgggttgtcattataaggtcattctctttacaatgtttcagtgaactgagcaattgttttctgtgtgttctgcatgttaatatttaagtgcagtgggccacacctgtaatcccagctctttaggaggctgagcagggaggctgacttgaacccaggagtttgagatcagcttgggaaacataacaagaccctgtctctataaaaaaatttttaataaaaaaaagacatttgtactaagtttccagaatgcaaactccatacacaaatctcagtgcatttagtccagctaagtcaaaaagcaaaacacaaaaacaaacaacaaacaaacaaacaaaaacaaatagtatactgaattggtagccgcaagcctttggaagtaattttttagaagagaggacagcctaagaaaactaattttcttaagccaggcatgcttgctcatgcctataatcctagcaacctgggaggctgagtcaggaggatctcttgaggtcaggagttcgagaccagcctgagcaacagagtgaggccatgtcaatcaatcaactgagtaatccataaataaataatttaaaaaatgaaaatttcaaaaaacaaatgttacctgtcagcaaggccctcccaatcaggctcattacctctgcaaaaccaccctgcactcctcatctgcttcctggcagtgtccttctagaattcaataccacagacttattatttcatttgtctttctcttccatcagtgggatcagagtgtcagctccatggacacaggcgtttgtatgacttttgttcgcttttgtataagtaactcagacaagagtgctcaacacgtatttgtcaatttgggtctggctctcctgggacacgcgcagaagcatcttgcagtttctgagtgtgcctgagcaccatggggacagagtcaatagcaggttggtgacagttgctcctttcccctcttccttccctgaacaacgttagtgggtctggcctgtgaccccacatttgatgtggcgatttgtccccctgcttccacccttggacagaagagaaaatatcagtctctgagtttctgagaccagctgcgagtttgtagctgtgttaccagatgtaactagttaccttttttttgttttttgttttttgcttttattttttgagacagagtctctctcttgtggcccgggctgcagtacaatggtacgatctcggctcactgcaacctccacctccctggttcaaacgattctcctgcctcagcctcccaagtagctgggactacatgcacgtgccaccatgactggctaatttttgtatttttagtagagatggggttttgccatgttggccaggctggtctcgaactcctgatctgaagtgatccacctacctcggcctcccaaagtgctggtattgcaggcatgagccgctgcgcctggcctgtaacaagttccctttgaagcggttcaaaggttaaaacttccgagggctgccagttatcgtcctggtgagtgccccttcccgggtccgattccaaggtctccactgcaggctctggtatgttcagacgcagttcctggaggagaggccctgctggctctgagccgggaacccgccacgacgtgcaaagtcgagattgcaaagacagcgcaggtcacacatcctgcctgactccagattgcacgtcaccgtttattttctgtgccctgtgccagaaaacgagatatgtgccatatgctcgcttacttgtgaagactcagggattctacacacattgctggcattcgcacgcatagggaggtgtgatcgtcgctgacactggagcttccgtgtctgtgtgccaggaggctccgagatctttcccggccacacccagcactcacatatggtgttgaaggtgctgtaattctagacacagagcatatgtcctcggagcagacagggtgctaaattaattctaaacgtccgttgtaagtttcttgccgagatgctccctccctgtataaatagcgtctgtgctgcactttcctacagcaggctccacggaagcctagataacctgatttcagctttattttatagtattgaacattcttcaaaacagcccatctccataaagggaaactgggggaaatgatgatatgctaagccgagggacatttgctaagtctaactgggtgttctctcctcttgtttcaatagtgggcatctcggtccctgaaccctgaaggatgctctttggaatcttttttttttttttttgagacagggtcttgctttgttgcccaggctggagtgcggtggtgcaatcacagctgactgtggcctcgactgtggcctcaacctcctggggtcaagcaatcctcctgcctcagccttccaagtaactgggaccacaggtgcatgccaccatgcctggctacatttttgaatttttgtagagatgggggtcccactatgttgcccaggctggtttctaactcctgggctcaagcagtcctcccaccctggcctcccaaatggccagatctaaggagcaaaatttcattgtggttctttcattctgttgtctgggagaggctctgtccccactgaaacctggagtctgggcttctcagatgagtcctacctcttcttctgctgctgtaagtctgctccatatttatactggccccatgaatcacattggggcctcctctataaacctggaagacaccagctttaggaccagaacaaactagagtcctggcctgagggtgccaaaatgagatggaaaatgactctgtgtgtgtgtgtgtgtgtgtgtgtgtgtgtgtgtgtttagaggagtgcgggactgacagaggggcaggacccttaggctcagcctgagtctcaaggcttagcccccctcctcccctctccccacctcctgttccagcctctaattcaccactcatcttccccaggatgggatcagccaggaccacagtttgtccatgtggatatgttgtgggaattagaaaaaggcactcttctggttggacacagctctgtggatgcttagcccagcaagtggtcaatgctttctgcaaaggaaaagtctctccttcctcttggaagatgcagcttcatgcaggaacaaagagctcagtgaatggaggacaggccggatttcagctcctactcgccttcttagctggatgcctttgtgcagtgcacaacttggacaacagtccaaggcacgccagggaacatattaacttcctctgagtttagaagagacatttcctacttgctacagacctttgcagcaaattattttctccaagaaatgacagcaacagcatctcccatttcgtacgactttacaaggacactcctttcctgtggagatagggtctacattccatgcccttgaatctggaaagggtacgtgactacggcagaagtgatgtgttgtgactcctgaggctgggttataaacagtgtaaagcttgcccttggttctctggggggctcactcttggaacccagctgccatgtttcaaggaagcccaactagcctgtgtggagagaccatagggagaggccacccgtggtgtcccagctgacagatagcaccaactgccagacaggcaggtaaagaggcttctggctccttcctgccccagccatggagttggactcacccttcaagtctacccaactgaggccctaaatattgtagggcagagacaagccagtctgctgtgctttgtgcaaattcctggctcatgggtccataaacacaataacatggttcttttgtgacactaagttcagagttttaaaaatgacgcagcaacagtgaacaggacagccttcaaaactcactgctccctccttcaagaagtccttcctgatgcctagactatgtcaaaatattccttttttcattttcttaattaactttttttttaatttttattttttgagatacgatcttgctgtcacccaggctggagtgcagtgatacaatcatagctcactgcagcctccaactcctgagcccaagcaatcctcctgccttagcctcccgaggagctggaactacagacacacaccaccacacttggctaatttttaaattttttgtagatatgaggactctctgtgttgcccaggctggtcttgaactcttggcctcgagcaatcctcttgccttggcctcccaaagtgctgggattataggtgtgagccaccatgcccagccaaaataccccttttctgtagcctccctaatcccctcaaccaggtgaccagctcagagcccttttcactgtgcactgtctcactgagtccccacgtcactctgtgagtggctgttactatcccactttacagacaagggaatggaagctcaggctgggggcgttcccaaggtccacaggggctgaggggcagggctggtctcacagctgctgtgatgcagaaagtgagatgcgtgaaatcctccagtgcccgagtcctggcccttcccactggtacctgtagagctcctggtgaagactcctgacagaaaagcatgaagcctacagcccctcctgaatgtagcacccctcccatgaggttagatctcctcctgctccagagccgccccatgccagtgaggagaaggagaaatgcatgtgccgcgtcaaagccctccacaaacgatcaacacagccagaaggtgggtttccagccacacagcagcaagccggggacgtggctcccacacgtggctgaagggctgggaccttctggtctctcgggacagctggctccaggcaaggccagggtaccatgagagtatgaaatgaaacccttattgtcttggaggcttttctttgttttcacggacagctacaaagctcattctctttatagctctatagttttccataacgtgattgcattgtgactgatttaaccaaatcgtccttggaaacggattggatggtttctagtgttttgctattaccattgctccaaatcaacatctttctacttactcctttgcatattcatgcaaatgtttcttttctttttttttaaattttactttaagttctgggatacatgttcagaacatgcaggtttgttacagagttaggaacaaattggggaggggaacgtggtgactttggtcaggtgcaaagcctggggctgctgggctgtcaaggccttgcgggtccctgagagacactgccccattttcaggctcctctgggtgtcaggctgagaaattagaaccctggccttggctggcaacttcagtctctgagctactacaggatccttcctggctgggaaatgcatgtatctgtggactaggcttgggagccgtaaggtggagcctcaggcagaacggtcccttggacaatgaaaccctttttttccttaacacatcccttttgttttgtttgtttgttctgtttcgttttgagatggagtcttgctctgtcacccatactggagtgcgatggtgctgtctctgctcactgcaaccttcacctcccgggttcaagcaattcttgtgcctcagcctcccgagtagctgggaatacaggtgcctgccaccacgcctggctagtttttgtatttttagtagagacggggtttcaccatgttgcccaggctggtcttgaactcctgacctcatgtgatccacccacctcggcctctcaaagtgctgggatgacaggcgtgagccaccatgcccggcctaacgtatctcttgtgtatattgactttcaatgtcttaagtggcttgcatgttttttataaagtcacacaatacagcaatacactgtaagaaaaaattgcaaacagagtacaaaataaaaagttaaggccaggcccattggctcacacctgtaatttcaacactttgggaggcagaggtgggaggactgcttgaagccaggagttcaaggccagcctaggcaaccaaacaagaccccatctctacaaaaaaatagaaaattaaccaggcatggcagcacacgcctgtagtcccagttactcgggaggctgaggcaggaggattgcttgagcccaggaggtggaggctgcagtgagctataattacaccactgcaatccagccttggtgacagagcaagaccctgtcttctaataacaacaacaaaaagaataaaaagcttaaattccggccaggcatggtggctcacgcctgtaatcccagcactttgggaggccgaggcgggcggatcacgaagtcaggagatcgagaccatcctggctaacacagtgaaaccccgctactaaaaaatacaaaaaattagccgggcatggtggcgggcgcctgtagtcccagctacttgggaggctgaggcaggagaatggcgtgaacccggaaggcggagcttgcagtgagctgagatcacaccactgcgctccagcctgggtgacggagtgagactctatctcaaaaacaaaacaaaacaaacaaaacaaaacaaaacaaaaaggcttaaattcctcccgtattcccactttcactttatagagacaatcactggtaatactttaatctgcaccgtatagtcttttttctacgattttgcataggtatatgcacacatatgtgtacattcagataaagggttttatgtaagtccaattatactatttgcattctcataactttttttttcactgaacttttatttgttgtcttggaggcttttctttgttttcacggacagctacaaatctcattctcagccgggcgcggtggctcacgcctgtaatcccagcactttgggaggccgaggcgggcggatcacgagttcaggagatcgagaccatcctggataacagtgaaactccgtctctactaaaaatacaaaaaaatagctgggcgtggtggcgggcgcctgtagtcccagctactcgggaggctgaggcaggagaatggcgtgaacccaggaggcggagcttgcagtgagccgagatcgcgccactgcactccagcctgggcaacagagcaagactccatctcaaaaaaaaaaaaaaaaaaaaaaaagctcattctctttatagctgtgtagttttccataacatgattgcattgtgattgatttaaccaaatcttccttggaaacggattggatggtttttagtgttttgctattaccattgctccaaatcgacatgtttctacttactcctttgcatattcatgcaaatgtttcttttcttttttttttaattttactttatgttctgggatacttgtgcagaacatgcaggtttgttacataggtatacacatgccatggtggtttgttgcacctatcaacccgtcatctagattttaagccccgcatgcattaggtatttgtcctaatgctctcccttcccttgcgccccacccaccgacaggccccagtgtgtgatgctcccctccctgtgtccatgtgctctcatcgctcaactgctactaatgagtgagaacgtgcggtgtttggttttctgttcctgtgttagtttgctgagaatgatggcttctagcttcatccatgtccctgcaaaggacatgaactcattctttttttatagctacatcatgcaaatgtttctacaaaagaggccgaattggcgtcgcgaggctaagggtgtgtgcatttacatttttatataaccataagttgtcctctccagatgccgtgctgatgaacacctcctcccgttccgtaggagagcgcctcgcactccacactgcccagcctcacatgttctcaacgtcttcactctttccgagtctaacgggccccagttacgtccctgttattgctgtttgcagttccctatttaactgcttaggctgagcataatttcttgtgtttattgaccactcatatctcatcgatgacagcacctcttcgtgcctgtattaattaaagtgctttggagagcagggaacaaaaaaaccatgactcagctggcttggacaataagaaatgtgtctccttttttttttttttttgttagacacgaggtctcactctgttactcgggctgcagtgcagtgccacgatcatagctcactgcagccttgaccccctgggctcaagtgattctcctgcctcagcctcccaagtacctgagactacaggtgtgcaccaccaagcctggctaattttattagtttttgtagagatggggtctcactatgttacccaggctggtctggaagtccagggttcaagcaatccctacacctcggcttcccaaagtgctgggattacaggtgtaagtcaccacgcccagcctcagtgtcttcatttttttggagatggggtctcgctctgttgcccaggttggagtgcagtggtgtgatctcggctcactgcagcttctgcctcctgggtttgagcgattctcctgcctcagtctcctgagtagctgggagtacaagcgtgcgccaccatgcccggctaatttttgtatctttagatagagacagggtttcatcatgttgaccaggctggtcttgaactctggacctcaagtgatcctcctgcctcggcctcccaaagtactgggattataggtgtgagccactgcacccagcatcagtgtctctttttaagaatgaggacaggctttccttgccaccccctatacccccagcagatggacaagacaacatcactgtctatgacccaacctatcgcactgtggtggccacggtgaacccagactccccagcatagcatctgggcactcccttgaagcaagcatctgtagcgcactgaggacctgagaaaccggggctcccctggggtggggagggaggaacggccactgccatcagtaacaaacctgctcgctaccacggctgtggcatttttctgtggcattgtttgtctttttctttttgatttgtaggagctgtttatatatatttgaaaggaaatatatattcctttcaaaatacatatgttgaatcatatacatttttctttggtaagtgctaacaatatttttcctggcctattgctttgctttgagtgaattgtatttatttaaggccaagccttaactggaaggatactttttttcctccccaaatcttgacttcatgaataataacagctgcttctctcactgaaaaacaaaactggaggtggcagagggtgggtgaggtcatcgttatcggtttgcaggctttgaggcagagagcatctgtaggtagaggcagctgcggagaagatcatccagggaggctgcagggagcgcagtgctgctggaacctgcagcagggagactattaaagggtccaagccactgcagccccatgaggaggggcccacgcaggaaaagaaacggtgttgttagaacttaaagtcccgctgagatggtttccacctgggttcacgaagaaggctccagagacgggttcgttagatgacaaggctgactcccaggtggtgatcgcaaacacgaagacacatctcaagccacaggggcttccgggagccacacaggctgagattggcatgatgggcacaagatctgcctttgcagaggatgccctccctggcgggggctgaggaaacagcccatcaccttccttaggctcctgccctctttgtatggctctgggaggtagagggacttagctgacagttgcgtagtggaacggaggggatgcttggatccctcattggtctcattcaactggtacagagctcaggcgagcaggagggacattattatttatttatttatttagtggagatgaggtcttgctgtgttgcccaggtaggtcgtgaactcctgggctcaagtgatcctccctcctaagccttctgataagcgatcctccccaaatgttgggattacaggtgtgagccatcatgcccagcccaagaggggcattatttatttaatggggtttcatctgtaaccccaaatcccccttgccaatgccttgatgtctctggatacagaggtctcccttctggcagctggcctggagtcaataaccacagctcccatgtatgtgctggtcttgctgctccaggtaccgtgctgtgcaggtgtaacaactctatgaggctagaaacaccattgcccccattttgtagttgggaaaactgaggtaggaggaggccaaaaaatcaccaagcaatgctgctgctttctctctaatccctggtctctcctcctatttgtggaagcctttttaaatttttttgagatgatgtctcactctgttgcccaggctggagtgccatggcacaatctcggctcactgcaacctctgcctcctgggttcaagtgattctcctgcctcagcctccccagtagctggggtaacaggcatgtgccaccatgcccggctaattgtttttgtatttttagtagagatggggtttcatcatgttgcccaggctggtctcgacctcctgacctcaagtgatccacccaccttggcctccaaaagtactgggattacagacatcagccactgcacccggccagcagagtctttttgccaaaacgcaaggatggtctccagagtcccggtttctctgcagctggggaatacttttctgatttcagtctggagtaccagttttctgaagtgaggactgtatcggccaaatcttagaaggagaagatcacgaaaaagcgtctgcagaaagagaagaaaggggtggtacactgcggaggaggagggtccactccagaggctgcaggtgacacacgggaccccctccatggatgttgctatggtttaactataaatgtccctccaaaatgcatacattggaacctaatacccaatgtgaaggtattaagaagtggacctggccgggtgccgtggctcatgcctgtaatcccaacactttgggaagctgagttgggaggatcgcttgagcccaagaatccaagaccagcctgggcaacacagggagacctcatcccagtaagaaattaaaaagttagctgagcatggtgctatgctcctatagtcccagttactcgggaggctgaggtgggaggatcgctggagtccaggaggtcgaggctgcagtgagctgtgattgcaccactgcactctacagcctgagtgacagagtgaggccctgtcttaaaattaaaaaaaaaaaaagagatggtccttttgggaagtagttcagtcgtgaggaccccaccctcatgaatggattaatgcccttgtaataaaagatgcttcagagagcaacccagcctttccattccttccaccgcatgaggacacaacatttgtcccctctcaaggacacaacaacaaggcactgtcttggaaacagagagaagacctttcccagacaccacatctgccagcaccttcatcttgggcttcccagcctgtagaactgtgagaaagaaatttctctaatttatcaattatgcagtctaggatattttgctatagcatcatgaatgaactgagatggtacgaggcagggatgcagacaggttctaacgtgggggtggggaggccagactagagctggggtcgtgtctttggttggagaacgacaggcatattaaacaaagatatgaccctttgatttcttgcccaggggtctcgctacttcctctcacatcttgatatggttttgctgtgtgcccactcaaaatctcatcttgaattacaatccctataatccccatgtgtcaagggcgggaccaggtgaaggtaaccggattataggggtggttcccccatggtcttcttgtgatagtgagtgagtctcactgtcatgagatctgatggttttataagcatctggcatttcccctgctggcactcactccacgaagaaggtgcctgcttctcctttctcttccgccacaattttaagtttcctgaggcctccccagctatgcagaactgtgagtcaattaaacctctttcctttataagttatccagtcttgggtatttctccatagcagtgtgagaatgcactaatacacatctgtctaccagcactttagccatggatgtgtcaacatattaccttaaaatttgttcacaaggtaccaggctgggaagaaagtgcttcacctgtccctgacagcttttcctccatttggggcatctgcaaatatcttgaagttgtaggcagaaccgaggtgtgagtgaacacatgcaggtatgtgcattttttctgcaaaaataatccacggctttcatcagcctttcaaaggcatcctctgagaggctaagaagcattgttctaggttaatgatagtttccaaaatgggcaagaaacgagactcttaatctagagatcacaggattccaggctgcgcctgtgttgggtaacagcaggagaaaggtcaaaaccacccatcgacatcctgtgtgactttgggctagtttactaccctctctgagcattctcatttataaaaatgtaaacaaacacaatacctccttccagagcaggggtggggagtaaatgaagttatgtgcttagaggcccctgcccggggctccatctctccacctgcctgcttcctctgctgtctccagcaaaacctctctcctcttttcggtctgatcctccagcctgtgcattgtttctgtatctttgggattttttcttccttcccactgcacccaccctctggtcaatatcactgctatttctatttgcaacagggcaggagaaggaagtggtgaaactttctttaactttacaaccttggagcagccacagttgatatttggggaggaagaaagctgagattatcagcacatccaggtctgtgcttcccaatattcccgatgcttctttgtctactgactcctccctggtcatgaataattaaaactctggccatgctcaaatggcctaatgcaaccactacaagaaaacattggggaaaatatcttacaggctccagaaacaccacacccaaggaagatatttgcaagagcagatggtaacagacacaggttgcctcttcagcctcatcctggcttagggcagccatggccacacggttcccatctgcgtctggcccactgaggtgagaggaggttagctcgctaggcctgggcccattcatctcactcaggaccctaatgctggagcacatttgtgagccaatcagtccttgggccttttttcctttgaatctctactttgttaacattcagctctcatatttcctggtgacacacgaggtcatatgtatggcaaagcatcctctgaaatcatatcgtgctgtattgatattaagctaaagatatactgatctcgggttggttatctgttcttaattcagatgggaagaacaagacccgaagtggagatagttcaatcccctacccccaatttcccagccgcaccgcttaggtacccccaagtggcatcatgtgaccacttctggctatcacgtggtgaaccccaaaacttgggttcaccctgagatgccacatgggttcttggcttcatgcaggaaggaatttaagagtgagctgacagagtaaagtgaaagcaaatttattaagaaagcaaaggaataaaagggtggttgctccataggcaaagcagtggcatgggctgcttgactgagtatactgtcagttctttgttgctcatatgctaaacaaggggtggattattcatgagttttttgggaaaggggtgggaagtttcccaaactgaaggttcctcccctttctagaccgtataacataatttctgaatgttgccatggtgtttataagctgacatggtgctggtgggagtgttttttcccaagctaatgcattataattagtgtataatgagcagtgaggatgaccagaggtcgctttcctcaccatcttcgttttggtgggttttggctggcttcttgaccacattctgttttatcaggggggtctttgtgagttgtaccttgcaaaaccagtcctgcctattcttgtctcatttattcaagatggagtcactctggttggaaagcctctgacatggccactgagtaggtagcagacgtggtaggtgccacctctgggtggaagtattttagagctggtgcaagatgtccctggtctgtgttccctgccacgacaattgtgggggccacaggttgaggtgttagcattgcgagaaactgagaaccagagagaccgatacggagaacgggaggattgtttattttaggtacgcactggctcagtggattcgcatccaaaaagctgagcattgaacaacgactgagtggggtttttataagcagacttacaaaagtaaaacaaaagcagttaatcatatagtgtataatttgtggccttgtagctgcgtcaaaagaaaaacaagaactggctaaatacagacatttgtaaaacataatcacgtttaagaagcctgggaaaggagtaacagtaaagtaatttatctttttctctttttttttccttcaacattgctctgggggagaggggtgtctgaagcccattcctttggccttggctgctcgtacagcattatcttataactgtccttgaagtgtgcttgctaggcagaggaaaacttctttttttcttgtgaacccttgcctgttacttttcttggagtgaatgaatgcatatttatttttaaatttctgcctcattagagccacctatgaaagcagactggatcgctgagtcactcagtggaagcctgtttcaaaacacagtgtatcagtagaaattttgaggtatagtgaagccaacagatcaggagatgattgctattgaaaaagtagtttgttactcacagttcccaggaggaggggacaccgcctgccacgccacacagagccacacggggaagcaccaaggtcagttaggaggtggagggaaaagaaggctttgtttggtttgggtgggttgtttgcatctgaaaagtgctgtcatggcaacttgtatctctagaaattggctaactctagggggtcagcgaggccccagatgtcagagcattggaatgcaggaaataaaagatgtggttaataccaagacaagtgttccggagggctgcacaatctgcactggactttgtgggaggggaaattaaactttgttctgtgaagcattcatacttggggattcatttaccaccggcagtgtgctactgcaggaacacaggagaagcaggggcatgtgaaaaaacagcagtctcagcataggcatagcatctgccacactgacaaagttcgttcatttattcattccaatattcagccagtggttgttgagcaccagctgtgtgtcaggcctggggctggggactggatcacagagaccaggcactaaccctgctcccacagacctcttagtctcacgagaaaggtgacacatgtgaaaggacaaggatgggctggacacagtggctcatgcctataatcccagcactttgggaggccgaagtgggaggtgcttgaggccaggagttcgaggccagcctgggcaacattgcaagaccctgtctctacaaaaaagaaaaaaattacctgggcatggtggcatgcacctgtagtcccagctgctctggaggctgaggaggaaggatcgctttagctgagttggaggctgcagcgagctgtgatctacactccagcctgagcgacagagtgaaagcttgactcaaaaaaaaaagaaggaaggacaaagatgatagagtgtgaagactgccatgcagagctgggtctccagtgggtgggtaaacagaggagggagtgaatcagggaggacttctcacaggaagtgacacttagggtaggtgttcatggagttacataagaattccctgtgcagagacaatgggcacagatgttctgggatgtctaggaagcacatgtataagggcacgtccaggtctggcagagttcagtggggctggagcagaggagcactggggtatggtgagacatggctggaaagccagctgggttgacatctgcaaaggctttgggtgcactgacaagggctgcaggtgactgacggccatgcaggtgacattaggagattggcagtcacagcctttccttcttaaattcccctcacctccttcagtggctgtcctatcagatgattagtgttcatttaacccctcttgttatagttggggaagaaccccataagctcctctaatttaaggcagggatagtaaatgccatcctcccttccagcactcagggcagacatcagcaatcgatcgacattctttgcatcagaggccagattgagcctcagaggccttttcaacacagctcttcaggcaacaaatatccaagggcccaaattggtgtgcaagtcgatttatatgtcatttctgttttaagaggttaaggacgtcgtgttctctttctagaagtatttttactttagaaaaaagaaactgcagagtgaggacaaaatttagtcaaagaaattaatagctaatggtagaattttagtctgcagaagttttgggaaaggaagtctgtgcaagtctctcaatcctgtctccgttgtcacaaaaaaatgtttacgttgtttattttccaaggcaaggtaaacaccatggagcaagagacagttgtttccatggtaagctccacccacgatgtctccctttgtatcccccacaatgcccacaatcgttcaggcaaagaataggtgctcactaaatgtgtattgattgaatctaaattgcaattttatccaacaccctcagggaagccaactggaaactaaactcacccccatatattgctgaaacgcattgattaccaagaagccaatgtatgacagccccaacttgtgagacgcgttttttccaaagccacgtaaatcgcgatgtgtgcagcccgttgctcattctgtgtcatgcaccgttgccagccatttgctcttctcgttagctccgtgagggcaggggtcaccgttttcactgctcagcctcctcctgctcggcccagcccagggagacccctcagtccatacctgtgaatgaatgagtgacacttactaagcacagcgagatgaataattcatcattcctatccttcttcccaacttcctgatccaggatggcatagacgtgtgggaggcgcacatgctgggaggggtttgagtcccctgcccgaggttgcagagtgcctggggacgggggtgggggcatgctgggggcatttgcagaaagggcagtaggagagcagtttggagggaggtaaggcaggaagcactcagtcctgggctcagggactgtgacgtgctgctggaacctgcctggggagctcaggaatgaggggagatggcaaataaagacctggcatgaggctgggggcagggacagaaatcaccctggtgtccgaggaaggaaagtggaacgctaaagaggtgagacgaccagggaaagtgaaacaagagagaaagaagggatgtagaattggattattggggtggaaagaggaagccaggtgggggaagagtcagaggaggctcaggcagagggcaggaggggaattgggagaggacagcgagccttcgaaaaaatccggagctggcaccttcaacagaagccatggagcaacccaagaggagcctgggagacagcaacttggtggctgctgaaagacagtttcagctaaggggcaggagtgagagccagccagcactgcagaaggtggggggaaaggcaagcagcctagatggttccttcaagaggtttgtcgataaaaggagcagtcaataggacccaggacagtaagttcatttgttcttttaaacttttcttctctctgcttccttcctcctttcatttcctatcctttttccttccttccttccttcccttttttccttccttctcttttctttttccttccttttcttcccttaccttccccttttccccccctccgctcccgcttctcccctcccccctgaaccttcaggaacccacaccagcatgtgatctcgactcactctttttcccctgccctactgaaagctggctggggacctggagtgtttgcaacgacgcaagatgagaagctgggtcactgaaacattaactcacagaccagggtgggttgcagctgatccaacaggctggacagccgcatcaatgcttcctagaagaggagatgggaggagagagtgagcccaggagcctctgcgtggagaccaaggggccgaggagcacagaaagccccagggctacgcatcttgggtcaaaagtcgctgaaaagatattgatatctacttttctttcttttttttttttttcactgtctttttctggttttagtatcagggtaatattagcttcataaaatgtggtggtaagtgttccttcccctcctattttctgggagagattatgtaaaattattggtcactatagagattatgacatacatacacaacttaccacaagctactggtgttgacactgccactttgagtaagtgtagaaaccttacttccatttagttctctttagcttccccacttaaaaatatatgtgtcttgagtgtgttctttacatatattgaacatcacataagatgctgttacaatttttgcttcaatcatcaaatatgatttcagatactcatgagaagtatagtctgttgtatttatttctatttatgtacttcccatagtttgtttttcttttctggagctccaagcattcttgaaaccaatgagaaaagtggaaaaatctcagtccagaaatagaaggtataatttttaaataaaagcttctgttcagataacattctttacccaatctttaaagatacatttgccaacaataaatgctcttagtttttcttcatccaagaatgttttgctttctccttcatttctgaaggatgttttcaccagatacagtattcacagttgacagttctttttctcagtacttgaaagatgctgagccacttcctctggcctccatcatttcagatgggaaatccactatcattgcaattaatttttcccatgtcataaatgtgttatttctttctgactgctttcaatatgtttttgtctttagtttaactatttaattatgatgtggatttctttacatctagcctgcttggaatccactaaacttcttgaatctgtaggtttatgtctttctccaaatttgagaagtttttaaccactacttctttgaatacttttagtctcactctcttctcctttgggactcagaaggtatggctgttagctcttttcttattgtctcacaggtccctgggactgttatttcttccgtctatttttttttttttttgagacggagtctcgctctgtcgcccaggttggactgcagcggcgtgatctcggctcactgcaagctccgtcttccgggttcatgccattctcctgcctcagcctcccgagtagctgggactacaggcgcccgccaccacgcccggctaaattttttgtatttttagtagaggtgggatttcactgtgttagccaggatcgtctcaatctcctgacctcgtgatctgcctgcctcggcctccgaaagtgctgggattacaggcgtgagccaccgcgcccggcctattttctctctattattctgactgagtgaatgctattggtctgttcttgacttcacaggttcaatctctgtcatctctactctactatcaagcccatctagtgacgtgttttatttatctttttcctggttattgtgtttttcagttccttaattccatttggttcttttttataaccttgatttttattgaaattttctatttttcgtttgtttcaagagaattcataactacatttgaagcatttttgtaatgactgcttttaaatttgtgataatccctctgattcatttgcattttggtgcctgtttgttttttcattcaagttgtaattttccttttccttgacatgataaatgattgtctgctctatcctggacattttaggtattatattatgagagtctggatcctattcaacttttcttttttggcagactgtcttcctgttaagatgtagcgtaacggttgtgtattagtctgttcttgcactgctataaaaaaaatacctgagactgggtaatctataaagaaaagatgtttaattggttcacagttctataggctgtacaggaagcatagcagcttctgcttatggggaggactcaggaagcttccagtaatggtggaaggcaaacagggagtgagatgtctcacatggccagagcaggaggcaatgagaggggtggaggtgccacatattttcaaacaacccaatttcacgagaactcactattgcaacgagaactccaagggggatggtgttaaccattcatggcaaaccacccccatgatcccagcacctctcaccaggccccacctccaacactggagattacaattcaacgtgagatttgggtggggacacaaatccaaaccatatcaggttggatgagttgtatattcaacctcccactgggccccaccagtgctatcgtgacaaaagtgtagcactgatttaccctgcttcattgcaaatgggtggttggcagtgaactcccatctctgccttgatgataccttcccattgaaaatgcatcatcggcttgcactgtcttattgtatccaagctaccctgctaggctctgctgacccagagatgggagaaccagagaactggctcccactgttttgttgtggcagagtggggcagaagctcagctctccactggcccctgctggtaacagggtaagagagaagggaactcttatgcttctttgttgtgtcatgtccagagatttttttttttttagttgtaagatggtggactcaggagaaatggggctactctatcttgtctagagttagaagttcagctttctatctcctctgtttctttacctgtaaaatgggaacaatactacctactctacctacactacagaacaattttcagaattaattaagaagttcatgtgtatgaaagtacactgggaaaatgttatatcatgttatgttagtagactgttatttctgagactagggtctggcaagatgtagcttgagaagagataggataagtggcggggcacctccatattcatctatcaatttaatgttggtgaaaacaaacttgacagccagaagccagccttctattgtttatttccctgtttcttttgagtctgtggtgacctttgtcttgacaagcaataaccctggagaaagctagaggaaaaacaaagattagggtcacagcaaggagagagcaataaagtagctttaaagagcctaagaaaccaggataattgaatatagtaaggattgtggctgggacaaggaggtgtctacaacatcattttcagaaaaacaatcacaaaagaaaaataacactggagctgggagggaaggaactagttggaaagggaacccagaggagaaaggaacagcctctcagaatagtcagcaatgactctgccttacttagaggttatgggacagggctaccaattggagtgacctcagtattaccaatcaggatgacatagatcttgtgcacttttggcccctgtattagtccgcttttgcactgctatgaagaaatacctgagactgggtaatttataaaggaaagaggtttaattgactcatatttccacatggctggggaggcctcaggacacttacaatcatggcagaaggggaagcagacatgtcttacatagcagcaggcaagagagagcgtgcaagagcagggaaaagtgacttataaaaaccatcagatctcatgagaactcactatcatgagaacagcatggaggaaactgcccccatgatccaatcacctccctccctcaacacgtggggattacaagtcccttccttgacaactagtgattacaattcaaggtgagatttgggtggggacacagaaccaaaccatatcagccctcattccaggcaggcaaagggctctggattaagatttgggggaccccttaacccctgtgagcctcaggttttccttctacaagatgaaactggtaaaggtgccaactctgcttggttgtttgagggtcaaatgtggatcacccaacctgttcatggttggcaatcaatatatatagtagttccctgcctgatcacagccccagaaattttggcctctgtctaggctggacgctgactgtgggaggttcctctctaagagcttacgtgctctgccgtcatttcctgtgttttctggcccatagttgggaggggcatgccaaggtgaccatgccctaatttccctttctaaatcgtcttcattgcagtcttctggttcttctttctcttctttgtcccaggggtctccattgaactcactgtagggggtggggactctggaggcctggtcctgggggctgatcctgaggaaggggcattcctaggccagagtgaggtcctggggtgaaccacagaggaagttccatctcccaccccactctccttgtcttgaggaagttgactttaaataaagcccaacacgccccgctaaactgccagctcagaagacagggtctgtgtctgtcctgttcaagggtgtcccaccccacaccccttcccccatactggagtgctgtgctggagtcagctcctgccagctcagaagagtcaattcttacattttcaggaattttgcaaattgcttgttaaacatagccattattagaaattagactggctgggtgcagtggctcatgattgtaatcccggcactttgggaggccaaagcaggagggttgcctgagtccaggagttcaaaaccagcctgggcaacatagggcgacctcatctttactttttaaaataaaaataaataaatacacataaataaatgaaaatacaaattagactgtaaaagcctacaattaaataaattttattgaaaacaaagataatgaatattcaaaacatatcactccttaattattttgctgtttgctctgctctgctcttggggtttgcacctattatatccgcagagtggagattctgtaccatgatgtgctagcaggcatctcttcccaagtctgcatatagtgacaccatgttggcagcttgatattggccatggtgggagtattcacaccacaggaatcagcagacactacaaaccagagcttgccctattgtttggtttgttgtctagatttaaggaagggatggagaaaagtattaatgatgtagattaaacataaaagcatgtcattgttaaagtgtaaacagcacagagaattttaaaactgtttttccagtatttcataactattatcagggcctggcacggtggctcacacctgtaatccaagcactttggaagtccgaggcgggtggatcacaaggtcagaagatctagaccatcctggctaacatggtgaaaccccgtctctactaaaaaatacaaaaaattagccgggcgttgtggtgggtgcctgtagtcccagctactcgagaggctgaggcaggagaatggtgtgaacccaggaggtggaggttgcagtgagcagagatcacgccactgctctccagcctgggcgacagagccagactctgtctcagaaaattaaaaaaaaaaaaaaaaaggattatcagatcagattcagcaaggaagtctattatcatattcagcaaggaagtctctcatgtcatcgacaaaggagtcaagttccagcgtgcacttttgttgttttacctttatcttacttgttaacataaatgaaaatattagccaccgtaatcatggtgagtaatcatggcaggattactctcgtagagccggttgttaaatagttactagcacactattgtctggtgattagaatagtaccttgcttagaagacatgcccagttgtatgagtctgttctctcactgctataaagaaatacctgaggctggataatttataaagaaaagaggtttaattggctcacggttctgcaggctgtccaggaagtacggctggggaggcctcaggaaactcacaatcacagtggaaggtgaacgggaagcaggcatgtcttgggtggctggagcaggaggaggagagaggaggaggtgctacacacttacagacaaccagagggccaggcgcggaagctcatgcctgtaatcccagcactttgggaggccgaggcgggtggatcacctgagctcgggagtccgagaccagcctgaccaacatggtgaaaccctgtctctactaaaaatacaaaattagccggccatggtggtacacacctgtaatcccagctactcgggaggctgaggcgggagaattgcttgaaccaggaggcagaggttgtggtgagccaagactgcgcccctgcactccagcctgggcgacgagcagaactccatctctaacataaaataaaaaataaaataaaataaaaaaacaaccagatctcgtgagaactcactgaacatcatgagaacagcaaggaagaaatccacccccatgatccaatcgcctccaaccaggctcctcttccaacactggggattacgatttgacatgaactttgggcagggccacaaatgcaaaccctgttaccaataagtaccttctgaatgactgaaaccagtgaaaacaagctacaacggacatgtggggccaccccaccccttttgctttagcagcattggccttgcacattttgggtgctgtctgcctccccattcttgctccaggcgcctttgcccgtgttcacttgtgctctggcccagggcttctaagctgtactattcatatgaaacacctgggtgtcttgagacaatgcaggttctggcccaacaggtctatggcggggacaaagattctgcatttctaacaagatcccaggtgacgctggtgcttgtcacggagcacacattgagcagccaggttctagccaccctgccctccttcccatgtgccaagatcagggtctccacgtgaccttcgaacttgccacaacctttacctggggcgctgttctccctggtcttcacatgacctgcttccatgcaacattggggtctctgttcagacatcacccttcaaaaacaaagatcttttcctgactactcatgcaaacgtagctccccatctcagttctctgcataatgttactgatagtttctagttgatgtgtcgtcagctttcctccctagaatgcaggctccacgggagccccccattcccactctggtgactttacaacagcacatgcccaaaaaacaagtgttgaatgatcgtggtggtgatgtcacaaggctaagggtggagagagctggcatgatactggggatggaggcagtgatggaagggggatggttatagctcaaatgcatgtaattttcttttcttttgttttcctttcttttcttttctttccctatttgtcttcttttctctttttttgttttcttttttagagacaagaccttattctgttgcccaggctggatcacaatggcacgatcatggttcactgcagtctctgactcctgagctcaagcaaccctccccactcagtctcctgagtagctaggactacaggtgtaaaccaccatgcttggctaagtttctctttttgttttcagagatggggtctcactatgtcacccaggctggtcttgaactcctggcctcaagtgatcctcctgccttggcctcccaaagtgctgggattacaggtgtgagccaccacccctggcctaagtttttcttaaataatagacacaagaaccctttactcaatcacttttgttcctccacagtcacgacccactaccaagagtgccagccccaggccaggccaggcgtggtggctcatgcctgtaatcccagcactttgggaggccgaggtgggcggatcacgaggtcaggagatcgagaccatcctggctaacatggtgaaaacccatctctagtaaaaatacaaaaaattagccgggcatggtggtgggcgcctgtagtcccagctactcgggaggctgaggcaggaaaatggcgtgaacccgggaggcagagcttgcagtgagccaagattgagccactgcactccagctgggcgacagagcaagactccatctcaaaaaaaaaaagtgcaagtcccacccctccactgtccccattcacttccatgttgtgtgcagaagaaagagtaaaggaccccgaccaaggctctgagtaagggctgcagggtgccagttctcataatggtttctctagagttttgcacaaacaagacgaatggggccacagacaggcagcacccaggggtgcattctggctgggccttgtgcccagggcaggtttctccatcgtgttttatttccagaactaagttgagccatggctggtgctgccttccacgtctgactctgccaagaagtgcctggagcccttgttttcggggaggaagtatctctggtgggttttgaagtttctgtgtgatttctcttaacattaaatcaatactggaagtgtcttttgttatttttctgtttatggagccaatgctttaactaatatcagcagataccacatgctgaatggccctgttgtatgccaggcctacgtttcatctcattcaatcctctcaacagttctagggaacccaatctcatgttatcccattttcgagaggaggcacttgaagctaagagaggttaggtcattggcctgaggtaaaacaacagttggggttagtcagtactgcaggggtcgcaaacacaactgcctagagcagttgtgctttgcaggccagacagtgtctgtgcagctattcagctctgctcatgaagcacaaaagcagccttggaccatctacaaacaaatgagtgtaactgtgttctaataaaactttattaacaaacacaagtgtggggccagattgggcccatgggccatagtttgctgacctctcgcctagagaggccagtagggaaaatcaatgggtaaaacaggccaggagcaaagaataccgaggcgcttccttgttctggcttctcttcttcccagttttgatggaggcaagacaccgtgcaagtgcatgatgcctggctactggcacagtgacgtgtcagcaggtggcaggaggtgagggtggtccccaggtgttccaacaacaaacagtagccacacccaacttcagctgcctgctgctgccagacacacagccaatgtggccagtttttaaaagaagccacaagcctggatttgggagtgtgtgtgtgtgtgtgtgtgtgtgtgtgtgtgtgtgtgcatgcatgtgtatgaaataccacctttctttctatgttggctcaaatcaataaaacaaaaccagaaatcctgtgcaaaccaagtagaagacatccaagcatcgcctctggccctcagaccagcagtttacaacctctgcactccgaaaaccccccagacaacgctgtatttattaagtaataattcatctgtttcccatattttatttatcaaagacctcagtaactgtcaagtagaacttcttatcatcaggaaccgatcggcagacaagtgttacctcccagactgatgatcaatcttggcaaaccgggaaaccctgacattttaattagctggaacattcttatcagccatcaatcctgaacctgccatttcgcattgtttgtgagcccctaattgggaatccctgatttggtttcctcagggccacctcattcacgtgaacatatcctcattactttactgtggcagccacccctagattattcagcacagagccaacaccatcagagcgacagcgaccacctcaaaatgtgctcgccgtgtagcctcctgagttgctgacactaaaaaaggaaaaaatgggcttctgtaggctgcagcaccagcaaaaacaaaaaacaaaaaacaaacaaacaaaagaaacaacaacgacaacaaaaaaaaaaaaacagaaaaaaaaagtttttgtgcacaaaacgacgaacgatgccagactcagcaaggtggtagatgaaacatctcctcttatttggggtcttggtgaagtttcataaccctgtatggggactgtactgtgtaaagacactttcagttactctcaatgcaccgtgaaaccacagataaagatgatactggctgggtgtgatggttcatgcctgtaatcccaacatttttggaggctgtgttaggaggatcgcttgagcccaggagttcagaccagcctggcaacatagtgggaccctggctctactaaaaataattttaaaaattagctgggcgccgggtgaggtggctcattccagtaatcccagtactttgggaggctgaggtgggcagatcacctgaggtcgggagttcgagaccagcctgatctacatggagaaacgccgtctctgctaaaaatacaaaattagctgggcgtggtggtgtatgcctgtaattcaagctactcaagaggctgaggcaggagaatcgcttgaacccgggaagcggaggctgcagtgagccaagactgcaccattgcactctagcctgggtgacaagagtgaaactccatctcaaaaaaaaaaaaaaaaaaattagctggccatggtggcacatgcctgtagtcctagctactggcaaggctgaggaaggaggatcccttgagcccaggaaatggaggctgcagtgagccatgatcatgccactgcaccccagcttgggcaacagagtaagaccctgtctctttaaaacaaaaaaaaaaaaaaaggaaaaggagtaaatgaacaacaataaaccatcggaggtggtttcatacttcttccgaatagcccatgtttagttgatatggacttgtcaccttcctgagcctgctagagggattttctcggtcatagccatttttcgttccagctctacccccttgggagagaaacaacccactgctgcccctgttgtctaagcagccatggtttctatcatgctgtaattgcccaatgagttcttcctgcccactgtacagacgaccaattcactgagaccttgacattgcaataagaaacagtttaatcgacatggggtcagccatgccacatgggagacagagttattactcaaatctatcttccccaaaattcagaggctagagtttttcaaagatagcttgacaggcagggagctagaagaataggtgccacagattagttggggatgcaatcactggggtgtggaaaatggtcctcgtgcactgagtccaattctggatggggccacaggaccggttgagccaagactcgagggtccaggtgggaccatctggtcatcagaaacgcaaaagcctgaaaagacatctcaaaaggccaatcttgggccgggcgtggtggctcatgcctgtaatccccgcactttgggaggccgaggcaggcggatcacctgaggttgggagttcgagaccagcctgtccaacacggagaaaccccatctctactaaaaatacaaaattagctgggtgtggtggcacatgcctgtaatctcagctactcgggaggctgaggtggaagaatcacttgaacccaggaggcggaggttgtggtgagccaagatcgtgccattgcactccagccggggcaacaagagcaaaactctgtctcaaaaaaacaaaaaacaaaacaaaacaaaaaaaagccaatcttaggttctacaatagagaattgaggaagttgcaaatcttgggacctctggaaccatggctggcaattgttttgttttcttttaactcttattttaggttttgggggtacctgtgcaggtttgttacatagataaactcgtgtcatgggggtttgtggtacagattatttcattgctcaggtattaatgctgggtgatgaaaaatagttattttttctgctcctctccctcctcccactctccaccctcaaggtgacaccagtgtctgttgttcctttccttgtgttcatgagttcttatcatttagctcccatttataagcgaaaacgtggtatttggttttctgttcctgcattagcttgctaaggatagtggcttgcataactaagcctatactctagcagaattcaggctcctctcatcctcctaacctggtagactttcattctttttttttttttgagatggagttttgctcttgttgtccaggctagagtgcaatggcacagtcttggctcaccgcaacctccacgtcccgggttcaagagattctcctgcctcagcctcccaggtagctgggattacaggcatgcaccaccatgcctggctagttttgtatttttagtagatatggggtttctccatgttggtcaggctggtcttgaactcccgacctcaggtgatccacccgcctcggcctcccaaagtgctgggattacaggcgtgagccaccgtgtctggccctttcattcattttataaaggcagtttagttttggggaagggctattatttaaactataaactaaatttcccccaaagttagcttggccctaggcccacgaaggaccaagggcagtttgagattaagggcaagttggggatttgttagattagatctctttcactgttataattttctcactgttagaatttttgcaaaggtgatttcagtgcagcctcaccaggcccagccccagaggtgagggcgtgacagtgggcagcctatccaggggtgaccagcaggccgcagtgcagtgtcactggatgagaggggccaggcagagtccctctaatgggaaaaactgaaagaagttggttggaggtgggctccaggtctgccaggccactgagtgtgggccatctgggggccaagttcaaggcaaggttatggatcagcaaaaagtaggaggagacagagtcagggagaagctccaggatggaaggaaagagtcactgatctcctaaaggccctttttttttttttttttttttttgagacggagttttgctcttgttgcccaggctgaagcgcaatagtgtgatctcggctcactgcatcctctgcctcccaggttcaagcgagtctcctgtctcagcctcccgagtagctgggattacaggcgcccgctaccacgcctggctaatttttatatttttagtagagatggggtttcatcatattggtcaggctgatctcaacctcctgacctcaggttatctgcccacctcgacctcccaaagtgctgggattacaggcgtgagccaccgtgcccggccctaaaggcccatttctaacatgctcctccatggagtccctttccttgagcctggctgggtggtgcaggagggcctctgtttcttatgaatcgagaaagccatcaggaacaggcataccccaggcgttccagagaaccacagttcttgggagatctcgggagatcttgcacaaggtcgtcccccaaccttgtcaagtgaaaaagacacttggatgtcataaggagagactatctgaaagggttattacaagggggagggggatggctcttgcaatggagggagggggattatttcaatagggggactgttctgaacataaaatctgcaaaaatacttttcctgttttttctttagagactgggtctcgctttgttgcccaggctggaatgcattgatgtgttcacagctcactgcagcctcaacctcccaagtagctgggactacaggtacacaccaccacgcctggctaatttttaaatgttttgtagagataaggggttgtctcactgtgtttcccaggctggtcttgaactcctggtctcaagtgatcctcccaccttggcctcccaaagtgctgggattatcggcatgagccactgtgcttggtttttcttttgtggggagtaataagaccagaaagacccagtgtgaggaagtgacatgaatgtgtccacatggtaggtcagggtcggttttatcctagggcagccgattcttaagggtctgcgggcttaccccaagggcgggcctgaggaaggaggaagtttcaccaaagtttggttctcaagcatgttgttcccagtgatcagtggagacaagcagttcagctgatcattagtgaggcaaggagtgggaatttggagggtctgtgtctggcctggttgtaagcacacaaggggcacctgtgagcctcatttaagcatctaagtcctgctgttatagtgggtggctagttagatatgagcggcgcgattagagggctccccacaccccagggtgcgcacacacacacacacacacacacacacacacacacacacacacggagtgttgggcgaccatcaggtgatgatcaggcagtttttttgttttgttctttcaagacggagccttgctctgtcgcccaggctggagtgcagtggcatgatctcggctcactgcaatgtccacttcctgggttcaagcaattctcctgcctcagcctccagagtagctgagattacaggcatgtgccaccacacccagctaattttttttttttttttttgagacagggtctcactctgtcgcccaggctggagtgcagtgctgtgatctcggctcactgcaacctctgcctcctgagtccagggattctcctgcctcagcctccccagtagctgggattacaagcacccaccaccgcatcaggctaattcttgtatttttagtagaaacagggtttcactatgttggccaggctggtctcaaacacctggcctcaaatgatccgcccccacctcggcctcccaaagtgctaggattacaggcctgagccaccacgcccggccaggtagttgttaactgttgctgtaaagtaataattggtcacagctggtgccggggaaggcaaggtcctaatagaaaacacctgaaactgatcagcagcttcccagtaagatcccaggagcagggagaagtaacgtaaggttctggaagtgttccaatatgtaaaatccccagtcaaggccaggcactctggctcacgcctgtaatcccagcactttgggaggccgaggcgggcggatcatgaggtcaggagattgagaccatcctggccaacatggtgaaaacccatctctactaaaaatacaaaaaaaaatagccgggcgtagtagcacatgccttagtcccagctactcaggaggctgaggcaggggaatcgcttgaacccgggaggcggaggtggcagtgagccgagatcgtgccattgcactccagcctggtgacagagcaagactccatctcaaaaaaaaaaaaaaaaaaaaaaagagaaaaagaaaaaaattccccagttaagaggccgagctgcatacttggtttctcagggcacctgctggaccctcttccgagtcttactttccttcttttcttgccttcctttcctttctcttctaaagctttgtaatacattttcactcctgctctgaaacttgcctcggtctctccttctaccttatgcccctcagtcgaattctttcttcttcttctttttttttttttttttttttttttgagacagagtcttgctctgacacccaggctggagtgcagtggcatgatctcagcttactgcaacctccgcctgccaggttcaagcaatcgtctgcctcagcctcctgagtaactgagattacaggcaccttccatcatgcctggttaatatttgtatttttagtagagatagggtttcaccatcttggccaggctggtctgaaactcctgacctcctgatccacctgcctcggcctcccaaagtgctgggattacaggagtgagctacctcgcccggccttgagctctttcttctaaggaggtgagaattgaggttgctgagatctgtacggattcgccaccggtaactcagctatgtcacaccagtaacactgcagacaagggagttccttgccatgagccgttttccagaacacaaaaggatgggtggcggggagttcttgtccacgctgcctcccaggagcctggggctcaggtaaaattcaacattgtctatgggcatggtgacccacttgtaatctctgcactttaggaggctgatgggggaggatcacttggagcccagagttcaagaccagcctgggtaacaaagcgagacccccatctctataaaaaatttaaaaattactcaggcatggtggcaagcacctgcggtcctagcttacttgagaggctgaggcagaaggatcacttgagatcaggaggtcaaagctgtaaagagctgtggtcgcgcaactgcactccagcctgggttacagagcaagaccctgtctcaaaaaaaaaagcaaaaaagactgtcacctccaggagtcgctaaaatattccatgccttgtggatattatacaaaaacaaaattagcacatttgccagaagccatctgttgaattctttaggcctgtggtcccagctacttgggaggctgaggtgggaacatagcttgaggccaggagtttcaggctgcagtgagctatgatggcactactgcagtccagcctgggcaacatagtaagacccgatctcaacattttaaaaagtagctaggcatggtggtacacacctgcagtcctggtacttagggggctgaggcaggaggattgcttgagctcaggaggtcaaggctgtggtgagttatgatcgcaccactgcacttcagcctgggcaacagagcaagactctgtctctacaaaaagaggccttccaattgttaaagtgaactaaatatggcctaagaatgactctgtacttctatatctgagtccttgtggacaaactgcaacctagcttaataggcagacaagactgaaaacctaacttaggagtctgcacctgcaacaatagctgagtcttggccaatcccagcagccatagttcaaccactcatacactgctgagtgttcaaactgtgttcaaataaggcaaatgccaacctgtaaccaatctagctgttttgtacctcacttctgatttctgtacatcatttccctttatcgtctataaatcttcttctaccacgtggctgtgctggagtctctgtgaatctgctgtgattctgggggctgcccattcgcgaatcgctcattgttcaattaaactcctttaaatttaattcagctgggccaggcatggtgactcatgcctgtaatccccgcattttgggagaccgaggtgggtggatcactcgaggtcaggagtttgagaccagcctggccaacatagtgaaaccccgtctctactaaaaatacaaaaattagctgtgtggtggtgcgcacctataatcccagctactcagggggctgaggcaggagaatcacttgaacccaggaggcagaggttgcagtgagccaagatcacgccactgtactccagcctgggtgatagagactttgtttaaaaaaaaaaaaaatgaatttggctgaagtctatggagtccttctcaggccatatttagttcaatttaacacagtgataccctggacccatggcctctccccttttcttgacctctcccaaccaaccaacaacagactctgaccctagacaccaggttcttttgaaaaaccccaaatcgcttccattgtgcaagtcagcctgtagacctggtgccgggaactgtgttgccacagttgcagaaaactcaaacctatttccaagtgacaataaagtaatatgtattatccatctttttgtacccattgtaactactgaaagttccataggctcgactgtgtgccggacactgctcaaagcacattatccatatgaatggatttatgggatctaaacaacagcccgtgaaggtagaagggcttatacccattttacagatatgagaactgaggcccagaaaagttgttatgggcccaaggtgacagagctgggatttcaacccaggcagtcttgccccttggctgggatattctttaccccacactccccattctcaaggccatagcgtagcaccaccttgcttcccctaaataattatttcccacttctcggcaggtggtgtggaatcaggatctccatcatgacgttagtgatggcttttgccgtggaggtgagtgggcatgtctgttctctaaaatgctgcagaaagaagcatcagattacctccaacgcactgtgtctagaccagtattgggaacataggtgcttttccttataagaggttttcagagtaaatgaacttgagatttcattaagatagctattgtgtaagaaaactggcctgtctggctggacaggttttgtgttttggggtttttaaagaactacctgttttaaaataagattagtatcaatttggttaccctctctctgcaaagaaatcaccagtctcagaggctcctacatgtgctaggcggaggcattactgtggctgctgcctgcaggcgttgtgacttgggggttcaccctggagataaaacagtgtcagtgtggggtcagttatcccaacagtgaggtctgcctgccgataattgagtcctactgtgtgctgggcactgggttaagcccctcacatacctcgtcgctaactcttacgataatcccagagtgtatcatgattaaaaacttgtgcattggagtggcccagaattgggctaaatccccagtttacacttaatagctgtgtgacctatagtaggttgcagtcccctctgtagacttcagtttcctcatataaaagtgggtatcctaacggcatcagcttaacagggctgttgtgagaataaatgaaatcatgcacgtaaataaagcatgcctataaagcaatgactacataaatgttattctaaaaatagtcatccttatcctcattgtgcacaagaggaaaccgaggttcagagaggtgaaatgacctgcctccaaactgcaaggctagtagctggtggaaatggaatttgcagatccagatttaaattctagcatggaggaaacaattaagcagtgggagtggccaggcacagtggctcatacctgtaatcccagcgctttgggaggccaaggcaggaggatcgcttgagcccaggaatttgagaccagcctgggcaatatagcgagacccccatctctacaaaaaacttaataagttagccaggtgtggtggtgtccacctgtagtccctctactgaggaggctggggctagaggattgcttgaacccagaagttccaggctgcagtgagctatgattgtgttattccagcctgggcaacagagtgagaccgcatcttaaaaaaataagtaggagatagtaacaatggtaacagtgactattattataggctaatggctgcaggcccaggaacctgagctgacccccatcgtgactaacagcctactgcaactgcaagagtcaggctgactgtgataagggattgctgaggaggaagggcttgcaaggtgattatcagaagcagtggcccctcaccttggctttgccctctttatatgcaggtgaagcagagggtaagctaaaccttacctgaagcctcagaattcttctccatttacagacagcgctgctaccccagcctgaaatttaaaaaaaacccagcacacatactcagggaaacacatcaggaatttaaaagatcttccagggatgatgtgagaccccttgattgataaaaataacagtgacagagagaccgtgtggcgtagtggttgggctgggaatccagctctgccactgactggctgtgcaacttcgggcaagtttcttttttttttttttaattttctttttttttttttaattgagatggagtcttgctctgttgcccaggctggagtacagtggcgtgatcttggcttagtgcaacctcggcctcccagattcaagcgattcttctgcctcagcctccagagaagctgggattataggcgcccaccaccacacctggctaatttttgtatttttagtagagacagggtttcaccatgttggccaggctggtctcaaactcctgacccaggtgatccacccgcctcagcctcccaaagtgctgggattatagccatgagccactgcacccggccaactttgggcaagtttcttaaccttcccaagcctcagttcccccatccataaaacggggatgatagtagttcctatgtcagagagttggggtgaggaggaaatgagatgcttgcaaatgcctggcccctaacaaagcccacaataaaatttagctatttgcaaaagtgagtccctcttggctcccagggaggctgaggtaacacttgtcaagggtgggtgggctgattcaggggtactacattcgtgttgtcttgtctgtatggtagaaacatcaagtcccactcctaacctctcagaagaaagtgagtaaatgaagaccctaaagttacaccagagaaaacctgtcaattcccgcaaccttccttttgccctgcaccctttcccatcccccaaagtacacttgacccctctctaaagtggctgaattctacagtactctggggagaaagtcaagttcttagctatgacgttggtcttttttccccgcttttgttaaaagaaaaaatgatgagaaatgttcctttcttgcattcctgcaccatctcctctttctcttcctcaatttcttaggaacgaaatcacccaagatataaataaaatgttctaaataaagctctgcctaactgcagcgtaagacatgtctgtgtacgtttgtgactgtcagccaaaataagttaacctccgatggaagtcattttcatgtaattaattattcttgtcgcagctgaaagagacaggtgcattattggtgtactttggcagaacttctgggtgaacttaagaagtctgcatttcaaacacaccaaacaactggagtgcagctttggcttttgttctgatattgtttcttgacttggaacctttatttctcaattactgcaaactgaaaaaaaaatgaaaacaaaagaacagacatcaaaggcattctgaagtacaggaggtacgtgatgtgccaattaagcaacaggaatgccgtctattctgcaacagctgatgttttcattctcccactcagaaaaggggtttaggttgtttggggttttacagaaaagccacttgtgatcgggtaagtctgttattagcaagagttttctttgtgtcatggaggtcaaagtcctggcatgttaacatttttgaacaagaaagaaacatagcaggatgaaagagagactggccaggtgaatttgcagcttgttgaatgaaactgttcaaatacggactattacggagttgagggtctctagcggaatgccttagggctctttccttagccttctgaaactatttgaggctgaccaaagggggaaatgccaggaagctgaaggaacagtaactgctgggtgacagaattagatcaacccactccaaagactagtatgatgggcctattgaaccagctgttttccaaaataaatgttttagaaaatagctgttttccgttactttcaatggcaaaaactgcaattacttttgtaccaacctaataaattcttgccaaaacaaacaaaaaagcccaaaaccgaaacctacagcatatgaagagttaacttgaaagctaccttacaatcttaccctttctaagacatttggtgttaattgctcttataagcagtatggaattatattttaaatccaatttgatatttaacaggtgagtttgaccgaatcgcatttattgtaattgctgttatattgggatttaattctatcatcttattttgtatttttctattgctatgtttgtctccctctctttttttttctatgaattgatgaaatttttttattctcatttttttcttctactgttttggaaatgacagcttatctttctgttctttcatcagtacctgtacatttttttaaaatgggtagtttgtggccctaagaaggataagacatcagtttgaaaagagaccctatcagagtagcatgaattctgctaaaattgaagcaggaacaaacatcaagtttatgatgaactttgggtgaaagaatggtgaaatcattgatactttataaaaagtttatggcaacaatgccacaaggaaatcagaagtttacaaatgaataagttgttttaagaagggataagatgatgttgaagataaagcttgtaccagcagaccacctacatcagtttaccagaaaaaaattaatcttgttgatgccctcattgaaaaggaccaaagagtaacagcagaaacaatagcccacaccttagatatctcacttggttccgcttacacaattctgactgaggaatcaaagttgatcaaactttccacttcatggataccaaactgttgcacccagataagctacggacaaggacagagtttcagtggaaattttgagcaagtgggatcaagatcctgaagcatgtcttcaaagaagatgaaacatggcttcaccggtaaaatcctgaagacaaagcacagtcaaagcaatggctaccaagagggggaagtggtcctgtccaagcaaaaggaagagtgaaccactcataagcaaaggtcatggcaccagctttttgggatgctgaaggcattttgcttgttgactttctgcagggctagattacaacagcgtctgcttattgtgagggtgttttgacaaagttagccaaactttagcaaaaaagctctcaggaaagctttatcagaaagtccgtctccaccacgacattgcttctgctcattcctctcatcaaacaagagcaatcttgtgagagttttgatggaaaattactaggcatccaccttacagtcctgatttggctcattctgacttctttttgtttcctaatctaaaaatcttgaaagggtacccattttttttttcagttaataatattaaatatactgcattgacatgggtaaattcccaggatcctcagttctttaggaatggactacatatcatcacctacaaacacgtctttaactggatggagcttgtgttgagaaataacgtttacatttcttatttttatcttttaatttctttttcccataaagtttttgaagttccttcatatttttattttgtgctcacactggagcaataacttatctgggtataggattctagattgacagttgttatttctccacagttttgtgttttctggcaactaatgatgagctgtctgcctaattgtctttgctttgtaagtaatcaatatattctccctggcagctctgaacctcttcctgtctatccctagtaatctgtagtttcactaacattgtctatgtgtgagtttatttgtatttatgttgcttggcacaagatgcaaaatttctaactaaggacttcatatgttttcacaaaaataaacttgagcagataaaaagacaacccttgttcttggacaagatgactcaataccatatagatgtcaattctcctcaagttactatgtacatttaatataatccataaaggccaggcacagtggctcacgcctgtaatcccaacactttgggaggccgaggtaggcggatcacttgaggtcaggagtttgagaccggcctagccaacatggtgaaaccccgtctctactaaaagtacaaaaattagccaggcatggtcgtgggtgcctacaattccaggtacttaggaggctgaggcaggaaaattgcttgaatccaggaggcagaggttgcagtgagctgagatcacaccattgccctccagcctgggcaacaagagcgagactctgtctcaaaaaaaaaaaaaaaaaaatccataaaaataccaagttttttttactggagttagacaagttggtttgaatgttcaaatggaaaaataaacatgcaaaaatagaaaaccatttaaaaagggcaataaagattgactagccttccagatagtaaaatatattacatagcctctatactaagagtgtagtcctagtacataaatagaaagaccaatggaacaaaatagaaaatccagaaataggcacaaggacatatgagaatttagtatgtgataaaagtgacatctcaaatcactggggaaaagatagattttttaaataaatgattttgtaatacagatttgaaaaaaagataaaatcaaattcattgctccaactgtaaactagagtaaattcaaagtagattaaaagtttaaatgtaaataataaaactacacggctgctttttaaattatggatgaattcatttgtaatctggatatgcagaaatctgttttaactatgatgaaaaatccagatgcaataatttaaaaccttgataaattctattgcgtgaaaaatacaccatgttcatggtttaaaacattaatgtgagcaaagtaaaatcaaaggaataagaaatgagaaactgtggaacataattacaacctatactacagataaggagctgaaaaccttaatacgtaaaaaacatttatttatttattacttatttatttacttatttatttatcaagacaggatctcactctctcacccaggctgaagcgcagtggtgcaatcatggctcactgcagcctcgacctccctgtgctcaggtgattctcccacctcagcctccaaagtagctgggactacaggtgtgtaccactatccccagctaatttttttgtattttttgtagacagacttttggcattgatatggtttggatctgtgtccccgcccaaatgtcatgtcaaattggaattcccggtgttggagatggggcctggggggaggtgattaaatcgtggttgcaaatttccccttcggtgctgttcttgcaatagtgagtgagttattgcaagatctggttgtttaaaagtgcgtggtacctccccgatctctctcttcctcctgctccagccatgtatgaaatgcctacttctacctaaccttctgccacgattgtaagtttcctgaggcctccccagctatgcttcctgttacagtgtcaaccacgaaccaattaaacctattttctttataaattactcagtctcaggtatttctttatagcagtgcgagaatggactaatacagccatcttgcctaggctagtatcaaactcctgggctcaagcaatctgcccacctcagcctcccaaactgctaggattatatgtgtgagccactatgccctggccataaaaagctttttaaaatggagggataaaaggccacagacaattaaaaaatgagcaaaagacataaacatctagtttataaaaatcaatatacaattatccttttagacattaaaaagatgtcaactttactcttaagggaaatagaaattaaaactagtttacactgtagtacaatttcttacctttcattttggcaaaaattcaaaaccttgatattttgttggggggaatgctgtttaagcccttgtgcacgttgctggtgggggtgcaaaatgtataaaccctatagcagggaatctggcaatagccaaccaactataaaaccttttctctttgattcatcaatcccacttttaggaattcaccctgaagatacacctccacaatacgaagcaaaatatgaataagccagctgtcacacccttatttctaatagcaaaatactggaaacaacctaaacgcctattcataggcgaaagattgaataaattatgatgaatacacacaatagaatactatgcaaaaacaatgaggaatctctaagaactctgctgaaatgatttccaggatccattgttaagtgaagaaagcaaaatgtaaaagagtattataatatgctagactctgtgtgtgtgtgtgtgtgtatgtgtatatttatttgatttttcttctgaaatggaacacaggaaagataaagcagaaattaatgaagacaattatccatgaggtttaagggactggagtggaagtgataggaatagaaatgagactcctctgagtacaatttttatagttgggttaatatctaccatatttataactgttttctattcacagccctgctcttttttcttaatttctttctatctttttcttttcttttctttttggcattcccttctttttatatcttctctggttttaagtgagcattttatatgattcaattttctcttacagcatttcaattatatttcttttaagaactattttagtgtttgcagcatacatttacaactaattcaagaccactttcaaataatattatactgtttcataggtagtgcaggtaccttaaaacggagtactcccaatttcttgttcacaacctttgtaatattgttgtcatacatttcatttatatccataagttataatcatccaatacaatattgctgttgtttttaacaaagttatatattagatcaattaagaataagacaaataaatgattttttattttatctttatttgtttgttttctaatgctcattctttcttcacgtagatctgaatttctgacctgtattactttccttctctctgaagaacttatttttagatttcttataaagtaggtctactgatgacaaattccatcagtttttgtttttctgagaaagaaggtcttcttcacttttaaaggttaattttgctggatagagaattactgattggtgtattgttttttcttattttactccactctcattttgcttgtatagtttctaaagggaagtctgacataattcttatccttgtttcccttcaggtaaggtgttttcttcctctgacttctttcaagctgttctctttgttttctagtttaaatatgacatgcttaaaggttttttatttgtttattttgttgttgtagttatttgtcctccctgatattctctgaagttactgaaactgtggtttagtgtctctcgttaattttggagaactctcatgcattcatatttcaaatgttttgtctattcctttctatgtttactctccttctggtaatcccattacatgtatttacaccttttgtaattgacccatcattcttgaacattctgctctttttttttttcattctcctgttttctcttcacattccagtttgggaaatttctcttgacattttttcaagcttgctgattattttcatagccaaatccagtttactgatgaacccattaaaaaattatttctttctgacacaatgtttttaatttctagcatttcttttagattctatattagcatgttcctatctctgtttccaattaccatgtgttgttgcctgtcgttcgcttttttccattaaatcctttagcatactaattgtagttatattaaatgcccagcttgacgatttcaatgtctatgagtctggttctgatgcttgctttgtctcttcagactgtgttttattgtgctttttagcatgcctgcaattttttgttgaaagtcaaataagatgtattaggtaataggaactgaggtaaataggcctttaatttgaggttttatgcttatctggatgggagttaggctgtgtttaatgtttgctatagctgtagctataggtgtcagaggcttccttgtttttttctctcctgttgtctttgtgtttccctagaaagattatttttaaatagagtctgtgtcttgaagctgtatcagttgtaatccattattattatcctggaaccctgttgatgttgtggtaagatactgaggagggaagacagtctataatcttatgattaaatcttagagtttttttttttttaaagcaaaacactgctgaaagaaataatagataacacaaacaaatggaaacacatcccatgctcatggatgggaagaatcaatattgtgaaaatgaccatactacccaaagcaatctacagaatcaatgcggttcccatcaaaataccatcatcatttttcacagaactggaaaaaacaatcccaaaattcatatggaacaaaaaacaagaccacatagccaaataaattctaagcaaaaagaacaaatccggaggcatcacattaccaggattcaaattatactacaaggctatagttaccaaaacagcatggtagtggtataaaaataggcactcagacaaaaggaacaggttagagaattcataaataaagccaaatgcttacagggaactgatcttcaacaaagcatacaaaaacataaattggggaaaggacactacctattcaataaatgctgctgggaaaattggcaagccacatgtagaagaatgaaaatggatccccatctattaccttacacaaaaatcaactcagaatggatgaaagactgaaatataaggcctgaaaccataacaactctagaagataacactggaaaaagtcttttggacattggtctaggcaaagaattcatgactgagccccaaaagcaaatgcaactaaaacaaacaaacaaaaacaaataaatggaacataatgaagctaaaaaatcttctgcacagcaaaagctatagtcagcacaacagataacccacagagtaagagagaatattcacaaacatgaatttaacaaaggactagtatttagaatctacaaagtacttgaacaattcagcaagaaaaaacaaataatcccatcaaaaagtgggtaaatgtcatgaatagacatttctcaaaagaagatatgcaaacagccaacaaacatatgagaaaatgctcagcatcactaatcatcaggaaaatgaaaattaaaaccacagtgagataccaccttactcttacaagaatggccataattaaaaagtcaaaaaccaatagatgttgtcatgaatgtggtgaaaagggaacaattttacactgcaggtggtcatgtaaattagtacaaccactgtggaaaacagtatggagattccttaaagaactaaatgtagatctaccattcaatccagcaatcccactgggtatctactcaaaggagaagaagtcactataagaaaaagacacaagcacacacatgtttatagcagcacattcacaattgcaaagatatgaaaccaatctaagtgcccactgatcaatgagtggataaagaaaatgtggtacatatacaccatggaatattagccataaagaggaatgaaataatgtcttttgcagcaatttgggtagagctagaggccattattctaaatgaagcaacccagaaatggaaaaccgtatttcatattctcacttataaatgggagctaagttatgaggatgcaaagacatacagagtcacataatagaccttggtcgggggagaggttgggaggagaggtgaatgatgaaagactacatattgggtacagcgtacactgcttgagtgacaggtgcactaaaatatcagaagctgccactatagaactcatccatgtaataaaaaaccacctgtatcccaaaaactaaaaacattgaaataaaaaaataataattaaaaaaatcagagttgtttttttttttttttttttttttttttagtgagcctgaggccctgtgctgtgaccttcagaagagcctctcaggcttttttttttttttttctctgcttatgtaggcagggagctagagttggctgcaggtatctaattgcccctgcctagattccagaacagattctggaagttttccttgagagtaggactttgttgctgagaatagaatactctgggtatgtatatatataaagtgctgggattacagacatgagccaccatgcctagcctgggtatatttttaaataattactttttgcttcctcctgcctgaagaaagagatgtttctcctgtcttcgctgggagaacctggggagtctcctggatgtaaaacccataaaagtataggggttcctaagactgggaccccaggagtttgtaactccccagttataccatgttcagtgtgcatcaattactcaattacattttaagcgttcctaccagttactggctccagaagcttctgctccccataggctgtgatttatcatattcacctgtgtttccaaatgccaaagcagcattctgaggcgtgaccttaattctattacagatctaagaagagttgttgattttcagttttttcagctttttttcttgttgtaaggatggaggtgaaaacttccaggctctttatgtgtcagagctaaaactgaaagtctgtttcctgtttttcatttctgttttcttattcctgccttcttgtggttacttggtcatttaaaaaatttcattttgatttatttatagtgcttttcaatgtatctttatagatttattagttattgttctaggtattatattgtacatacataacatttcagtctactggtgtcgatattttagaagatcaagtgaaatgtagaaagcttacttctcagctgggcatggtggttcatgcctgtaatcccagcactttgggaggacaagacaggcagatcacttgaggccagtgttttgagaccagcccggccaacatggcaaaaccctgtttctactaaaaaatacaaaaattagccaggcatggtggcacacacctgtaatcccagctacttgggaagctgaagcacaagaatcacttgaacctgagaggtggaggttgcagcgagccaagatcaccccactacactccagcctgggtgacagagcaaggccctgtctcaaaaaaaaaaaaaaaaaaaaagaagaagaagaagaagaaatcttacttctctttttgtccctttatcctcctccttttatgatataattgtgtctacatacattgagaatcacatcagagttataatttttgtttcaaccatcaaatataatttagaaaactcaagaagagaagaagtctattgtgttctttcttctttcctgatgttccaagatttcttattttatcatttagggaaattccactggccatttttttagcataggtctactgctgacaaattctcttagcttctcttcattcaaaaatgtcttgatttccccttcatttctgaaagatatttttgctggatacagaattgtagatggataggtttgttttttatttcagtgctttaaaatgtgccacttccttccggcctctgatgagaaatccattgttagatgaattgtttctcttttgtaggtaaggtctaatttctctcttactgctgtcaagatatttactattttctttttaaaccaaagagtttttatcaacttgactatggtatggattgctttcagtttatcctatttggggtttacttagcttctgaaatctgcaaatttatgtcttttgtcaaatttgaggatttttcagccattattcctgtgaacattttttagccccacccactgtctcctctccttcttggactccaatgacataaatgttagatcttttgtagtagttctacagagttttaaagctctgtcctttttttcttctcttttcttcagcgtattttctctgttgctcagattgggtaatttctattgttgtatcttcacatttactaattctttcctctgtcttctccattctgctgttaagcccatccattcaggtttaattttggtggttgtattagtttgttctcacactgctaataaagacatactctaggtaatttataaaggaaagagatttaattgactcacagttcagcatggctggggaagcctcaggaaacttacaatcatggcagaaggggaagcaatcatgtccttcttcacatggcagcagcaagaagtgcagagtggaagggggagaagccacttataaaactatcagatctcatgagagcttactcactattacgagaacagcataagggtatctgccccatgattaaattacctctcaccgggtgcctcccacaatgtgtggggattacgggaactacaattcaagatgagatttgggtggggacacagccaaaccatatcagtggttgaattttccagctttaaaatttccgtttgattctttgcttatgccttctatttcagtgctgagactttctgcatttgcctgcatttcaagtgtgttcatcactgcttgttgaagcattttataacgtgtgtgttaaaatcgttgtcagataattctaacatctgtgtcatctcaatgctgacatctgtcttcgtttgctagggctgctgtaacaattaccacaaactggtagacataaaacaacagaaatttattgtctcagtgttctagaggccaggagcctatgatcagggtgtcggcagagttggttccttctggaggccctgaggaagaaaccgtcccttccagctttcctaacttctggtggctgctggcatctgtggcttgtaaatgcatcactccagtctcagcttccatcttcacgtggccttcttctctgtctcttcttcttatagagacactattgattgaatttaggatccaccctaaatccagggtgatttcaccttgagatccttaactaattatatctgccaataccttgtttccaagtaaaataacatgctgaggttccagcggacgtgaattttgggaggatgctatttaacccactctagtgtctgtcaatgctcttttctcattcaagtggctatttttctggttcttgaaacgatgagttatatttgattgaaaatggacatttgggatattatgagactctggattttatttaagtcttctgttttaagtagacctttgctgacacttatttagctaacaaaggggatgctcccttgttacttccaggtggggttttcccaagtggcctccaaggacaccagagggacaggtgctcttcattgctgctggctgagggtgtggcctcagcttctccaccaggcctctgttgacaacaaactggctgacaggcacatggggacttccttactccctttcatgcgatgtccactttcatggcatgaaggtggctttgaaccactggatggtggtgaatatttcgatttttccacttgtctcttctgataccagcgcagcagtggggtggacgggcacgtcatcctaccaggcatgagtggaagtccaagctccccacatggtctccaatgacactgctgagttgggctttattaccactaggctggagtgcaagttctggcttcgcactcagcctttgctggtgggagcgtgagtggggccatgcttgtttctgtggtgcttttctggtgtggagtggttactgtctaaaattctttcatcttgccaggctgcctctttcccgatcctccggcaagaaaaagcggattttccttggcgctttggtttacctttgtctttgcctgttggtgtttccagcttgccatgttttcccacacccaatccgggatatgagacacaaaaggaaaacttaaagaactcactactttgtcatttcttggttctgaggtccctagaacgtctgccttcttctctccatctctcagtgtctttctgtttgttttatacagaacgtccagggcttttagggaaagtacatctatgtcatcttcccatacgtggaagttcctatttctaggattttaaatttaaaaaaaaaatctttctttttaattcactcttacctgccaagcttttgttcattatcttggtctcattctatgggtgttattttctcctttatctctgaggattatacttacacctacttaaagtccttctttcgttttttttggtgtgtgtgtgtgtgtgtgtgtgtgtgtgtgtttgagacagagtctcgctctgttgctcgcgctggagtgcagtggcgcaatctcagctcacagcagcctccgcctcctgggttccaacaattctcctgcctcagccacccgggtagctgagattacaggcatgcgccactacacctagctaacttttgtatttgtagtagagatgagctttcgccatgttagccaggctggtctcgaactcctgacctcaggtgatccgcccacctcagcctcccaaagtgttgggattacaggtgtgagccactgcacctggccctatttaaagtccttttatggctgctctaacatttgcatgtccttggtagccatgagtttgttgatcatcttctacaaggtgtgctttggattttagtttgagagcttatcttgaatagaagttgtgtgtgtgtgtgtatgtgtgtatatgcatatgtgtgtgtgtacatatgtctgtatatgcatatgtgtatgtgtacatgtgtgtgtgtacgtgtgtgtttatatgcatatgtgtgtgggtgtacgtgtgtgtgtgcatgtgtgtgtgtgtgtgtgtgcatgtacatgcatgtgcgtccccttcctaggatcactcctctctgaccagcagtttttcagttgtctccatctagctcactggattcctgagtaactaggccttatattggaggcttaggctttttgtcccaagggacaggggtagggtatgatttggccccagctcagctcattcctgctgccttaggaaactgccctgggccactgctgcaatgttctatttatgggtggaaacagtttccccagactggactcaatcctggattatatggagacaattctgtcccccactaccttgcaggatttaactctcaaagaatctgcatatttttaaagaacagttaagtcttataatatgtttttatattttattcattatttctatgattttggagatggaatgaggaaagttttgtgtgaactcatgatgccatttttatgggaagtaaccttctcttcccacccaccgctttgaacgtgaagctcagtttcagggagcctggatggctttggtgttttggtgactatcttaattagcttgtatgcaggcatttgctcaataactatattaagtctggataatgatagcaatccatttggaaggtaatttactgataactttagatttttcaatcaaaaaccttaaattgcaaaattacatattttgggcatgtattaggtaacaaaagtaaagaggcaacaaagaatctttgaacaacattgaacttcctgctctgaggcagaattatagtatttttgtaaaatcacaaagagaataagaggatgtgatttttttttctctctctctctcttaaaggcaattttgtttctccagcataaagtcgggtctgtaatccctggagccacgcagggttcctgctacctgtttgtcctgattgttctcattcagtccaggtgatcagccaagatatgttttgatgaaaatagcaattttgctcacccccaacccacttgcttttgtgtcccccgtcactacctcaatttggccgtaattgtaccgctcccataacaacagccaaataactggatatttgtggagggcttataacagggttgtccacaaagccactggcaacgccaaacagaccctgtatatcagcatctcacaagagagacagctatccgggggagcaattcttggcagctcccaatcaaacttgcagctgactgctgattacctctgcgtttccaatctgaggcacagcaccccatatttctcccacatttcctccgttacactcagtctcaggaccatcattccctcatggcctgcctgggacattaaaacaatgcacacacagaggaaaacacacaacaaaaactctttctctgcattgagagcaccaaattgcagcaaagatcagggaaccacgcggtctcagggctgtgcttcaggttgtgtgctagctatcagcaccaagaatcaaaacatctttatgggtatggatacagattccctttttgctgagccactgtgtgattttggggagcacgttcgctgatcagggttatgagagctggatggagaggaagtcgcctttgttccggcctgcacgtcatgtcaagcgaagttagatatttccctaccgacagctattttgatctctcagtactaaagagaaccgctgcaggtaaccctgaagttgaatcccacattctgtctgagtttaggactaggactttgcaaattgacagctcacatacttttgctggtgtgcggccaacacagagatgggcttcagtcaaattcgggagagggagggagggcaatggagggggagggagcggcaggggtggcaagaggagaaggcaagaggagaaggcaggagcaagggatggtgcctcctgcccgtcttcaaacgcagactcacagggtttggaggtggccgcagtgtcacacctggagctacagatgtaacagccatcagagggaactgcaagcacagagcccagtcctcccacccctgcccctgaagaaagaggtggtggacaaccacctctggtgtctctggcacccaggtgggctgggcagtggggtacctgacacctggcagcaaggtgggccctaaggcctgcaggcctcaggttggccccttagaaatgggtgtcaaagggctgggtgtggtggctcacgcctgtaatcccagcactttgggaggccaaggtaggcagatcacgaggtcaggagatcaagaccatcctggctaacacggtgaaaccccatctctactaaaaatacaaaagcaaaattagccaggcttggtggcgggcacctgtagtccaagctactcgggaggctgaggcaggagaatggcgtgaacccgggaggcggagcttacagtgagccgagatccaccactgtgctccagcctgggcaacagagtgagactccgtctgaaaacaaaaaaaaaaaaaaaaaaaaagaaagaaatgggtgtcaaatgtgtccctttggatgaaaattaagtttttaacctaaacagggataacgtcaatgtttcacatttgtaggaactactgccgtttccaagcaattgctttgttttactaatgatttgatcaactccatgcttttggctatatgtttgctgtctgattgtgccaagtgtggaccccaggccagcagctttggtgtcctccagagcttgggatagatttggactccaaggccctccccagccatcctgaatcagaacttgcgttttaataagatgcccgggagatccgtggcagggatgaatcatttccctgtaagatgtgctttggaattttagtttaaaagctcatcttgaataagtgtgtgtgtgaagctagaggggtaggctgggccttgtgcactatgatagtttggctttcatttttcaaagcactggaaagctattgaagagttttacacaggcttgatgacatgatcagacttggaagtaatctctctgtctgcagtggagcaattggactggaagggatcagcatgggtgcagccagaagtcatgaggctactttaggtgaaatgggggtagcttgaacaaatgtcatggttgtggtagcggtggtaatggtagtagtgatggtggtggtagtggtgatggtgatgatgatggtggaggtggtggtgggttgattgtggaagagtggtgatactggtatggtggtgatggtgatggttatggtggtgattgtggtaatggtggtggagatgatggtggtaggggtgatggtactcgtggtaatgatggtgatgatggtggtaatggtagcgatggtgatagtagtaattgtggtggtaacggtggttgtggtagtgttggtggttgtggtagtgatggtggtgatggtgataatgatggtggtggtaatggtagtagtgatggtgatgataatggtggtaatagtggtggtgatgatggatagtggtgatggtgattgcggtggtagtgatgttggtggtgttgatggtaatgggagagatggtggcaatggaaagaagtagaaatttacacaatacttaaaaggtaaagtcaacaaaaattagtgattattggaaatggaagatgaagaaaaggttaagtcaaatttattttgtaaaaagcttagtgctgtcttaagttgctcttggttagttgaacatgcacatttgttcatcttctttctatagacagtttaatactgtgcctcaaacagtcacattcagtctccaaaccaccaccaccagcacactacaagtgttcttagctgctgtggtggattaaagatgactgctcattctttgacaatccttccatcaagagatggggtctattttcctttccctttaatctgggctggcctatcactgctttggcaaatcacttatgggagaagtgatgtgtagaacttctgaagctaggacataagaagctgtccagcttctgcttgggtctcttggagcactctctctggaagccctgagctaccatgaaagatatctgaccaccctgacaccatcaagcttgaggggccccatgtaggtgttcttttcaatagtcctcatctttcagctggactcaccaaagccccagataagtgagaaaccccttcttggaacctctgtattggttcatctgggagctgagtaaaactgagtggcttcagtcaaagccacatggagcagaagaatcacccagctgagccctgttcaaatcaagcccactgtattgtgagatagaataaatggatgttgttgaaagctgctaagttaaagggtaatttgttaggcagcagtgactggaacacctgcttttccatatgtgacaacagaattagagtaataactcctattcttccttaccaagcctattcttcacccactctgaccagtagcatagcatgcataaacaagggtgtattctgggatgtgaaacagaaccattttagctattagatgatgcagatagagaaaaacaatacccagtgagtgacttagtgggtgaggcctctcttccctaccccacccctacccctggcatcttgttcccagcctgaggagttgagactgctatagtggatgatccaactaacagcctggtccctggggggtgccatgatccattgccttgtaactgggggtatttaaattactcaattggaacagttctccccatggaggagattaaattccaagtaacagaagtgaggggtgcatgagaagtgagaggacaaaaatctgtcaacagtgctattcctcaccaaacctctgctcattgaaacaatggctcctcagtgattctcagactgcaaaagcatatccaactttagaggtgcgcaaaatgagggaaataaattgatgactgcacctggtaactcttaaaacctctgtatggtccagctatgttattcttgttaacattttcattgtaaaatggcatttcttcccaggataaaagctcactgaaacgatgccttcctgggagcatatgtacgaacgtcacactctgccaattttatatctgattaaaacctcaatacatcaaaacatcctttgaaataattaagagcatttctccattaggggcacgaagctaaatgtgtccaaatatatctgaaatcagcagatggaactaagggaattaatagagtagtacgacattttgcaatcatctaaaagaaaacagaatttggcttgcaaaggatatactttttcatttggggtaaaatgaaaaggatatactttttcatttggggtaaaataaggtgcattttccactcgcactaagcaccccattcgtacatgaatgtacatgtaatacatgaagtacaatttatctccaggttgttgaagggaaagccatcattttcaggggttctgctgctccctgggaagggagcctccaagacagttttgatccattgatgagtgctgtctaatgtgctccctgaggtacagtttccctaaatctgttagacttttacagtcgtccaggatctgcagtctggagatgctccatcatactgtattaacttgacaacgtaatgtactgctatcttttattttcataggaagtactaggtttgaccttgaaactcttaaccacactttataatcctcagcccatcctggcaaaaaagaggccatcctaacaaatccatcctggctagacttgagtctgtaaaacgttggattggaatgcataggactaggggaggtgggagagtaagtaagggtcttgacagctctgtctcaatcttcaggggcaaatgaagtgggggaattgaggagacatgagttacgttaccagctacagttcactgagctcttaccacgtgccgagcactgtgctttacgtgggttattctagtcacttctcatgaggctgacattgttcttgcttcatatatgagggtattaatcctttttcatgctgctggtgaagacatacccaagactggtaatttataaagaaaaagaggtttaatggactcacagttccatgtggctggggaggcctcacaatcatggtggaaggtggaaagcacgtcttacatagtggcaggcaagagagaatgagaggcaagtgaaaggggtttccctttataaaaccaccagatcctgtgagacttattcactaccatgagaacagtattggagaaaccacccccacgattcatttatctcccaccaggtccctcccacaacatgggggaattatgggagctacaattcaagatgagatttgggtggggacacagccaaaccatatcaatgaggaaactgaggctcagagaggttaagcaacttacccaaggtcacccagctagtaaatggcagagcccggattcaaactcaggtctttttgactcaaaagccaaagctcttaagcatgattctatgatgactcattctgcagtgaaatctctgctcttgagaataggaagtgggcttggactgcacttgactgacttggtgccttcatgggacatggttcagtcattcctttcacttgccatcagcccatagctggacatttccttcctgggtccttcttgaggagcacagagtccttccctggggctgggagttatatgtcaggtcttctttcctgctctagagacaccccatgtgcccccagagtgggaaattaaaagggcctgaaatggtaccttcatgcaagtcacctggatgctgagcctactcagagggcttccctgtgtgtttccctgggccatttggtctatactcaagcactaggggacgtctgaaaggccctgacctctgcagagagcagtgtctttgggtggttgtatggagaccccagagaccaagcagaaggtgaacagtcacccacccgatggtagacatgggcactggcttgggggattattgtacagatccatggtgggtgctcccaaatttgcttcttcctgcaaaccataaaggcttttaattattaaagaatgattcttgaggctggccaatttatcagcctctggcaagaataaagagtcaaccagccatgaatcctatctgattactaataagaacgacataaaatgacacaagtgctgagaaatgctctcggttgggctccagccaaggcagacctggatcaaatgagcccaggttaaaccagctcccactttccccggttgccgagtggatgcggaacgttctgttccgaagggcagatgcttacatgctcctagcagcagaggaaagtaggcaaagctggtttctggcatgggccacatggctcttccctcccaggagcgttctcacttcctccaccaacgaggctcccccgcagctgcctctgtgcatctctttgccccaggcctgggccccggcattctgcaaggggaacttggagccaggacggctgggtttaaatcacatcataaacagcccctcacgtgtccatccacagatgaatggaaaaacaaaatgtggcatatacatataatagactattattcatctataaagaggtataaagcgctgatacgtgctacaacatggatgaaacttgaaaacatgctcagtgtggccaggcacagtggctcacgcctgtaattccagcactttgggaggccgagaggtgggaggatcagttgaaaccaggagttcgagaccagcctggcaacatagcgagaccctgcctctacaaaaagtttttaaaaaaaattagttaggtgcggtggtgtgtgcctgtggtcccagttactcaggaggctgaagtgggaggatcgctggagcccaggaggttgaggctggactgagctatgattgtgccattgcactccagcctgggtgacagagcaagaccttgtctcctaaaaaaaaaaaaaaaaaaaaaaaagagagagagagagaaaacatgctaaggccgggcacagtggctcacacctgtaatcccagcactttgggaggccgaggcgggtggatcatgaggtcagaatttcaagaccagcttggccaagatggtgaaaccccgtatctactaaaaatacaaaaattagccaggcatgatggcagacatctgtaatcccagctacttgggaggctgaggcagggaattgtgtgaacctgggaggcggaggttgcagtgagccaagatcgccccactgcactccagcctgggcaacagagggagactccatctcaaaaaaaaaaaaaaaaagaaagaaaaaaaggaaaaaaagaaagaaagaaagaaaagaaaatatgctaagtgaaagaagccagacacaaaaggccacatcgtgtgcaattcctgttatatgaaatgtccagaatgggcaaatccgtgaagacagaaagcagattggtgattgtcagggggcgggggtggggcgaaaggaggaacgactgatgaaggggtaggagtttctctttggggtgacgaaaatgctttggtgctagatagaggcgtggcacaacatcatggatgtactaactgccactgaatggttcactttaaaatggtgaattgaatgttatgtgaatttcactccaataaaaaacagaaacaagtcacatcagggtgctccttcaacaagcacttcctggggaaaagccttgagacccacgagcggtgagccctaaggcaggctgggatctgggagcgccgtcgtgtcctgggagaagttcagtcccagcgggctccaccacccacacccgctccttcctcctttgaacgcagaggctctggcgacggtggcaggagccacgcagagcggtggagcttccagcgtggagaggggcactacaaggacctgcctccatgcagctgctgaatccacgcccgttgcttggtgtcaccacctcctaagtttttgttattgagaagaatagattcgtatttgttgaaggcacactgagaacaagtcaacagaagcagtcatctgcgagagcttgctgtgggccccgtgggagactcgcaatatggtgggagacggatttagaaacaaacagtgatgatttttgtgcattaagtgcaacgcgagagctggaatcaggctgggcccggtggctcacgcctgtaattccagcactttgggaagccaaggcaggcagatcacttgaggtcaggagttcgagaccagcctggtgaacatggggaaaccctgtctctacttaaaatataaaaattagccaggcatggtggcgggcatctgtaatcccagctactcagcaggctgaggcgggagaattgcttgaacctgggaggcagaggttgcagtgagctgagatcgcgccactgcactccaggctgggcaaagggatcgaagctccttctcaaaaaaaaaaaaaaaaaaaaaaaaatagagctggaatcagaggcatgtaggagcccagagaaggggtccctgaccatcacccaggtgaggggcccttaagccatggaaggcttccctgagtgcctgaggagagtcttggggcctgaggaggagcgggaggtagcagagaacagagatgacagtcagagaaaggcctggaggagaaaccctgagtggcccacacaggagcccagccacctatgcaggaaacagataaccagctcggctttgcaagagtgtagtgtgcatgagatttttaaaacattaacatcaatatctacaatcttctggccaccctccgtgctggcctttgccatgctgacctgggcaaggggtggaggggacaaggttggaaagccagggctggctgcatgtctccacctgcggaaggagaggaggtgggcttcagggagaagagggggcaagggagtggcatttgaggattaatgaagagagacaaggaaatgagatgaggggctcccgtaaggacttgggctttgaagggagaggtgtgaaaagtgggtttttaggacagccctctgcagctgtaggtcttccgaaagaagttgttagtaaagactctcactaggtcagtgctttttggagggggattttctgttggttgcactgctggctgttggagagagtccctattaaaatagaaaatagaaggcccagtttcctttggcttatggtgaggtacaaggcagggctgaaggaggtgaggcaggtggatacacagagtttcacacctcagaggatctcttgggcctggaacttttctgtacacagaagggaactttgggatcttgaggaaattttagcttctctaatgctcagtttcttcttctttttctttttttttccttccttccttccttccttcctctctctctttctttgtttctttctttctttctttcttcctttatttcccttccttccttccctcctctctctccttccttccttcctctctctctttctctttttctttgttttctttctctttctttcttcctttcttttccttccttccctcctctctctgtctctctctttctttctttcttttttctttctttccttctttctttctttcgtttttcagggtcttgctctgttgcccaggctgcagtacagtggtgcaatcatggctcactgtagccagaacctccctgacttaagcaattctcctgtcttggcctcccaagtagctgggactacaggcacacatcaccgtgcctggctaattgttttatttttggtagagatggggtcttgctatgttgcccaggctgatcttgaactcctgggctcaagcaatcctcccacctcagcctcccaaagcactgggatttcagcgtgagccaccacacccgaccagttccttctttaaaatgaagatcataatgatccctgcactatagttttattacaagtattacataaaaccacacgtgagaatagaactaacccacttcccggcctggagcaggcccttcattcaggcttattgaatctggacctgctttggccccacccaaaccgatatgccccaggtcctgtttatttatggacagccctcaccctatggagctgatccagtgtttgccccacagcatcataatggcataggcaacaggacagtgtcacatttcacagcagcctttcttccctgttctgaaggagggagccacatggacgttttagtggacagaggagaaacacacacatgctttgtgtcatgacaaggctctgccattgcactggctcaagatcaagggcctaaagtgaggaacaaaaggccaaggcacaccaatgcaatagaacagtaacagcatgtaccgctgactcaggtcctctgcctaccctgggcaatgtctccctcaatctttgcaacacccctatgacatgggtcaaaaagtgctccttttttttttcctgagacggagtctcgctttcttgctcaggctggaatgcagtggcacaatctcagctccgcctcccaagttccagctattctcctgcctcagcctccctagtagctgggactacagacatgcaccaccacgcccagctaattttttttgtattttgagtagagacggggtttcaccatgttggccaaacctgtctcgaactcctgacctcaagtgatccgcccacgtcggcctcccaaagtgctgggattacaggccgtgagccaccgcgcccagcctcagaagtgctccttttttaccaatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttgaagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctggaggagcttcctgcagccaaatgacatcgagtgtgaccatttcaaagtacaaacaggattaaaaggaaaacatctgtaccttactaggctgcactaactcagttacaaacaagctgtgtagatatccaaatgcgcagtgacttttgctgcagaggtgggtggtgaccatctggactgggcattgattagaagataactggacatccgtgtgactgcatccttggtgggggtcagggcacagagatatatgtttgattccacaatgtcagtgtgactcagagacccttttgttgtcgttgtttatattacagttagtgagtcacccactacacctccctcctgggatgaagtcctgagctgtagaatgactccaaacaggcacgactgctttattagcaggctttgactcccatacagggctctgaacatcaaacaaagttggccaggatttgatcctcaaaagagaagatgggatcccatcaagatgtccacatgcctaacgcctgttggtccaaaagagtctcattttgtagggggaagaaacttaattaccagcgcaggaagagactctcagaacatgtggttttcagttttgccaagattccaggccaacttattactctattatcattgttgttaatctttgcttgaaagatgcatgaagtcagtaagtccctttcttaaggacaccaaagctgggagtctctgaaaaacaggaccaaacagtggaccactggtcagaggcacgatgtgagtaaagagtagcagaaatatttttgtcatgtatccacattaaagggtgactataaagtatgttccacaatggctttttttttttaccccctcagcaaagaaatagcactctattttgtttggaaaacctactttgatgcctcaaaaaaataatgtgcttttctgattctgatttttcctcttttctttcagcaactgtgttctgcctgtctctaaaccagtacttggaaggaatgtctctctctctctgtttatatttctatgtttcagagtcaacgtcatggctaaaggagacgtgatttgcaaaaaggcttgttctccaatagccaaggaaaatatgttttttaaaaatcttggtaatgcattagttttggcatctttaaaactcctttttccttttctttttttagggggtaggaggacagggtcttgctctgttgcccagactggagtgcagtggtgcaatcatagctcactgaagccttgctcaagccttcactcctgagctcaagtgattctctttcctcagcctctccaatatgtgagactacaggcatgtgccaccacaaccacctaatttaaaaaaaaaaaatttgtagagatggagttctccctatattgcccaggctggtcttgagctggctcaagcaattctcccgctttagtctcccaaagcgctaggattacaggtgtgagccactgtgccgagacttgtttttctcctctttttgtgatccctcccaaaatttgctgtcaataaactgtgtggtcctgtgagtgacccagggcagagacaagcattgtagccctgtcaccaactggccaaagatggctgctacatgatttcccttatccaatctaaagggggctattggagggggacagagggccatctgtgtccacaaaacgagcccagagttgggactgctgggactatacacatgtgaccgtatgtccagttgagagttgtcatacataaccagacagtggaggagcatggtggtcaacccagaaatgatgagttgggttctagggctgacagactgaaggctttatgaatgaccttttcacttcgttgacacataggtgacccctgtgtcctctaaatggtgcaggccaggcatcttttccgagacctaatggttccttctcttttataaatggccagatcgaagggcattagtgctctcaggcacaataggcctcaaaggcccctgcctccttcctaaatgggccttactgcaaaaccctaatgcacttcctcacactgggacctcagctggctctgtgcacaggcctccctgcagcacaggccctccctgcaaccacagcagtcactaatgaatattttatcagtcgccatgcctctctgtgcaggctgtatctggaagtcatctttgctgatttgacagcctttctgccttaaaggagccaccagcaatgatgtgttgccatctgtttagaaatgaggactcagccagcctcccagttaagctggaaagctgatcctccttagaacagatatttgaaaagagggctttgctctcatgaaagcccacagtctgcccctgcagttcccttgttactaattccagtgggggaaaaaaaattaagaaaatgtagacctagaagatcagaagattgcctcttcaaaaggcactagtttctaagagtagtattcctattattttattttagatcttgggtgaattcatttatttctacaacaaatgtttatctagttcctacttcatcagaaaaaacactggaactcagcccggaacaggaagaagctgactttgccctcggagaacagacagcctagtgaggaattcactgacttgcacattcatttattcaacacctatttacagagtgactatgatgtgcctggcattgctccggggacagggatacacagtgaacaaaacaaacaaaaatcattctgctggaagacaaaatataatcacacaatgtatataattattaaatgcgataagcacaatgacaaacatttccttacaaatgcctttcctgagattctatatccagctaaactatcattcagcagtaaagacaaaaccgagacattttcagatatacaacaaataagagagtttcttatgagcaggtgctcactgtcagaggaaagtgaaaaaagtgaacaaagacgaaagaaacaagaggcagcacaaaaatccaggaaatacattaacaaatgcaatgaatgactgcaatttttgtattttaacagagaaaaaaatgaacattcctgaaaatagtaaaatagaaaaccaagataaaggagaaaggatttttaaaatctgactttttagtcaaacaaagaaagcaaacaagcctctagcaagattgacttttaaagaggggtacaaaggcataaataatagcaggaatagggccaggcaccgtggctcacgcctgtaatcccagcactttgggaggccaaggcaggtggatcacgaaatcaggagtttgaggccagcctgacaaacatggtgaaaccccgtctctactacaaatacaaaaattagccgggcgtggtggtgcgtgcctgtaatcccagctactcaggaggctgagcaggagaatcgcttgaacccgggaggcagaggttgccgtgagccgagaatgcactactgcactccagcctgggtgacagagtgagactctatctcaaaataataataatagcaataataaataaaaacagatgcagttgagtttttttttttttaattaggagaatgcaatgaatacctttatgctaacaaatttgaaaacttagatgaaatgaataattttatagaaaaagactactaaaatggacccacagcctgggcaacatagtgagacccccatctctacaaaaaatcaaaaaagttgctgggtgtggtggtgtaccgctgtgtttgggaggtgtactcaagaggctgaagtgggaagaccgatggggccgaggagttcaaggctgcagtgagctatgatcaccccactgcactccagcctggacaacagaccaagaccctgtttcaaaaaataaaatctcccagcagtttgggaggccaaggcgggtgaatcaccttaggtcaggagtttgagaccagcctggccaacatggtgaaaccctgtctctactaaaaacacaaagaaaattagtcaggcatggtgacacacgcctgtaatcccagctactcgggaggctgaggcaggagaatcacttgaacccaggaggcagagaggttgcagtgagctgagatcagtcagaggttgcagtgagctgagatcatgccattgcactccagcctaggcgacagagcaaaataaaataaaataaaaaatagagccaagaagatcttttaaatatgaaataaatcaacaactattaaagaaattgaactggcaatcaaaagttctcccacaaccactcccacacctcccccacccctcgcccccaccatacacacagacaaaagacagattgttttccaggcaagttacaacaaagctttgaagaatagaaagccctcattttatgaaaacagtttcagagactagaaaaaggggggaaggtattgaaagaacttgataaagttagtataatcaggaagcccaaaccagagcctcatggtgccaccaggagagaaggtcctagcacctttgttctatcagctggggctctgcctgtcacgctggaaacaaaggtttcaattacacagagtaactgtcaggaaaaggcaggttagctgttggctgtctttcacatcaaactatgtgttaaagtggcaactttctttactccgcacagatctcacactagacctagatgaggctgggccagaagcaggaatttcaaagaggagctttaccaaatgcatcctggtttatgtaaatgcaggtgccaataatatcactggaacggtggctcatgcctgcaatctcagcactttaggaggccagggttggggaatggcttaagctcaggagttcgagaccagtctgggcaacatggcgaaacgtcatctccacaaaaaatacaaaaattagcaggacatcatggcccatgccgctcatcccagctactcaagatcctgaggtgggagttttgcttgagcccaagagtttgaggctgcagtgtgtcaagattgcaccactgcaccctagcctgggtgagagagcaagaacttgtctcaaaataataataatcatgtcacttcactaaaaatgagaaatctggagccagatacagtggctcacgcctgtaatcccagcactttgggaggccaaggtgggaggatcacttgaggtcaggtgttcaagatcagcctggccaacatgatgaaaccccatctctactaaaaatacaaaaattagtcaggcgtggtggagggcacctgtaatcccagctactcaggaggctgaggcatgagaatagcttgaacctgggaggtggagtttgcagtgagccgagattgcgccactgcactccagcctgggtgacagagcgagattaagtctcgagaaaaaaaaaaaaatgctgggacaaatgctagacgaaatgggacgccaggacaaccggtaaaagccaggactctgctgagccaaccaggaaatgaaggtaaatctcactctagcaagagagttaatgttctggacgtaaaatcaaaacaccaagtcaaaagcatccctccatagcaatagaaaccacttagaaagtgtaatagaaggaaaacacacatgaaggtattaaaggaaaaacacacacaacagccaccgaaagtatttatggccgggcgcagtggttcacacctgtaatcccagcactttgggagggcaaggcgagtggaccacttgagatcaggagttcaagaccagtctgagcaatatgatgaagccccatctgtactaaaaatacaaaaattagctgggcgtggtggcatgggcctgtaatcccagctactcaggaggcagagacaggagaatggcttgaacccaggagactggggttgcagtgagctgagatcatgccactgcactccagcctgggcgacaagagtgaaattatgtctcaaaaaaaaaaaaaagtatttacaccaactgtgaatgtatctactttaaaagaactttataaagaacagtataaaacatgatcagaaaaaaatatttttaaaagcatccagaaattatatcaagcatacctggtcttgttgtactttgctttattgtgttttgtggatactgcatttttacaaattgaagatttgtggcaaccctgcatgaagcaagtctatttgagtcacttttccaacagcatttgctcactttgtgtcgctgtcacagtttggtaatttccccaatattttgaactttttcattattattatgtgttataataatccatgatcagtgattttttattttttattttttgagatggagtctcactctgtcacccaggctggagtgcagtgccacagtctctgctcactgcaacctccgcatctcgggttcaagtgattctcctgcctcagcctcccaagtagctgggattacaggtgcccaccaccatgcctggctaatttttgtatttttagtagagacagggtttcgccatattggtcaagctggtctcaaactcttgagctcaaatgattcatctgcctcggcctcccaaagtgctgggattacaggtgtgagccactgcatctggcccgatcagggatctttgatgttactattgtaattgttttggggcaccaaaaaccacgcccatatgacagcaaacatactctgtacatgttgttcatgttctgactgccccaccaactggcctttccctgtctctctccctctcattgggcctccctctcccctgagaaacaacaatgttgaaattaggccaattaataaccctacaatggcctctaagtgcgcaagtgaaaggaagagtcacacatctctcactcaaaatgaaaagctagaaatgattgagcttagtgaggaaggtgtgctgaacgccaagacgggctgaaagcttggccccttgcacaaggtagccaagttgtgaatgcaaaggaaaatttccttcctctcttgaaggaaattaaaaatgccgctccagtgaacacaggaatgataagacagggaaacagccttattgctgatatggagaaaatctgagtggcctggatagaagatcaaaccagccacaacattcctttaagacaattcctaacccagagcaaggccctaactgtcttcaattctatgaagatggagaggtgaagaagctgcagaaaaaaaaagctggaagtgagtagaggttggttcatgaggtttaaggaaagaagctgtctccataacataaaagtgcaaggtgccaggcacggtggctcacacctgtaatcccagcactttgggaggttgaggtgggtggatcaagaggtcaggagttcgagatcagcctgaccaacatggtgaaaccctgtctctactaaaaatacaaaaattagccaggtgtggtgacacacgcctgtaatcccagctcctcaggaggctgaggcaggagaactgcttgaacccaggaggcagaagttgcagtgaaccgacatcacaccactgcactccagcctgggcgacagagtgagactctgcctcaaaaaaaaaaaaaaaaaaaaaaaaaaaaaaagtgcaagttgaagcagcagcagatgctgatggagaagctgcagcaagttctcaagaagatctagctagaatcactgattaaagtggttacaccaaccaacagatttgcagtgtagagaaaacagcctttcattgaaagaagatgccatccaggactttcatagctacagaggagaagtcaatgcctggcttcaaagtttcaaaggacaggctggctctcttgttaggggctaatgcagctggggactttaagttgaagtcaatcctgaaaatcctggggtccttaagaatgatgctatatctactctgtctgggctctgtacatggaacagaaaagcctcaaagacagcacatctgtttacagcatttttttttttttctttttgagatggagtctcgctctgtcacccaggctagagtgcagtggtgcaatcccggctcattgcaagctccgcctcctgggttcacgccatcctcctgcctcagcctcccaagtagctgggactacaggcgcccaccaccacgcccagctaattttttgtattttttagtagagacggggtttcaccgtgttatccgggatggtctcaatctcctgacctcgtgatccaccctccttggcctcccaaagtgctgggattacaggcgtgagccactgcgcccagcctacagcatgttttactgaatatgttaaacccgtttttgagaccaattgcttataaaaaaaagatttctttcaaaatattactgctcattgacaatgcaccttgttacctgagagctctaatggagatatacagtaagacgaatgttgttttcatgcctgctaacacaacatccattttgcagcccatggatcaaggtgtaattttgattttcaagtcttattatttaagaaatacattgagtgagaccgtagctgccatagatggtgattcctccaatggatctgggcaaaatcaactgaaaatctggaaaaggttcatgattccatggctattaagtacactcagtattcatgggaagaaattaaaatagcaacattaatggaagtttggaagaagttgattccatccctcattgaggactttaaatggttcaagactttactggagtaagtatttggctggtgcaaaagtaactgctgttttgccattacaagtgcagatccgtggtggaaatagcaagagaactagatacagatgtggtagaaatagcaagagaactagaattgcagatgtggtggaaatagcaaaagaactagaattagaagtggagcctgaagatgtgatggaattgctgcaatctcatgatcaaactttgttacaaaaataattttagacttttattttagattcaggaggtacatgtgcaactgcatgatgctggggtttggggtgtgaatgatcctgtcactcaggtagtaagcatagtacccagtaggtagtttttcagcccttgctgtcctccctctctcccatctctggtagtttcccatgtctgttgtttccatctttatgcccatgtttacccaatgcttagctcccacttataagtgagaacatgcagtgtttggctttctgttcctgtacaatttgcttaggataatgactttcagctgcatccatgttgctgcaaaggacataatttcatttttttatggctgggtagtattccatggtgtagatgcaccacgttttctttatccaatctgccattgatgggcacctaggttgactccatgtctttgctattgcaaatagtgctgcagtgaacatacaagtgtgtgtgtctttttggtaaaatgatttattttcctttgggtttatatccagtaaagagattactaagttgaatggtagctcgttttaagttctttaagaaatctcgtaactgcttttcacagtggctgaactaattcacatgcccaccaacaatgtataaagcgttctctcttctgtgcagcctcaccagcatctgttattttttgactttttagtaatagccattctgactggtgtgagatggtatctcattgtgattttgatttgcatttatctgatggtcagtgacgttaagcattttttcatgtttgttggccgtttgtatgtcttcttttgagaagtgtctgttggccaggtgtggtggctcacacctgtaatcccagcactttgggaggccaagtcaggaggatcacttgagccttgaaccttgaggagtttgagaccaaccggggcaacatagggagaccttgcctttacaaaaaatgaaaaattagccaggtgtggtggtgcactcctgtgatccgagctacttacgagacaggtgggaggatcgcttgagcccaggaggttgaggctgcagtgagccgtgattgcaccactgcactccagcctgagcaagagagtgagacccagtctaacaagaaatacccaaaaagtgtctgttcacatcctttgcccacttttcaatggtgttgtttgtttttgcttgttgaaattgtttaaatttcctacaaattctggatgctacacctttgttggatgcattagtggatgaagagttgttccctatggatgagcaaagaaagtgatttcttaaaatggaacctactcctgatgaagacattgttgtaggagctaagaagagagttctccttggctctgtgatggttcactgaaaaaatcacctctcaaaaggcagattaactggagaaaagacatgcacatttattttaattgtatacaaggaaacttttagaatgaagacctaaagatacagggaaaattgtctgttttcttttcttttttctttttttgagacagagtctcactcttatcacccaggctggagtgcaatggcatgatcttggctcactgcaacctccacctcccgggttcaagtgattctcctgcctcagcctcctgagtagctgggattataggcgtctgccaccgtgcccggctaactttagagacaggatttcaccatgttggccaggctggtctcgaactcctaacctcaggtgatccacccaccttggcctcccaaagtgctgcgattacaggtgtgagccagcgcacctggcgtccattttcatgcttacattcaacaaagtatgcacagccatgtagaaacatgattggacaaaaagtgtgtgatctaatggtaatagacttagtggagaaagccagcgagacctatctgtctagattcttctaggcctctctgagagtgaattccttagggggcaggacactttctggaatgggactcttacgacctacagtctaaaaaggtagatcagataatttctttatctgatccacctttttttacacagatagggcagagggaaagttaagtaatctttttctggttttatggctggcttgggggaaaaaggggttctggtttctatgacctgctttggggaagagggattctagtttttgtggtgcctctggggagaatgggactaaaagacaggcaggagggcagagaaaaaccttttgcttctgaggccctcatcttggagtattgttttctgagtcccaacactgtaaactttgttgaaatgacaacagaggatttattaatagcacagtatcatgaataaactcaacataaacttagttgataaagcagcagcagagtttgagaggattggctccaattttgaaagaagttcgacaatgggtaaaacactatcaaacagcaccatatgctacgcagtaattttttgtgaaaggaagagtccatcaaggcagcaaacttcattgcggtcttattttaataaattgccacagccagcccagccttcagcaaccaccaccctgctcagtcagcagccatcaacatcgaagccagactctccaccagcaaagagattatgacttgattaaggctcggatgatcattagcaccttttagcaacaaagtttttgtttgtttgtttgtttagatggagtctcactctgtcacccaggctggagtgcagtggcatgatcttggctcactgcagcctccaccacccaggtgcaagcaattctcctgcctcagcctcccgagtagctggcactacagatgcacgtcaccatgcccagataattttttttatttttagtagagatgtggttttaccatgttggccaggctggccttgaactcctgacctcaagtaatccacctgcctcagcctcccaaagtgctgggattacaggcatgaaccaccatactgggccaacaaaatattttttaattaagacatgttcactggttttttaaatatacatatatatatattctaaaattctattgtgcacttaatagactataatatagggtaaacaaattttgtctgcactgggaaaccaaaacatttgcatgacttgttttattgaggtggcctggaactgaacctatgatatctctgaggtatgcctgtacgagcttgggaatccttaatataataaattctcttccaacataatatgatataatctataattatacataataatataataattatagtagtaggatagactaattctctccaattaatttataaattgaattcaatcccaagatggtttatcaaggaactttcaaagcttattaaaaatgttatatgtgctttggaaggccaaggccagaggactgttggaactcaaagttcaagactagcctgggcaacatagcaagacctgtcactattcaattaaataacaataaaaaaagagtctgggcacagtggctcacacctgttatcccagaattttggaggccgaggtgggcagatctcttgagcccaggagtttgagaccagcctgggcaacatggcgaaaccccatctctactaaaatacaaaaattagccaggcacggtggcatgcacctgtagtcccagctacttgggaggctgaggtgcaaggatcacttaatcccaggagttggaggccagcctaggcaacatagcaagatcccttctctacaaaagagtaaaaaaaaaattacctgggcatggtggtgtgggactgtggtcccagctacttgggaggctgaggtgggaggatcacttgagcttgagtggcagaggctgcagtgagttatgattatgccactgcactaaagcctgggcaacagagtgaagccctgtctggaaaaaaaaaaaatggataagactcagaaatagccaagtggaagaggtgccgagggtggggtatggggagcggcgtggagcttccagccctcttctaggcccaccatcctcccagcacctccatgtgtccatctacccagaagctctctgaacatcatcctttagggtttttatggaggtcccattacatgtgcatgataggtaaatctttggctatcgatgattagctcaatctccagtccctctcccctctcaaggtgagtggggggctgggggagtgaggctgaaagttcccaccctctaatcacagggttggctcttctgacgaccagcccccatcctgaagctatctaggggcccaccaagagtcaccttattagcatgaactcaggtatggttgaaagaagtttgtcataaataacgaaagaagctccactaccgctatcactcaggaaattgcaaggattttagaagctctgtgtcaggaaccataggaagaccaaatatatatttcttactgtgtcaccatgcgctgtaggagctcctacacagcttcatagtaacacaggtccaagaaagtccattgcattattgtttctaataattcccaaatgctctgtcagtaatgataacataatgttcagctgctagtgatggaagtgtatctctagaaaggtttattctctcaagttaaaaaaaaaagttgaggcctggtgcagtggctcacgcctgtaatcccacccctttgggagcccaaggcaggtggattgagatcaggagttcgagaccagcctggccaacatggtgaaaccccatctctactaaaaatacaaaaattagctgggtgtgttggtgggtgcctgtaatcccagctactcaggaggctgaggcagggaattgcttgaacccagcaggtggaggttgcagtgagccaagatcacaccactgcactccagcctgggcaacaaagtgagactccgtctcaaaaaaataaataaaatcaatcaatcaatcaatcaatcaatcaatccaaggctgggatgaaggctccacaaagtcaccagggacctggtttccttctgtcttcctgctctgtcgtactgaggagggaggcttcatcctcagcatcactgcatggtctaatgtggctgctggagctccagctatcaaatccacattccaatcaacagaagagggcgagggagggaggaagagcaaaagcgaatgccccagtctgtccctctttggagaagcgctctcatatatcctcccctgaaagttctgtttatattgtggtgaccagaatatatgtgtagccacacctggaagcaaaagaggtaaagaaatgtaggcttttagctgggcacattgttgctttgcgtatctgttactaaaggagggaaaaagtatttgggaagcaaccagtagtctttgtcactcaacttaaatatctttaggagaatggataaataaattacagtgtatttgtgcgatggagcactatatagtagttaaaatgaaggaaatagagctacgtgaatccacatggataattctcagaacaaaatctcttgcccgaaaaagcgagttgctgagttccaactctacgatgccattcatataaagtttaaaagcctgcaaaacaacacaatgtatctttgatggctacataaaatatatatgttgggaaggtataaaaacataaatgaaaatgaaaaatactaaacgcaagatgatggttacctctggagagggagagcaaacagtgtgatcagaaacagagacatccaggctttcgattactacctgtgatgttgtatttctttaaaagacaagaaaaaatttggaggaaacagcaaaatgttaaggcttgtaaaagtcgaattgtgagtacgcagcatttaacccaccattccctatatgtttctgtatgttccacatttgtcattgtatatgagctagataaagaaggagatcaagatcatctagaggcataacttaatgagatgtaacccacatatggcgaattcccacctctcaaggatacagcatgatgaatctttacagagtgaattcctccagagaagggtatagaatctagcatcccagaaatttcctctcagtggcagccccagcaaagaaaaaacactattgtgatatctaccaccattgattgtatggtttttttgttttgttttgagacagtcttgctctgtcttgcccaggctgcagtgcagtggtgcaatcacagctcactgcagctttgaactcctgggctcaagtgaccctccggcctcagcctcccaggtagctgggtctacaggcgtgtgccgtgacacctagctaatctcttttatttttttgcagagatggggtctcactattgtgaaacccaaaagtctgagacaggtctcagtccatttaggaagtttgttttgccaaagttaaggatgcgagcccatgacacggcctcaggaggtcctggtaacatgtgcccaaggtggtcagaccacagcttggttttatacattttagggagatgtgagacatcaatcaacaaatgtaggatgaacattggttcagtccagaaaaggccagatgactcaaagtagggagggggcttccaggtacaattggttgtattctactgagtttcagatgagcctctccaaaggaggcattcagatacgcattcatctcagtgaacagaggaatgacattgagtcgaatgggaggcaggtttgccctaagcagttcccagcttgactttttcctttagcttagtgatttgggggccccaagatttattttcctttcacgttgtgtttcccagacttgtctggatctcctgaccttaaacctccctcccttcttaacctcctaaagtgctgggattacaggcatgagccagcatgcatggcctgcgttttgtcttttgcaagaaggaattgtcagacgtgtgtgaatgaaagcaactccatcttaaataggagctgggtaaaatgaggctgagaccaactgggctgcattcctagatggttaaggcattctaagtcacaggatgagataggaggtcagcacaaaatatgggccataaataccttgctgataaagcagcttgcagtgacggagccggccaaaacccaccaaaaccaaagtggccacgagagtgacctctggccgtcctcactgctacactcccaccagcaccgggacagtttacaaatgccatggcaacgtcaggatgctgccctgtatggtctaaaagggggaggcatgaataatccaccccttgtttagaatatcatccagaaataaccataaaaatgggcaaccagcagccctcggggctgctccgtctatggagcagccgttctttattcctttactttcttaataaacttgctttcactttgcactacggactagccctgaattctttcttgcgcgagatccgagaaccctctcttggggtctggatctggacccctttcctgtaacatatttacggcgatcacaaagggattaaagtgcagaaaccctacagaatcacgccaaatcatacggtatattctcgtgaatggctgacttcattttctcagcagtatgtctctggagttcctccgaagaagccgttttctaatcttcagcactcatccaatcagaaggctggagctctgcgctcgacataaggaagaacttcatcattaactccccgagccctgcaaagcagctgggagggagatctaagtttttggagtggatttcaggatcctttgtacccacagctgtttagggagccggcgtcctgctgacagctgtaggtggatttgaaaatgttcccaaattccctcctggccctcagtttcccatttctcttcctctcctgatgtcggctctaaataaagaaaaaaccaagtgtcaggggctgcagagaggctcctgagaatgctcacatctcagctctcagacagctcacaaggggtgttaaaataattaaagctgaaaagggagatgtaggtattatttttagacaagcgtctaaggtttacctgttatacgtgcccttcattcctgtccctcattcactgccagcatctttttttttttcattaaatagaacaaaaatacacttaaattttatggcatggctaataaaaaaaaaggttaagttgaactcatttcatcaaagatttgtggtgggatgacccactgtagttttgttgatgtgtttgcttttttaacagactttattttttagggtggttttaggtttacagcaaaattgagcagaaggtacagagaattcccatatactgtctgcctctccaacacacacacagcctcccacgctatcaacattcctgccatcgtggcacatttgtaatggaaaccaagagtctctgagacaagtctcaatcaatttagaaagtttattttgcccaggttaaggacatacccatgacccagcctcaggaggtcctgatgacatgtgctcaacctggtcagggtacaattggtttatacatcataggcagacatgagacatcagtcaatacaggcaagatatgcaatggttcaggatgcgaaggtgagacaacttggaaacaggggcgtccaggtcataggtagatttaaaatttttctgattggcaattggttgaaagagttattatccgtagaaaggaatgtctgggttatgataaagggttgtggagaccaaggttttgttttgttttgttttgttttttgagatggagtctcgctgtgttgccaggctggagtgcaatggcacgatctcagctcactgcaacctccacctcctgggttcaagcgattctcctgcctcagcctcccaagttgctgggatgacaggtgcgtgacagcacgcccagttaatttttgtatttttagtagagacagggtttcaccatgatggccaggatggtctcgatctcttgactttgtgatccgcccgcctcggccttccaaagtgctgggattacaggcctgagccactgcacctggcccagatcaatgttttatcctgcaaatgaagcctgtagatatcaggctttagagagaatagattgtaaatgtttcttgtcagacttaaagagtctgttttatcagcaattccaaaagggaggaggggataatgaggcatgtctggctttctctttccaacatggcctgaactagttttttcaggttagctttggaatgctcttggccaagaggaggggtccatttagatggctggaggacttagaattttatttttggtttacagaaaaaattgatgaaccttacactgtacatcatcatcacccagagtccagagtttacattagggttcactcttggttgtggtgtgttttctctgggtttggacaaatgtctaatgacattgtaggatcatacagagaggtttcactaccctaaaaatcctgtgtgctccctgccagcattttttaacatcatctctttcaagttgtttttgtcaaaaatgttaaattaccaaacaatgcggcgatatgttcttgcaaaagtaaaggctacagatacgtgctgatgggttctctccactggtctggaagcatgcagcacttacaaagcgtcctgacatgggatctgtttcctgcgtgtgcagtggttggtgggttacactctacctgtctgcttccccatgtgtgggaactacaaggtgggccacagttcctggtcagccaccacacctagccaaagacttccagagactgctcacaggtccctggaatccatccgtgaaattgtcagaggcatttgaaccagagcacctccatcttgaagaggaactgggtaaaatgcggctgagacctactgggctgcattcccagatggttaggcattctaagtcacaggatgaggcaggaggtcagcacaagatacaggacataaagaccttgctgataaaatatgttgcagtaaagaagccaggcaaatcccaccaaaaccaagatggcaacaagagtgacctctggtcattctcactgctacactctcccaccagcatcatgagtgtttacaaatgccatggtaacgtcaggaagttcccctatacgatctaaaaacgagaggcttgaatagtccaccccttgtttagcatatcttccagaaataaccataaaaatgggcaaccagctgcccttggggctgctctgtctatggagcagccgttctttattcctttactttcttaataaatttgctttcactttacgggctcatcctgaattaatgaattaattctttctttcttcttcttcttcttctttttttttttttttttttttttttttttttttttttatggagtctagctctgtcgcccaggctagagcttggcttactgcaacctctgcctcctgggttcaagggattctgctgcctcagcctcctgagtagctgggattacaggtgcaggccaccatgactagctaatttttgtttttttttttgtttgtttgtttgtttttttagtatagacagggtttcaccatgttggccagcctggtcttgaactcctgaactcaggtgatccacctgtctcggcctcccaaagtgctgtgatgacaggcgtgattacaggcgtgagccaccgtgcctggcccacctggctaatttttgtatttttagtagagatggggtttcaccatgttggtcaggctggtctcgaactcctgacctcaagtgatcctcggcctcccaaccaggtccaagaaccgtctctgggggtcttgatcaggacccctttcctgtaatatctttctggtgtccacagaagggactatactgcagaaacacccaacccaaaggctaattttgggtaagtggtgggatccagtaacaaaattaatggaccgacggaagtccaatccaaactacaaaagtaacagagacttgtataaaacacatgcacacacagaaacacacactgcacggagccccacagagaattccatttttgaattattcatttttcacttccatattgtcattgttttatctgcagtggagggagaattccctgttgctggtgaagttcatcagagtcttatatgctatgatcggtgggagggtggatcacaaaatatgacagtctgaatttgactgccagatctatttgcccacgcatttaaaccccattcccaacttagctaaagaaattatctcataatagttttgtttttgcattgtgcaaaaggacagcactaattatccaggtaactcagggcctcctgaagctcagaaaacattcctggaaagaacacaatgaatagtcacctctgcgagaggggaatgcagagagctgcgatgctgactgggagaaaagaggaaatgctgcttgccttagtgaagccgattcaatctctgtgcaagggagatactgagcttatttcaacaaagaagcaaaaatgagattgagttcattccccattctgtgtaacccaaactgcattcaaggatagtgtctatttgcttgtaattcctctttgacttgagaaggaagaatcatgactctggagaaaggaagaatggaagagaagcaaggtgctgattagatgctggctgaattatggagagtctgtccagaagaggggggagttggtgtacttgaagattcagccaaggagaacagtggaaaccaataaattatttttggcttctgagaataaggacctgttggtggaaaaggttgggaatggagtacctgggaagggagggaagggagtgttgtccgatttcgatgcaatgccagcatctctaaacttgtaagagacagcaggcacagtggccaggactcagttcctctgtctgcagctccctggggccacacaatgcagtccagcttttgcctttgccacctggagttaggagagaaaagcttcgtgttaaaacttgaggcactcgaacgtttatcaaatctgagatctgcaagtgtgtgcctgcaccagggattagcaaacaacaaaatgccattaaaagctaaaaacaacaacaacaactctctttgcagcatgtaggtgcctttgcaaagttctctctaagccaaagttcgtggacttccaatcttgtcaaaatcactactaattaataccttttcacttcccactgaaagaaaaacaattcaccattaagtcaggcagcctacccataatcactctaacaccttctatgtatgttttgaaacgtgctctcacatttcatgatccgtttattttacaagatgggtaaactgcagacaattatggtgataatacggctgaggtgtttggtttttatctgttcgcagtaaattgtggttgttcaagccttctcagtaatgatttccatccctctctcaatctcttcctatcacctggcgataaatagaatgtttttaaaaaagaatgttagtttactatcatcattatcacctattcaactagcaatataattaaataatttcttggtaggtatgactcaattaaattaattacactaacagatattccatggtacacgcctctaaaaatataaagcgtattcactgttgtgtgtcatttttctctgtataggcaggaagagctatctggataattgagcaggcaattttgcttttgaaagatgctatcaaagtacgcaaggatttaatttcagattttttattagaagacagtgccttctgcatgtaattctccgcggctgatgcatttcagaggttcatgagcagcggacacgaagataaaaactgaaagccagggctatgggaatagctggaccatcagtggagtcttggcatcttagacctggtctcttgactgcctgttccttctgaaatgtccttaggccactttggccagaggcattctcggacttatgaaaaggggaacctgtaggctgtttgttgaggtctaaaaggattaagatttgaaggtgacacccctgttgggataatctccctcaaaactcttctctaaacaactgaagataatatccttataccttttgcctgtggttctctccaggggatggtctcaaagtgttcttgaaaatgtgtttgaagaaaataggcaatgtattagtgtgatttaaagattccctcccaaaattttcacttccacggggctcagcgggaaaatagggtaatgtagagtgagcctctctccctggtgacataggtggcctcctattaattaggttagggaaatgcagaactaacttgccatttggagaaagtcacatgaaatagacttctttttttccgcctccagaattttgaattcattgaacatggccacagcaagagtcattctttacaatcctctgacatttgaaagtaagaagctttagactttattctaacgctcttttaccttcttcccggtccctgacaactgtcacaccaggtccacagagacagccacaactctaaaagggtcagttatatggtaataatgacagctaagctccgccagtagcactctaaattttgcaaagtggctttgcaaatattagctcatttgtttatgaacccaagatccctagcacttagcaggggtggtggtgggggtgtgagtgggaagtgtgttggatttcatttatcttttaaaatcctaactgggctcagtgtggtggctcatgcctgtaatcccaatgctttgggaggtggaggtgggaacatcacttgaggtcaggagttcgagaccagcctggccaatatggtgaaaccctgtgtctactacaaatacaaaaattagccaagtgtgatggcacacccttgtaatcccagctactcaggaggcagaggcacgacaattgcttgaacctgggaggcagaggctgcagtgagccaagactggacccctccactccagcctgggcaacatagcaagactctgtctctacaaaatataaaattagccaagcatcgagggggtcttagcatcttagacctgggattagtggtgcacgcccatagtcccagctacttgggaggctgagacaggaggattgcttgaattcaggagttcaaggctgcattgagctatgatctcaccactgaactcaagcctgggcaacacagtgagaccctgtctcaaaaaaaaaaaaaactaataaataaaaaataaaaatagggctgggctcagtggctcatgtctataatcttaccactttgggaggccacaacaggaggattgcttgagcccaggagttcaagaccagcctgggcaacatggtgagatcttgtctctactaaaaataaaaaatgagccaggtgtgatggtgcacacctgtggtcccagctacttcggaggctgaggtgggaggattgcttgaccgcaggaagtcaaagctgcagtgagccatgtcacaccactgcactccagcctggatgacagcacaaaaccccgtctcaaaaaaaaaaaaaaaaaaaaaaaaaaaaaatatatatatatatatatatatatatatggccaggcacagtggctcacacgtgtaatcccggcactttgggtgactgaggcaggcttatgacttgaggtcaggagcttgagaccagcctggccaacatggtgaaaccccgtatctactgaaaatacaaaaattagcctggcatgatagtatatgcctgtaatcccagctactcaggaggctgaggcaggagaatcgcttgaacctgaggggcagaggttgcagtgagccaagattgcaccactgcactccagcctgggtgacagagcaagactccatctcaacaaaataaaataaaattaacgaatttaattaaataaataactaatttaaaaacaagatcaaccataataggaatcaaagcaaagggaaatctacccattcttctttgtagaatgttctctgcctgtctctctctctctgcattaatttcaaatctgtattgagttccacgggctctggacagattttatttgggtgctatgctttggggccaatgtgctctctgtagtggtgctgaaggtctgttgcaggtaaccacgtcctgcctcttttgcgatcacccactctgaaatgtgatctagctcccttcttctcccatccttattactgatggaacagatttatcactgtgaggccagcacagctgtttcgtgactcacgggaatatcatatttagcatgtgttccctagtgaatgtatttatttagatgacacataatattgttgaaaagccaagtctgcattgctcttaaacccagccttatggatgaacgcggaggagtgcaaaaggcagaatgagctcatttgggagaggcagctggtcagagagtccttttgggtcattcatgcaatgagctcacactagaaatctaaacaacagggaaatcgaccctgggtgctgaactacagggcacaagaataggaagcagccttataaagcagctcatcctaagcatttgtggctcacaaacattgccactaagcatgggggaccgttgatggcacaccagccttctaaagagaaaaccacagtcatctaccacttgagttgatagagtagcatcttgggaattgatagcagcattatggcttttatcctctcttgaggtcatcctctggaaggtaacaaggccattagcactgaacaagccagatggcccacttagctgacagcgggctcccctcttaacgccctaccccccacccccaattcatcttcccagtcttggtgttgctgtgcctcactgagcgagggctcagaacatctccccaaacacagggtattggagggaaggtgtgctaatgaagttaatgtgtgaaaacatgagcaaccttccggctgggcgtgatggctcacgcctgtaatcccagcactttgggaggccgaggcaggcagatcacttgaaagtcaggggttcgagaccagcctggccaacatggtgaaacccgtgtgtctactaaaaatataaaaattagccgggcgtggtggcacatgcctgtgatcccagctactcgggaggctgaggtgagagaattgctggaacctggaaggcggaggttgcagcgagccgagattgtgccattgcacttcagcctggacgacagagcagcactccgtttcaaaaaagaaaagagccaccttcccattatgtttttaatatccttcttggtgatgtctggagcccgtgactctgccgagacagcgtgctcagggccagtctccaagagctcccattttcttaaacacatcgccttgaacttactcacatttgatctcatctccctccttccttcccactgatacagagtcttcagatctttctgttttcctgtcatcctttgcccaaccctcatcctttcatctgcaaacccagagctttctctgctccccccagtcccacctcttccagctcttgtaaaagaatattaaataaaaccagggctggcactgatctttcagaaatcttactcttgacacatccctatcaaaaaaagtctctgtcccttcatccctggcatttattttttgctctttagtattctctgattgtgtcactgtagctcccatttcaatcaattggtagttcaattatctccaaattcctcgaagtcatgaaagttcaagtaggtatttttcaaacttttttgcagcagtgaaaccctgttaccctgctgttgtgctaccactagacatccagaagagtgtgaatttgtagattaagaccagaaaaagtactcgagcatcttgtagctgattgtgaatatcagcccagggaatgtgcaacacagaaaacagccctttcaggctgggcatgctgttgcacacctgtagtcccagctacttgggaatctgaggtgggaggatcacttgagcccaagaggtcgaggctagagtgagccatgattgtgccactgcactccagcctgggccacagagtgagaccctgaaagaaagaaagaaagagagagagagagagagaaggaaggaaggaaggaaggaaggaaggaacgaaggaaggaacgaaggaaggaaagaagacaaaaaaggaaagaaaagaaaaaaaaaggaaagaaaagaaaagaaaaaaaaaaaaagccccttcctcctcaggtcgtctttgaggctttgcagaaatggcctcagatataggatatagaggaccctatcttccccaggctgcccttcatcttcccttttctacccactcccaaaccagggtcttgaccaccaacttctgatttcctgcacagtcaaagtcagggaaactgactttttcctgacaaagtcaggaaaccatatatatatatacattttgtattttttgagatggggttttgtgctgtcacccagtgatcatggttcactacagctttgacctcctgggctcaagcaatcctcccacctcagcctttctttgttctattctggagagcaagggagattgccacaaatttctgtgggtgtagtggtagtgatggtggtggtgatggtgatattgtggtggtggtggtgatgatgatggtgaagatgatgatggttaagataatgatggcaatgatgttggtggtgatgatgataatgaagatgatgatggtgatgatgatggtggtgataaggatagtggtggtgaggatgatgatattcatgatgatgatatttgtgttggtggtgatgatgatgatggtaaagataatgatggcaatgatgttggtgatgataatgaagatgatgatggtgatgatgatgtggagataatgatggtggtggtgaggatgatgatgttcatgatgatcatactgatggtggtggtaatgatgatgatagtggtggtgaggaagataatgaagatgattatgatggtggtgataatgatgatgatgataatggtggtggtgatgatggtagtggttgtggcgacaataaaatagtgatgatggttgtgatcataatggtaaagatgatggtgataatgatgatggtggtggtaatgataatgatgatgatgatgctggtgtatgtattagacagggttctctatagggacagaactaatagaatatatatatatgggagtatataagtactctttaatatatatattaaggagtattgactcacacaatcacaaggtcccacaataggctgtctgcaagctgaggagcaaggaagccaggctgagtctcaaagctaaagaacttggagtctgatgttcaaaggcaggaagcatcctgcatgggagaaagatttaggctaggaggctaagccagtctagtcttttgacattttttctgccttttattctggccttgctggcagctgattagattgggcccacccagattgagggtgtatctgcctttcccagtccactgactcaacatcctcacagacacacccaggaacaatactttgcatccttcaatccaatcaagttgactctcaatattatctatcacggtggtgataatgatgaagatgataaaggtggtggtggtgatgaagatgatggtagtagtggtagtgatgatgatggttggggtgatgatgaagatgatagtgatggtgaagatcatggtggtagtgctggtgatagtggttgtggtgatgatggtgatgataatgaagatgatgatgatggtgataatgatggtgatgatgatgataatcatggtggtgatgatggtggtggtggtggtggtggtgaagatgatggtggccgtgctggtaatggtggtggtgatgatgtagttgtgataatgatgatgacagcagcagttaacagtgtaaggcatcatttgtagtggtttgcatgtattagctcaggaagtccttatcagccaagtattattaggatgatctaccccattctacagatgaagaaactgagccatagaaccattaaataactcccttaagatgacacagctagtaaaggcggaactaggacttagacccaggcagtctagctctaaagcccacactcccagccactcactaatggtgcaagtggtttagagtctttggggtggtaaatctagaagcaaatgaacttgtattgcatttaagtagaaccatcattaattatgttaaatgacctccacaagcagtaaggatggaatggaaggtgaggggacagagaatcccaccatgatatactttttcacaaaaggaatctttttttttttttttttttgagatggtttctcactctgtcacccaggctggagtgcagtggcgcgatctcggctcactgcaacctctgcctcccgagttcaagcaattctcctgccttagcctcctgagtagcttggattacaggtgcacgccaccatgcccggctaatttttttgtgtattttcagtagagattgggtttcaccatgctggccaggctggtctcgaactactgacctcgagtgatccacccgcctcagcctcccaaagtgctgggatgtcaggtgtgagccaccgtgcctggccgaaatcttatgaagaaaataattacaagtagaactgtttgaggggaaacaggtaagggggctggacccttgtttcctgatctctccaatgaccctctgcagaggccccaaaggctctgcttccagagaccccagggctctatagaattcagctatactactcatcagttcagatatggtagataatccttgctctcacttatgaccctcctgctaggtacttttcttatcagttttaatcctcagaactgcctttggagtgaggtgtgattatcctaattttacaggtgaggagaatgaagctcaggcaaggtttgcaaccagaccaagttcacaaagtgtaagttggtggcagagctgggatttgagccaggacagtatgactcagaaaatgtactgttttccagataaattggctgcttgctgtacatctcccatgtagaaattagatccatcagttttcctttgtacacacactgactcaccctcttgggccttggaagactctagcacagccatcaagtatgatttctctgggcagcacctgcgtggcagctctttctcccactctccattcattccctgccctgtaggttatttttaagtccacaggcttctctcttttatttcaactgccaccagcttggtccagatggtggctgagagctgactcatctgcgctgtaattccccaggcccctctgagccactcttatggccagggtcacatctgtgagctgacatcctctccactatagtggccttctgggctgacagttcccacattcctgccaatcaaccatcccagtttcatccatgagctcctgcagctctctcaggtggatgccatctgcttgcagtgattgatctgcacttcattctttccaatctggcttagaacatcctggtattgaccacggtgtgatctagtacctgtctgtgtagaggctattcaaatagcctctgtagacccaggctagaagtccattcaatccattaactgttttctttttattctttcctctgcagggaacatctattagttacaccatcctttccaaaaatggagtgagcaactgagttggtggtttgtgctctccttgcaggatactgaccttatactgtgatcagcaggttgtgttgcttagtgaatgagagtatcggcattagagtcaggctgacaagagctgaagtgctgtctccatcacttcccacctgtgaagcttgtctggccagtaccactttgtctctctttggggaaatgatctcctccacacgccatcatggtagttgcactggagatcaccaatcacagtacacatcctccttggccacagaaattagcccagggatgggtcactagaagcttccctgaaatgtttctaactggagcccatgggggatgctgtttctgatcatatggacaattccagagctactcctgacccttttctcagttttccaatggagagacatgtttgaagcacataagaatgatgccaataagcacagagaatgagaagcaagagataggggggaagagagacatagggcatgattaggagagtgtcatcccgagaactcagcatctgtggtctcccaaatcagctctatcccttgcctttccaggcatatgagccaataattctttttcttttttttttttttttttttttttttttgcctgagctagtgtgagttgaggtcctgtagattgcagccaatgtccagatcaatgcaacctcacgatgagtttcttgctgagtctctagaagtctttcctcttcaatatcactgaaaggtcttttctcatgcaattggtttgagaatctcttgcaagctacacaacaaagtcttggccaattatgtctggctttgcctcaaaggattctctacttctgtttgaacaacttgtctttttttttttctttcagtgatctaaactatttacaaagcactttcacaccctgtgcctcagtaagtgctgccaaccaccctttgagacaggaatctgttcattcagtcaacagcctttctagtgctaccactgtttttggcactgagaatatactggtgaattagacaaagctcccacttcataagcttacatttcagtgggcgagacaaacaagtgagtaaatacataaataatataacttctagaggcagtaagtcctctgagaacaaatggcgtggggaggttgggtgccattttagacaagatgaacacaaaaggtgataggtagtcataagtgattgtaaggtgtattagtctgttctcatgctgctaataaagacatacctgagactgggtaatttataaagaaaatgaagtttaatggaggctgggtatggtggctcacacctgtaatcccagcacgttgggaggccgaggtcggcagatcacctgaggtcgggagttcgagaccagcctgatcaacacggagaaaccctgtctctactaaaaatggaaaattagccaggcgtggtggtgcatgcctgtaatcctagctactcgggaggctgaggcaggagaattgcttgaacctgggaggcagaggttgcagtgagctgagactacgccattgtactccagcctgggcaacaagagcaaaaactccagcaaaaaaattaaaaaacaaaagagatttaatggactcacagttccactttgctgaggaggcctcacaatcatggtggaaggcaaaaggcacgtcttacatggtggcagacaagagggaatttttgtggggaaactcccccttataaaaccatcagatctcatgagacttattcactatcaggagaagagcacaggaaagactcacccccaagattcaactgcctcccaccaggtccttcccaggacctgtgggagctacagttcaagatgagattcgggtggagacacagccaaatcatatcgggaaagggttcatagaaggccttccttttttccttgcttccttctttccttcttaaaaatttttaaatgttttttggagacagggtctcactctgtgtcccaggctggagtgcagtggcacaatcatggctcactgcagcctcaacctcccagactcaagcaatcttcccacctcagcctcccaagtagctgggactacaggcatgcaccaccatgcccaacacatttttaaatttttgtagagacggggtctacctatgttgtccaggctggtcttgaactcctgggctcaagtgattgtcctgccttggcctcccgacgtgctgggattctaagtgtgagccactaagcctggcagaaggcctttctgaagaattgactttcaatcagagatctacacagagtcagggagtaagcccatgaagagtattccagggagatgctacaacaagtccaaaggccctgaagcaggaaagagattggcgtgatctaagaaagcaaggccagctggatggcgtgaacgtgaggagtgagtctaggcagcttttagcccatatggtacaattacgtttgttagaaaaaggtgccctttctgggtagactaattaccactgacatcattgttcaggacacacctggacaactgtaccagttaattgtggagacagacttaggagacaaggtcagagaaggacgggagccagaacattggattttactctaagctgatgctgcctgagaagaacagaacatgatgttctgtatgtaacttaaacttttccaaaagccacattgtgaaaaaaacaaaaagaaagaggtaaggttgggcgcagtggctcatgcctgtaatcctagcactttgggaggccaaggcagaaggattgcttaagtttaggagttcaagaccagcttgggcaacatagtgagacctcctctctactaaaaatttaaaaaattgtcctggtgtagtagggcacactcgtaatcccagcacttttgggggccaaggcaggaggattgcttgagcccgggagttcaagaccagcctgggcaatgtagtgagactccatctgtaataaaattttaaaaattagccagtttcggtgggccatgccttagttccaggtgaggtatgaagattgcttgagcccaagagtttgaggctgcagtgagctatgaacgtgccactgccctccatctagcctgggtgacagagcaagccccgtctcaggaaaaaaaaaaaaaaaaaaagaagaagaagaagaagaagaaaaacaagaggtaaaataatttaaataatatgttgtttagccagtatatctaaaatgttaacatttcaacatgtgatcaatgtaaaaaaattacgagatatatttaactattttaaaaataaaatttcttcaaaatctggtgcatacttttatacttacagaacttctcaactaaaaataaaaataaaggaaaaaaagaaaacttcctaactcaggtattaaattttttttttttttttgagatgaagtcttgctccgttgcgcaggctggagtgcagtggcgcgatctcggctcactgcaatctctgcctcccaggttcacgccattctcctgcctcagcctccagagtagctgggactacaggcgcccgccaccacacccagctaattttctgtatttttagtagagacagggtttcactgtgttagccaggatggtctcgatctcctgacctcttgatccgcccgccttggcctcccaaagtgctgggattacaggcttgagccaccaaggccggcctaaatttttatcagaaatgcttaagcaatatttggatttcttaagtttatggtgaaaagtagattcacatacccaggttgttccaattgtacttaaacagtttcaaataataaaactggacaccaatttttaaatttaaattaattaaaaataaaactgacttaaatatttcctcaattgcaccaagccacattgctttttttctttatttcttcatatgtcttgtaataattcattattttcagattgatgacaatttttcatgattgttatacgtgaattggaagtatttgtcaaattttaaggtgacaacattgacattcttgttttcattctgctttgatgagtctgtatagaacttgctttttgttttttgtttttaaatttcaactattattctagatatggggggtacacgtgcaggtttgtacatgggtatattgcacccaggtagtgagcatagtacccaatggtagtttttcaatgcccccgcatccttcctcttctttctagtagtccacagtgcctactgttcccatctttatgtccatgagtggtcaatgtttggctcccatttatatgtgataataagcagtatttgcttttctgttcctgcattaatttgcttaggattacagcttccagctccatccatgttgctgtaaaggacatgatttcattctttttcatggctgcatactattccatggtatatatgtaccacactttctttatccagtctgccactgatgggaacctaggttgatcccatgtctttgctattgtgaataacgtggtgatgaacatatatgtgcatgcatctttttggcataatgatctgtttttctgggtatatacccagtaattggcttgcggggtcaaatggtagttcagacacttctcaaaagaagacatacaagcagccaataatcatatgaaaaaactcccatcatcactattcaacagagaaatgcaaatcaaaaccacaatgagataccatctcacaccagtcagaacagctactattaataaggtcaaaaaacaacagatgctggtgaggctgcagagaaaagggaatgcttacacactgttggtataagcagatgggtggtggggatggaaatgagttcagccactgtagaaagtcgtttggagatttctcaaagaacttcaaatagaatttgtttttaaaagcatacaagccatgtttcaagtgctcaatagccacttatggttgttatcctcttgcacagagcaggtctaagtgttctgggggccactatacagttgagaatagggaatgacatcatcttgttaccttctagaacagggtgtccaatcttttggtgtccgtgggccacactggaagaagaattgtcttgggccatacacagaatgcactaacactaatgatagctgatgagctaaaaatgaaaaatgtaaaaaaaactcataatgttttttgttgttgttgttgttgtttgtttgtttgttttgaaacagagtctcactctgtcatccagactggaatgcagtgacgcgttcttgactcactgcaacctccgcctcccgggttcaagtgattctcctgcctcagcctcccgagtagctgggattacaggcatgcaccaccacagctggctaatttttgtatttttagtagagatggggtttcaccatgttggtcaggcttgaactcctgacttcaagcaatccacccatctgggcctcccaaagtgctgggattacaggcgtgagccaacacgcctggcctaaaaatctcataatgttttaagaaagtttatgaatttgtgttgggctgcattcaaagctgccctgggccacatgtggcctgtgggccattggttggacaagctcattctagaagaatttttctggaaactgcatgaagaacagacttgtacagggaccagaatgaaagcaagaacggtggtaacagtgcaggtgagaggagatgaggacagtgccgggtgttaaggtggtgctgagagtggtcagatttaggatctattctgaaggctgggctcacagcctctgctaccaaaatagacatctcatggaagacaaagggagagactgagaagggagaaagagaggggaagagagaggggggagagggagagaggaggaggagagagaaagagagagaggagagagagagggagagagaggggaagggagggagagagagagagagatggagacagagatagtcagagttgggggagagagaggggaagagagagtgggaaagagagagggagggaaagagggagggagagtgaagaaaggggagagagaggaaggagggagagagggagggaaagagagaaaggaagagagagaaggggagacagagcagagggaaagagagagggagggagaaagagaggggaagggagtgggagaaacagagaggaaggagagggaaagatgggggaggagggagagaggggagagagagggagacagagaaaaggggagagagggagacggtagagagacagggaggggatgaccaactgttaacacttaagcacttcgctctgtcaacactgttaagtgttaaactgttaacactaggagaaaggtatatgtgttcattgtactagtgtttacacttttccataaatttgaatttctttttttcttaagagccactgacttttaaagccacttggccttgactttctgttcaatgagcaatttgtccggcccatggccaggcagtgggaaatcaatggtcgccatcaatcccgggactcccgtggccacatggctgctcccagttaacgtttctctccaccctgccgtcccgacgggtgcctggcagtgtgcgtggaggatggaggtgtgggtgaggagtgcagcaaattccctctaggacttgagttaggatgtccagtcctgggatcccctagtgcatccttcagtggggcaggtgcaggggctcccctgatgtttatgtcatccttctccaagcagggtttctccttccatttgcctgtccctctttttttttttctttctttctttctttttttttttttttttttttgagacagtcttgctctgtcacccaggctggagtgcagtggtgcaatcttggctcactgcaacctctgcctcccgggttcaagcgattctcctgcctcagccttctgagtagctgggactacaggctcatgccactatgcccggcttatttttgtatttttaatagagacgaggtttcgtcatgttggccaggctggtcttgaactcgaactcctgacctcaggtgatctgcccacctcagcctcccaaagtgctgggatgacaggcgtgagccaccatgcccggccatgttcctctttttcttgggcggtttttggcctagaagctcatctcatcaattgttctcctgccaccagttctctgcgatgccagctatgccaagatctccatttgctgccaaggagctgttcaagccaccctgttatggaggctcctggcattgggatctgcagcctggctttgtttagtttatctgctctctggttacctaatgtctcattgaataggtcagcttctgtctcttccaattattttcttaagaaggcaacaaggctttccttttggcctctctaacagatgcttcatcaatcttgatcacatacttaacccacattcgctggctttctcccatgttattataagtttagaaaatccacagtaataaatggcagatctttttaaactcttgtaatatatcctctcttagctgagatgtgacttcagaaggatcgtttgtatcctaattcattgtttccctgtgtatattccaagccgtaagttctctgaggacagggatttattcttgtctgattctctgacccttaaactgtgtctgatgcatcgtagaaattcaataaatgtttgtgtaatgaaagaaatgtccctattgctacaaccataaccccttgttaattgggccatcattcagaaggaacaagccatttccccggagacataagacggttaacaattcacaaagacttctctggcctcttcagccttcaatgccattgttatgcaaaaagtatttgcaggggatatttttgggcaggctacatttactcagcgactacccatcaagcgattttgctttcatttcacaaatactttggggagccagggagccgagcactgtgctgacctccaaggataaaagatgaagggcggaggatcatttgaggccaggagtgtaagaccagcctgggcaacatagtgagactctgtctctacaaaaaattgaaaaattagccaggcatggtggtgtgcgcctgtggccccagctactgaattggctgaggtgggaggattgcctgagcctaggaggttgaggctgcagtgagctatgatctcaccactgcactccagcctgggcaacagagcaagaccctgtctcccaaaaaaattaagacgaagggccacttgttgctcttaaggtatacccagcatcttaggggaggaagatcccaacacacaaatgagagtcaggcaacgcagagaaagataaatgccatgagaagaaaggcgaaaacattacctagatagagtcccacttctgaaacgatctcaaaagctctcaggaaaagaaattcgcaaaataaaagaacaatgatatttgtagagcttattatgatccaatagcctttgacaaggcagagattgtcatcacctgtaaagcacaaaatgtactcctcattccgtagaggattccgaggctcatggagggaaagggacctggcctggatctcacagctgagaaggcgctaagctgggaccccgccccaccaacctcacttccccactgggtggttctgtctggggggatttggtgtgaggcactggttttcagtattggttgaacagtagactctcaaaccatccctaaattctgactcagttggcctggggtcctgctgtttctaaagcaccctgaaaaacagtaatgaaaattactgtgcattagtgatgtcttttcattctgtatttaattaattattaattaattaagagacagggtgtcgttctgttgcccaggctggagtgcagtggcacgatcacagctcactgcagcctcaacctcatgggcataagtgatcctcctgtctcagcctcatgagaagctgggacttagagacttaagccattgtattctacctggtcctcaaatctattttaaagcctttagttaggatattatgcagtgagcattatgggcttattcaatgaatctaaaaatgacttagagacagggaataataaagaggccactctggcaggaacagtttcatctgtggggaccctggtgtggagcactgcaagtgatcttgtgatgtttttgcaaatgctctggaagaaaatgtgcccagtgaagtcactgacgcagcacatgaccttggaccttcccgggtggtaggatgtgaggccagtggagaccaacattaggaggtgttccgggctgagcgtgtgagcagggaagtggcgaataagcttctctgaggcaaaccctggaaatgcagccagggaaaaataacttggagatgtcagctgcaacccaaggaaggagcgagaaggccctgtgcagtcctgctggaacatgtcagctgagatgagatcagaatgctggaccttagcaggcagggcatcaggtcattggaggacagagttcattattccattgctttcgaaatgcctcatcttccatcatttcctccccaaaccctgcaccccagtactggtggctcctcttaactttttgtttttttagatggaatcttgctctgtggcctaggctggagtgcagtggcatgatctcagctcactgcagcctctgcctcctgggttcaagcgattctcctgtctaagcctcccgagcagctgggatcacagtcacccgccaccatgcctggctaatttttgtatttttagtagatgaggtttcaccatgttggccaggctggtcttgaactcctgagctctagtgatcctcctgcctcagcctcacgaaagtgctgggattacaggtgtgacccactgctcctggccatcctcttaacttgtgtaactgtgcttctgaatatcgtctttccctccacagcaagtacctctatcttgcaaatttccagcaccctttaaatcccaacttaaaggcctccattgagctggaatttaaagggtggaatttaaaggtagaatttgcaagatagcaagtagcactaccttgcaaattcccagcaccctttacatcccaactcaaaggcccccttctctaggagacctcacacaaccatgcaccgggccatgactgctcagaatgaatcaccccaactctgctcagacctgtggaaagtgcattaaaatgatctgttcaatgtttgcgtcatgcacagtgagctactcataagcaaggggtgcatcctacacagtcagtactcaatacttacttatgggatgcaccaatggagagaagataaactgtgtttcaagacagacacacagagctgggaaaggtcccaagtcagccacgatgaccttggggagggaggagccaccacagagatgcatgtctcttcaggatggaagaaagacggctaagataggtgcaagagacgcatccaaatcctcgaaaggtatggagaaggtgaataaggccagctcaccacatcacagagtcctggaaaaaggaggcaacttttgatgtttgaaaaacactttaggctgggcccagtggcgcatgcctgtaatcccagcacttccagaggcccaagcgggaggattgtttcagtccaggagttcaagaccagcctgggcaacatagtgggaccttgtctctacgaaaaatttaaaaattagttgggtacggtggtgtatgcctgtggtcccagctacttgggaaactgaggtgggaggatcactcaagcccaagaggtcaaggctgcagtgagctatgattatgccactgaactccagcctcggcaacagagtgagatcctgtctcaagatataataaaagaaaagaaaagcttaaaatttgttttttcaaatgaatgaaagtggccatgaatcattgtgggtacaaagtatgctttaaaaaaatcagctttgtttttgtaaattacatacaattaaatgcaactattgtggtcatgtagttccatacattttgacaaatgtatacacccacgacaaccatgtaaccatcactgctatcaagacagggactatgtctatcacctcttgtacccctttaaagtcattcagctgcatcccccaccttgggcaaccactgatctgctctctctcactctagattagcttgttctacagcctcctgtgtgcatttttgaggctatattaattccttcatcattgtgtttttgagattcatccctttggtgtgtatcaggagttggatcttttccattgctgcatattattccatatgggccttgttacagtttatccatttacctgttcaaggtatttccgttgtttctagcttgagtctattaggtataaaactgctgtgaacattgtgtacacgtcttgttgtggatgagacacagtgttaattaaaaaaaaaaatgaaagaatctcagagctgggcccgggtgcggtggctcacacctgtaatcctagcacttggggaggctgaggtgggttgattacctgagctcaggagtttgagatcagcctgggcaacatggtgagacctccgtctctactaaaaatacaaaaaattacccaggggcatggtaacacatgcctgcaatcccagctactcaggaggctgaggcaggaaaatcacttgaacctgggaggcagaggttgcagtaagctgggatcatgccactgcactcccgcctgggtgagagagccagcctctgcctccattaaaaaaaagaatctcagagactcagagctggaagggagagttaagcaggacgttaacttgctaaatccaaccctcttcctgctgccttccctcctctatcacacccctaaaaactggctatttggtctccatttgccccactgacagggaactcactacctcctaaaatagcctattcagtgaatgcttccattgctagaaggtttttttttttttctttttttttcttttttgaggcagagttttgctcttgttgctgaggctggagtgcagtggcgcggtcttggctcacaacaatctccgcctgccaggttcaagtgattctcctgcttcagcctcctgagtagctgagataacaggcacctgccaccaagcctggctaattttttggatttttagtagagacaggttttcaccatgttggccaggctagtctcgaactcctgacctcaggtgatccccctgcctcactgaattgcaaatggccagtagacagggttcgccctcagtggtgctacagtgaaatctaacttatctacatagtcagatatttgaaaacagcctcaaattcacctccagtcttcccccatttaggctacatgtcctttgttctgccagccactgcaaccaagactgactctagctcgtggccgttccttttgcactgcaccatgaggagctgaacacattgccccagccacagccaggccggctcagtgctggccagaaatccctgcttctgcccaccatgcagaagtgactctcgctggggaccaccaccacacatcgctgactcccacagagctcacaggcagcaccacagcagcctccgggcgtttctcacatgcgctgctatcaaaccatggccccacaccctgtgtttcacacagtggggagcagatttatggaaatggaacaggcttgcaaatacagatagcttcaaaaatgactcagacaacttcatggttgagagacccgtaatggcttattacggcaaactgggatgttctgttgtgtatttcttgtttttccggctgacatcaagataaataactgtgttggactgatggtttctgaggccccttccagctctaaaattctgtgactctttgtcctcccaccaaatgttctttggtgccaatgttggccccagaatgaagccaactggaccagggacggattcaattgtaacgttctctgcaaggagaaagtagaggaaagagaaaggaaggagagggtagcaagaggcagcattactaaaaattccaaacaccattcagcatgagttggacaaagtctgttctcctgcatctgggggaagacagttgccagcaccacccacacattaaaccataacttactggagtttccttactgtttattataaagtgaagtgtattcatcttgggatttttagaagcaaaaggataattttaaagaaaaagaccacctttaattctatacaggaatgactaccattaatatctcagtgcatttcagccagatgtggtggctcatgcctgtaatcccggaactttgggaggccgaggtgggcggatcaggagtttgagaccagcctggcaaacatggtgaaaccccatctctactaaaaacacacaaaaatttagccaggcgttgtggcttgtgctgtaatcccagctacttaggaggctgaggcagaagaattgcttgaacccgggaggcggaggttgcagtgagctaagatcgtgccactgcattccagcctgggcgacagagtgagaccaggtctctctctctctctccatgtgtgtgtgtatatatatatgcatttccttccaattctttttaaatgtttatttatctttagatcaatctatccatctgatatagtttggatctgtgtccccaccgaaatcccaacttgaattgtaaactccagtgttgcaggtgtggcctggtgggaggtgattggatcctgggggtgggtttctcatgaatggtttaacaccatctctcttggtagtgtcctcacgatagtgcgtgacttctcgtgagatctggtcatttagaagtgtgttgcccctacccccccttgctcctgatttcaccatgtgacatgcctgctctctcttcaccttctgccatgattggaagcttcctgaggcctccccagaggttgagcagatgcctgtgttatgcttcctttacagcctgagaactgtgagccaattcaaccccttttctttataaattacccagtctcaggtattttatttatggcaaggcaagaatagcctaatacaccatccaacccatcaacatatgcccatgtattccaatttttgcaagagaaaaatggcataaatgattttcccaactaacactgtcttcaccattttcccatgccattaaaatttttttttaatttttattttaagttctggggtacatgtgcaggatgtgcaggtttgttacacaggtaaacatgtgccatggtggtttgctgcagctatcaacctgtcacctaggtattaagcccagcatgcattagctatttatcctgatgctctccctccccagaccccactgctgacagtccccagtgtgtgtcgtccccctccctgtgtccatgtgttctcattgttcagctcccacttacaaaagagaacatgtggtgtttggttttctgttcctacattagtctgctgaggatgatggcttctagctccatccatgtccctgcaaaggacatgatctcgttcctttttgtagctgcatagtattccatgatgtatatgtaccacattttcgttatccagtctatcactgatggatatttgggttgatttcatctttgctattgtgaatagtgtggcaaaatattctttcaaaatgtaaactattcaatagcattccatgaagttgataaactgtaatgtgtctcatttttcagctcccacttattaatgagagcatgtagtgtttggctttctgttgctgcattagtttgctaaggataatggcttccagcttcatccatgtccctgcaaaggacatgatctcattcctttttatggctgcataatattccatggtgtatatgcatcttagacattcaggttgcttgtaattttttcctattaccacagtgcagagacaaccattcttgtacatggatctttgtattttcagttattttaaagatacatttgctgaaatataatttggggccaaaaaatatgaactttcttaagacttttcatatgtatgtgtcacccacttattctccataatccctctgtgcctctgcagtcatgtgcttccttcctctagtaagttttcagaataatggagcaggtcaactctcagttttatgccctcattgaacaaaacccagaagagtgaaaggtaaaaatgacatgcaaaatactaaatttctctccaaggattctaggcctcataagtgagggaaaaaacacaaacagtcagaaagaaaactggagttaaactgacataattgaaacaaccacatactaaatatcctggtggaagccagaatgccaaagagcattgttatgtcaagaaaatgtcccttaagcaagaatggcaggtccagtaccattaatgcctggcagctcttagagacggtgcccacatagctaaaggaacctagtcccttgctgtgttagttagtgagggctgccatagcaaaacaccatagactgggaggcgtaaacaacagacatttattttctcatagttctagaagttggaagtctaggcccaaagtgtttgcagggttggtttttctttggcctctctccttggcttgtagatggcgtcttctccctgtgttctcacatggtccctctgtgcatgtctctgtcctaattacctcttccttttttggggggcagtggggggagaaggagtcttgctctgtcgccagactggagtgcagtggcatgatctcggctcactgcaacctccacctcccgggttcaaacaattctcctgcctcagcctcctgagtagctgggactacaggcacatgccgccacgcctggccagtattttgtttgtttgtttgtttttgttgttgttattgttgtattttagtagagacgggggtttcaccatgttgctcaggctggtctcgaactcctgagctcatgcaatctgcctgccttggcctccctaagtgctagaattagaggcgtgagccaccgcaccccgccctaatttcctctttttataaggacaccagtcagattggcttagggtccaccctaatgacctcgtttgaacttacctctttttgttgagacagtgtcttgctctgttgcccaggctggagtgcagtggtgtaaccatggctcactgcagcctcgacttcccagacttaacctcaacctcccaagtagctaggactacaggcatgtgccaccatgcctgcctaatttctaaattttttttttaatagagatggggtcttactgtgttgccaggtctgatttcaaactcctgagctgaagtgatcctccagccttggcctcccaaagtgctgggatcagaggtatgagccaccatgcccagccttaacttacctcttcaaaggccctgtccctatgtagtcattttctgaggcactggggattagggattcaacatatgaattttggtgagacataatttagcccataatcctcacctagtagaaggactggtttatgtggacagggctttgtgtttgtaatctggtttcaccagcttctaatgcaggaccccaggcccttgcaaagtacccttccttcaaatatttctgggagtccttcagggagtatcaagcagattgtactttccatgatggctgcaacactatctcatatcttattagctattctgcagtgtgaccttgcctttacccacatcaagacgtagagcctaatatccattcctctggagtctgggctggccttggtgacttgcttgcaaccaacagagagcagcagaaatgatgctccatgatctgtaaggccaagttagaaaaggccgtgcagcttccagatattccctcttggagtccagctgccatgttgtggggaagcccaagccacaagaagccacaaaaatgcactctggctcatagcccacactgagcccagctagcaagtgatcccagctcaggcatcccagctgagggaaatccccagccacttcccagctgtgccctgaatggattcctgagccccacaacctgtgagcatagcaaaatgactgttttttttttttttttttttttttttttttatcatttttggatgatgcagctaaagcctaaagaggtactgctgctcgcttaaagttattttgctgattaatggagctggattaaaatccagacctcataaattttcaatcagagctccttccaccatttattctttcaacaaatgtttactgttactagggctccacgtgctgttttgggcactggggaggtggcagtgactcctgaatctagctccagaggacagaatgaggactgatgggtgatccctgtggagaggctggttacaattcggtgtagacaagacctctggagcaaggagaactttctgcaaatggaatgaccttgaggggtgacacagaggagctggatgtctgggacagatgattggatttaataagcattgagatcagccccaactctcccttccaacttggggagtctattacttgcaaactttgtttctaaaaggatttaaagcaactttattttatttgactcacaactacctcttttcttttctttttctttttttttttttttttgagagatgaagtcttgctctgttgcccaggctgaagtgccagtggcacaatcttggctcactccacctcctaggttccagtgattctcctgcctcaacctcccaggtagctgggattacaggcacacgtcaccatgcccaactcatttttgtattttcagtagagactgggtttcaccataccggccaggctggtctcgagctcctgacctcagctaatccatccacctcggcctcccaaagtgctaggattacaggcataagtcaccaagcccagccaaaactacctcttttaaccaaggtgctctttaagaaagagttcttcagtcagtgtggtggcgggcacctatagtcccagctactcaggaggctgaagtgagaggatcacttgagcccaggagttcgaggctgcagtgagctatgaatgcatcactgcactccagcctgggtgacagagcgagatcctgtctcaaaaaaacaaaaagaaaaataaacccaaaaccaaccaaataaaaaatattaaaaaaaagaaaacccttctactaaattttatgatgtcgtctgtacaatatttgtcttgcctacccccaaagtagaagacagcatcaggagacataggttcaaatcccagctccacctctcactagctcggtggccctggacaaatgatttaatatctgagcctcagtaaagtggaaaaacacacttcccatcacacagggattgttgtgaggattaaaatacttatgtaaaaatcaggtggagagatgtctgttgaatctgttgctaaagcctctccttttcaccaagtaaatatctcaaactttctacatctgttctgccctcaaaggctcccaattccctccttacctcacattgaacaggtgacctagctattttagagagagagcgaagaaaacatcaggtgcatctccctaaatttcccctgataattcttctaactaagctatgacctctccctggttctttctgcagtggactagatagtcctcctccacgtaagactaaccctccacttcacagaacgttccagagatttgaggctgctgagctgttggtgaccaacccattctcctgggtccccctttctacagaacacaagcccatatctttcctgccatcttctgtctaacctttgcattaaacctcttgaaaatgtcatgtccgggcccggtgcagtggttcacgcctgtaatcccagcactttgggaggccgaggtgggtggatcacgaggtcaggagatggcgaccatcctggccaacatggtgaaaccccatctctactaaaaatacaaaaaattagccaggcgtggtggcacacacctgtgtagtcccagcaacttgggaggctgaggcagaagaatcgcttgaacctgggaggcagaggttgcagtgagctgagatcacactactgcactccagcctgggcgatagagcaagacaccatttcaaaaaaaaaaaaagaaaatgtcacgtccacctccagctcatgtctctaccacctgggactggctcaggcacccatcaacactgtgctcacggggtctttgaaggagctctcttgctcagcctacaagtcacttttcagtccttcactccttgtctgtgttgcccttttttttttttttttgagacagggtctcactctgttgcccaggctggagtgcagtggcgcgatgtcagttcgctgcaacctccacctcctgggttcaagcaactctcatgcctcagccccctccgagtagctggaattataggcatgcgcccaccaagcccggctaattttttgtatttttattacagacagggtttcgccatgttggccaggctggtcctgaactcctgacctcaagtgatccacccatcttggcctcccaaagtgcaggaattagacgtgagccactgcgcccggcccagtgttgcctttgaagtcatcttcctctgctccttccttctctgcattatacccaacatccacatgtctaatgatcgtatctgcctgaggatgtcctgctgacacatcacatttaacagattaaaatcaaacgtggcactgtcctccttatccctccaaaccttcccctccacctgtgttctctcccttcagaaacaaaatcgccatttttccagtttcctaagccagaaaacagaacgttatctgcaaacctctctttcttagctgtggattctctctccaagatagcttttttgttattgttgttgttgttgagagagagtcttgctctgtggcccaggctggagtgcagtggcatgatcttggctcactgcaacctccgtctcctaggttcaagcgattctcctgcctcagcctcccaagtagctgggattacagtgtgggccaccatgcccagctaatttttttgtatttttagtagagacgggggggtgtttcaccatgcaggccaggctggttttgaacttctgacctcaaatgatccgcctgcctcagcctcccaaagtgctaggattacaggcgtaaaccaccgcgcttggccatagatagctttttaatctgccacttctctctcgtcccaactgccaccattacttcatatttgaattgctgcaacggtctcctagcagatttcctggctcccaggcttgcccaatcccaacctagcccacaacctgaattacttttctttgtctttttcttttttccaagatggagtctcactctgtttcccaggcgggagtgtagtggcttaatgtcagctcgctgcaacctccgcctccctggttcaagcgattctcctgccccagcctctggagtagctgagattaacaggtgcgtgccaccatgccaggctaatttttgtaattttagaggagacggggtttcactgtgttagccaggctggtctttgaatgacttttctaaaagtctttgattctgtggtttttcaaatccccatgcctctccattgttctcatgctcaagttcaaactctgggcttcaaacttttggcaggtgctgttccttctgcctggaacacactttcttctcctgactgttgagggatgaactcttaactcgttcttcaggtcttagtttagacactacttcccctggaatagtttccctgattcctcaaggctgttagatccctgctctgatattcccttaggtgatttcacttatcatatgaatgcaattactctaattgtttatttcactcttgcctagtgctggggcaggcatcaatcagttatctgacaaacacttgctgaaaagtaggcatggaaggaattgctttcgactatgggtatcaagcttgagtgtatatcagaagcacctgggccgtgcatggtggccaacacctgtaatcccagcactttggaaggccgacgcttgtggatcataaggtcaggagattgagaccatcctgaccaacatggtgaaaccctgtctctactaaaaatagaaaaaattagctgggcatggtgatgcatgcctgttgtcccagctactcgggaggctgaggcaggagaatcgcttgaacctggggaggtggaggttgcagtgagctgagatggcaccactgcactctagcctagggacagagcaagactccgtctcaaaaaaaaaacaaacaaaaaaaaaaacaaaaaaaaaaaaaaaaaaagaagaagaaaagaaacacctggtgggctggttaaaccatagcttgctgggttccaccccccagagtttctgattcagtagtgtggggcgatgtccaggtgatactgataacagctggtcaggaaactctgcttcttgcaatttaaggcaccccgagagctgagggacagttactattaaaggcagctggtaggcatttttggaagcttggtacatttctggtaccgctcttcttcatagcttccttaataagagcatttaatcggattatagcttttgaagatatctcaggaaactaggtaaccaaagcacgcgccccattagggctcaaagctgcacctggaactgcgccctgcttgttaatgggttgccaggcaacagaacaaaggtgaggctgaggcgggatcagcagttggcagggatctgagagtgaaccactgaggcaactagaggctggagttctcatcaggacaggaccttagggaccagccattagggacccccaggatgtggactgggagccttgcattgcacacgggagagcatcacatccccaggtggacaagtgcatgttgtaagttggcctctgataggattggggattatttttctcagaagtagaaccatgggaacccatgggggagatttcctaacgacttatgggtaagaaaaaacttcttaggctcaccaccttccgcttcttaaaagcaagctttattagtgttttggtttttttttgtaaattatgacatacacattcacatttggaaatataaaaagtacaggaaagatcccgccactgcactccagcctgggcgacagagcgagactccgtctcaaaaaaaaaaaaaaaaaaaaaaaaaaaaaaaaaaaaaaaagtaccggaaagcacataattccatgtcccctgaaggaaattatatacattaggcattcatcctttcaaaaacaaaacaaaaaaaaagacataaatgagattatatatttgctccataacttttaaaacacagaactgtatatagcagacatttctacatcagcacttttaacagtcatccagaaatgtattgtgtggatatgccatattgcacttttttttttttttttgctactagtgatgctgcactggacaaccttatccatatgtctttttgcatgtgtgaggtataatagatcaaagacaattcatatttaaagtttaactaccggctgggcacagtggctcatgcctgtaatcccagcactttgggaggccaaggtgtgtagatcacctgaggttgggagttcgtgaccagcctggccaacatggtgaaacccatctctactaaaaatacaaaaattagccaggcatggtggcgcgcctctgtaatctgagctactcgggaggctgaggcaggagaatcgcttgagcctgggaggcagaagttggggtgagccgagatcacaccactgcactccagcctgggtgacagagcgagctctgtctcaaaaaacaaacaaataaattttaactatggattgcaggtttctctccacggcagctgtttagtttgtacttacactaagaataaatgaatgctcatttcctcatagtcttaccacacatttgccattatcagtcagtccttaaacattttttacaagcctcgttgctttaatttttcactgttaagatcaatttctggctgggcgcggtggctcacgcctgtaatcccagcactttgggaggctgaggcaggtggatcacttaaggtcaggattcaagaccagcctggccaacatggcaaaaccccgtctctgctaaaaatacaaaaattagccgggcatggtggcatgagcctgtaatcccagctacttaggaggctgaggcaggtgaatcgcttgaacctgggaggcagaggaggttgcagtgagccgagatcacaccactgccctccagcctgggtgacaggtgagactctgtctcagaaaaaaaaaaaatcaatttcttggtgcatctcttcatttattttctctttatatctctctgcctgttactattctttggtcttttgttttttgagatggagtctcgctctgtggcctggctggagtgcagtggcacaatcatggctcactgcaacctcccaggctccagtgatcttcccaccttagcctcgagggtacctgggactacacacacatgataatttatttatttatatatttttttgagagatgagggtctcactatgttgcccagactggtctcaaactcctaggctcaagtgatcctccctccttggcctcccaaagtgctgggactacaggcctgagccatcacacccagcctctgctcatttttctatagggcttgttcatctatttttcttattgactcataaaagctgtaagtcttattgactaacatagatagtaacattttctccagtttgttagttttttttcacagtgccatacagatgcttttggttttgaattggtatacagttcaagctactgatgttctagaaagttgcaaattgtccttttaaaataaaaatatttctatcatttaaaaaaggttctcttttatgtgatggcccataagaaaaaggaggagaaaggacagaatgaagcaaaagaggaatgagggctctattatattcctcagactcaacgggattgatgagtgattttcgaactttcatttacacaggaatcacttggagatctttgaaaatgcagagtatgagtcagcaggtccgggactgggcttgagattttgcatgtctaacaagctcccaggtgaggtagatggcccacgggccatacctggagcagcaggctttaaatcacaacaagggaaagcactgctggtttcatggatcatcctaacgacgtgaaaattatcatctgttttgaaaactcttccttctctctttttaattaagcagggaaaattctaacttcttattctggaaagtaggagatggccagggctcattgggggaaggagaagaagaaggagaaggagaggaacaggaagaggaagaggaagaagacaaataagtggaagaggaggaggaagaggaagaagaagaggaagaggaagaagatgaataagtggaagaagaggaggaggaagaggaagaggaagaagaagaggaagaggaagaagacgaataagtggaagaagaggaggaggaggaagaggaagaaggaggaggaggagaagaagaagaaggggaaataataataatcagttttcatggagtaacatccctccacctcatggcctttagcgtatatggttacaatttttaatggcaagtatgcaggtataaaatgctcacttcttgaggccctcttgtagggctgggcaaaatgaagttgagagattcactggccttaagggcagaaatattccagccccctcctggctgtctcccctccccagcattataaaggggtttctctgtattattgtttgagaaagaatagctgtagtctaaacacaggccccaaaatggtaacctaataggtcctgtgaaaagcaacatggtcggggcgaggaaaaacaagtctcagaacaggactcaggagagctggatgcttgttctggctttagcacggttgcttcgcatgtattaaactttctaggcttggcttctccaactgtagaatggagattagagtagaaccttatttctcaaggctgatattgggataggaagaaaaaaaaatttcttggagaggtttccagaccttctgtagtaacagtgaggtcactgatctgtcttttttttttttttttttttttttttttttgagacagagactcactgggtcacccaggctggagtgcagtggcacgatctcggctcactgcaacctctacctcctggattcaagcgattctcctgcctcagcctccttagtagctgggattacaggcgcccgtcaccacgcccagctaattaattatttatttatttatttatttattttttaactatagatggggtttcatcatgttggccaggctggtctcatactcctgacctcaagtgatccacccaccttggcctcccaaagtgctgggattaaaggcgtgagccactgcacttggcctggtcactgatctcttataacctggtgtatactaacttggctttccaatttccaagcaagtttccacaaagctttctgctacctgcaaaataagtcatggcaaaagaggctctgggtaattttgacgtgtcctaaagtcaagaagttgcttgagttatgttcgtgcctatgtggactggagcggtatatgggcacaggtttctacgtgaaagtggtggatatagatcgatactggagaggaaaaggttaaatgtgcagcaaactcaaatggcggggagagcaagggtagtttgggacaaggattgccacgttagtagagggaaaggaaaaccagcatttactgagtgtgaattatctcactctgtctactaccctggagatgggaattattcctaactttttacaggaacttggagtcagcgatttgcccaaatttcacaactacaaagggcggagctgagtgagacctcaaagccccatgactccactcttggatcaccagcctctatctcccagcaaagcagaggtggttggggtgaagaggaagggaggtgagctcccgaccttgggcaaaacacttcacttcctttatttatttatttatttatttatttatttatttatttatttatttattgagacagagtctcactcagtcgcccaggctggagtgcagtagcaaggtatcggctcactgcaacctccacctcccaggttcaagcaattctcctgcctcagcctcccgagtagcttggactacaagcgcacgccactacgcctggctaatcatcttcttcttctgtctttcttcttcattttcttctttcttttttcttttcttttttttttttttaactgcagacgaggtttcaccatgttggccaggctggtcttgaactgacctcaagtgatccgcccgcctcggcctcccaaagtgctgggattacaggtgtgagctaccgcgcccggcccacttctttatgcctcagtttctccatctgtaccagggccagcacctctcacacagcaggtagtgaagctgctgctgctgctgccctgggctggcctacagtgagtgctcactgcacaggaggtattgcttccccccgcccagcaggttctcattataatcttgcaagtttgaagaaacccagccttgctaccaacagaagataaaaacagacatgcctctctgcctccagtctcatccccatgtccttggggagctgtcctcttccggctcgtcccatctatgcgccctcactatatcctcagaacagggcactccgtggctcctttaacttttttgcccctcctagcatggtgtggaaagggggcagatgggaggcctctttctgaaaccacctcctgttcggcggctgtacttggacctcagtttccctgttttgttcacgtggtcattgttaagtcttaggggacgtgtacagaggctaatattgagccaccaatcagttatttgacaaataccataggcgctctgtgagcaggagctggctcctatcccagaccccagccctgtgacctgctctccactcgcccggggtctttcttggctgggacaataaacctactgcatcaggtgattcctggggagtcagccccgtgctgggctcacacccagcccctctgcgttcatctcttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggccgggctgtgaatggggagcggcggccgcggcagctgagggcgagcgcgaccgcgacgtgcgggcgggcgcactttcttctcagcgccgggcgggggcggcggcggcggcggctcctccgcgcccggcggacccctcggagctagcgcggcgggctcgggactgcgtgagcgccggacgcgaatttcccccgttgacaacttcttctcgcccggctcgtccccggcccgcgccgcgcccctcacgcggggacccaggacgccgcccctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctgccagctagcatcgttttcttttgaagtttgctggtctttaaaccaaaacacccccctcaacccagaaataactattttaatacgtcctttggtaacgtctttaaaacacattagtgaactggttttgctgatggtagttttaggaaaattaacttagttgtattccaagatacagctaacgaacaatcatggtaaggaactcgatattctgagattggcgaagatgagagcattaaacttaaattagctgtgttctgtgtcctgtgaagatgatttatgtgtagtaacatgacttaaatgttgtaacattttaaaggtctgagctcaaaactatcatccaatagcttaacaacgaactcatacttttttttattgatgcttatgtaacgttatctaaattgtgcccctccacccccctccagctttcataaatgctccctcttatgttttactacatgaaaacaaattgccatatttctggttaatttaactcctccattacttggaaaattttcatttcacttatttgtgctttttgcttaatgacttactctggaagaaaagcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctgtgtgtttaattgcttgtgactttcccggattcctaaaaagccaagtctttaattctggaaggcaggtggcaacacatgctttctttatgccatccaccaaggagccagctgtgagtggtttggaaggatgacttctgaggctaaagatgtataagcagtcttatgtgtgaagtccgtggtgcctttagctttactgctggactctttacaggcttactgattctggcagtgttcagtagacctcctagattcagcttgcattcctcaggcctagaaaggataggaatgttcttgtccatggggctgtttgttcatagtcctcagtttctcatttgaaattgtctccacttggacctatggttctccagctttggtatgtgttagaatcacctggggaatttgatgaagctgtagagtacctactcttcctcttccatgagccacatttgctttccatgtgattataatacacattggaattcgagaactactcacttattaccttgtgtttccccctattccagacacctgctgacttcctggaaactctctagcccagtgtttctcaaacttggttgcacattggaatcacctggagctttaaacttctgatgcctggatgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctttcataacataacatgaattccagcttcatgatggtctgttggcagagattagaccaccccagaatggactactgggagtgcaccaactatttatttgaggaacatttggaaaattcttttatctgcactgaagtgtatgaatttgagtcctttaactaaaggaggtggagtttgtaaggtactgatcttttattagtttgccttagcacacattttatgtaaacagttaagtttaggctatactggggtttatacctaaccagaagtttcctgggccctcaaatactgagataaaacaacgtggaaggctgcaagttaagtgggtaattaagtgatatcaggtaagactgtgtagtttaattctccctaccagttgcctttatgttatttccatcctcagagcccctgtattgcttgtattggaatacataggatttggcgtctaaggtggcagaggtgtgtggcatgtagtgtctttctgcctgcctgccttacggtgtcccagagatcagagactggtaatgtcagctgactgaaactagagaatggaatggacacaaagtgaggattctgattaggtcacggcttaaatttctctaagaagtaaagaaagtggtagttatgagagtagacctccaggtccaaatgcgttgaaagttgaattaagctcaaggtggggaatgaaaatcacattgaaaggtgtagtataaagaaaaattaaggtttatttacaaaagaaagctattgatgttttgttatttgattaaatactcctggtacccaattatacatttaacccaaagtaaccgagcattttaatttgcatagtttctaaaattttatttgacttcatttctgtaaggcattatcttaaatttccccctaagtatgtacacctcttttttttaaaaaaagggcataaacgttcgtagccataatcctgagggaggacatattttgtcagttgggacagcaaatatggcacctcctgccatcctatggtagcaagtagaaagaagctataggttcttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtcagttttgtcttctctctaggtgttaggcgcgatgcaaaaagaatgaaagagattttgatagggtatgaccaagcccttctatacaatggatgtcagtgttgatttttatacacaaaccaccagatggcaacagaaaaagtgttcatataggatataatctgtggtttccacagccaagttttttttttttttccttccatgattcaccactttttagtatgcttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatatttgaactgcagtagtattgggatggaaaaaatggaatggtcagtcttgcttagagaggtaaatagatgagaacaaaaggccattggatttgttgattacatgggtaatggtgatctttttgagctcaatctcactggagttctaggagtataaagtagattgaagttcattatggaatgaatgggtagggagaaaagagtcaaccggtatgttcttgttctattgaaattctcaaggaaagagaactatggaggcatttgaaatgcatagtgacaaaaatgatcttaaaataccttgggaatattttttccaaatttgaaatctattattgaggctgggaaaaaaaattgtcatttggcagaatggtaagtaattatcacaattctctgaagtgatcatttctgtttcatatgttgcgactcgtggaggcttctagcaacattgtcaccaaagctgaatgtggaggactcccttcaccaccctgctataaacacacagaaactgtggacaaaatataacaagaacaaacaagcgtttctgaagtttaaaataccagggaatccctaggtgccagctatgaacagaaaattcagagctagggcgttaatcaggagctcaaggcctgtggtggtttctgatctgaatacacgccccaatggcttagtcctgagggtctcatggaggagtaggaggcatggccttgggtctgcatagacttggaaggtggagtaaaggttctctagcatcaaaccttgaagggcttttccatctgtgaaaagagaactagaaaaactttgcctactggtttgggaaagtgtaggaaacttgctgtcctcctggggttgtgatcattaggaataaaaaagggacatctaaactccaagattgcacctcataattggggtggattcaaatttaacatttcttatagtgcaactaaccttcaagctgagacaaattagcataaaatctggtctagaactatggaaatgaatagagccctcaggtctgaaactgacctgcagagcaaattaaaaatctaagactcttgcagaagaaacaagtcatgctatagatgagcttgcaatacaaaaattgcccagctacacaaggaaatgaatcaccgtgaaggagagttagcagatgaatagtattccaggagattgagatgataggatatatgaaagagattaattgcttaaaattatgagagatgaaaggggtaagatcataatgaaagagcacagattagaaaaataacatggagttggaaaagaacccagtaggacttctagaaatgaaaataatggtcattaagtgtttttttttaaaaaaaataacctcaatggacaggttaaagagccaggtagatataattgaagataaaaactgtattgaaaaatcaatagatttttaaaggagatctgaggaaatttcttcgaatacagtaataagggataaagaaatggaaaatgagtggttacaattcatgaactttagaatgaggaagtctcatattaccttctgtgagcttccagaaagaggaaatagagtaggagagacactattagaagatagaatggctgagaagttttcataatcaatacaagttctgcctgagctcttagtttcaagaaccgtagtaaaccccacacaggataaataaaaataaattcatacctagacatattgtagatgaagccttagaaaataagaggaaagcagtctgaggaaagttgatgtctagactggcaggcattttgttcatagcagaagatgattgaataataacatcaaaggctggaagtggaaatccactaccaacctagaattccatgtccatataaagtattatgatactcaagagtaaatgaaatggctgggtgtggtggctcatgcctgtaatcccagcactttgggaggccaaggtgggcagatcacgaggtcaagagatcgagaccatcctgaccaacatggtgaaatgccatctttactaaaaatacaaaaattagctgggcacagtggcatgcacctgcagtcccagctacttgggaggctgaagcaggacaattgcttgaaccctggaggcggagattggagtgagctgaggttgcgccattgtattccagcctggcgacggagcgagactccatctcaaaagtaagtgaaataaaggttgtagataaaaaacaaagttgatgattagtagttggaactactaaaaaatgcacttcaaaaagaaagaaattgaacccaggagtgaggtacagattgtaaagtgctaaatgataggaagcattgttgcaatgtgccccttaaatttatatgtaattgctttgcagtttgagaaaagtgtcagcagtttccactacaagtactcatactgcagattaacggattagcgagagtgtaagcagtagggacgggtttgggagatgttggtcaaaggatacaaaatttcatttagaaggaataaattcaagagatctgttgtacaacatggtgactataattaatgataacttgttttattcttgagttgctaaaagtaaattttaagtattcctaccacaaaaaagtatgtgaagtaatacatataattagctctatttagccatttcacaatatatatgtgtcaaaacatgtcgtacacaataaatatatacaaatttttgtcaaaattttaaaaatgtatgtgagcaggagttaattcatctaatgcctcagtgaataaagtgctgtgttaaaggtatagtgatcaataacagttgcttccttcagagagcttatagtttattagggcatacacaccaaaaaatacagcgccaatgtgcagatgaccctggagagccctttaagccatacaggggattcagcatctggtagataagtgttaaataggaccctagcagggatacatataggcaagccatgttggaatctggggactcagattggcacgtggaaatacaaagatgaaggattcaggtggaaagctgctgatcaacaggagtgaggaacccaacacctagatcagaacaggattcttgccaaaggaccaaacatcaagaccttcatatttagccagtacattccaagtgacctttacattctgaattagggtcttattgtcatagctgtaggaaatgtggacttggatcttggccagcagagagttagattaaatgtgcagggtgaagcactgttcagagctgagataaagcatacacaaagaggcaagtggttgagatggagcagctcagtggatgagagttagttacagatgagattgtagccatttgcatttttgtggcaacttgatatgattggttgatgctcatcaattcctgaattttgaaaattacttatatctgtatcatggaatgttatagttggaaagacagaggccatctgcatctctaactttgctgtcttctgtggaatgaaaagcatgaaatataagttgtgttatgcttttatatagatgaatacttcatagcaattaaaatattataatctagtgttttattagatgtagagatgccttaagaggttttattttaaacccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaatccaggcccttttaaatatataactcctaaatgaaagataccagacccaaacattatgaaaagaaggatatttggggagtgcatctctcatttttgatcttgcatgttgtgttgtatggaccttggaatgtaattttctgtagaaatatttgaaaatgtaatttgatacccagtccacactgcaaaagcctatttttttttttttttgtcagggtcttgctctatcacccaggctgtagtgcagtggcacaatctcagtttactgcagcttcagcctcctgggctcaagcaatcctcccgcctcagcctcctgagtagctgggattacaggtgtgggacaccatgtctggctttttttttttttgtagagacaggtctcactatgttgcccaggctggtgttaagccctgggttcaagcagtcctcctgctttggcctcccaatgagttgggattacaggcatgagccaccatgacagatatagagacacatatggagacacatagagatgtgcatgtaaaataggcccaaaagcctatccgtatgtgtctctctatctgtatatacatttctttctgtgctatttaaaatacatgcagtcactgtgtgacatattacatttcaagtgccaacttgggaatggtggaactctgcctctcaccttgaggacagcccttctttgcagcacagtcaatgactaggaggacagtaggcctgtgtttacatctgtgcaagaatggcatctgccttcatctccgcatgctcctagagaaggagccgtttcagcgagtcacttctcaggtattctaaatttggtaataaaaggacttgatgcactccaggtgcagtttctctgaccatatcaatgttcttaatttttttttgaggggaggggactgtgtcctaattagtaattaaggttattttgatagcaagtgttagaaaaatgctaattccaagactacaagcgtatttcacattctgaaatccaggtatcctaagggaccatggactggaactccactagatactactcagaagcttcgtccgcctcatctgtctctacttttacctctgtgacctagaggtcacttgaaacaagcttcctcctgctcgtcagcttcattcctctctttctgatgactgtctttctctagccatctgagcctcctgtcctatgtgacagtctcagctcatgactttccatcccctcagtttcaagagtgtgtctgagacctgattccagaatcccaaaaggcagaatgacattgactgacccaactggagttcgttaggtatccgtggcttgttaggaatctatctctagtaggaatgtctgctgccctgggggccgaatcctgcctgtgcatgacctgctagggcccatgcctccggtggatggaatgaagcaaggatgggggctgcctgcagagctgtgtcactcacttgtattcagctttcctgcctctggctctctgtcttttacctttttttgttcgtttgtgttttgagatggaatctcgctctgttgctcaggatggagtgcagtggctagatcttggcttactgcaacctccgcctctcgggttcaagtgattcttctgcctcagcctcctgaatagctgagactacaggcacatgctgccacgcctggctaatttttttatttttcatagagacagggtttcaccatgttggccaggttggtctcaaactcctgagctcaagtgatccgcttgcctcagcgtcccaaagtgctgggattacaggcgtgaggcaccacgcctggccttttatcacttttaaactaagaaaacaatgatcaccatacatgctctgcttccaaactatactttcacatccaaagtacccccagatcataaagtgccaccaaagagctgtgatatgaagaaagaccccgggtagaatcactctgaaaatgtgggaggtttttttttttttttttttttttaaagcaaattcattttacttagccagaatcctaatagcctgctgatttttgtagatgattactctgaaaacatatgcattggtgtggtctatgagtaaggctctgccttttaagtcacattctttgctgcttcattgcaatgaaaaataccaaaggtgaataccaaatcaattttttttagtattgtacttgtaaagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatagaaaaacctgtgtctggctcaaggtaatacttgaattttaataggaacctaggtttgctgtcttcccagtgtagactgtagcctgcactgtcatagaagagtgttgattgatccggttgtgaaatagatggatacccacatttaagttgcttttgaaagagtcagtttccctccacaaatatggcaacaaaattcttttataatccacaaatagaatttttcttcatctgaaagagatttctcctaaaccagcctgaaaaattgcttttctaggaagaatttcatggctgagcctcattcttgtacagattcatagcatgttattactaacttgtaaatattcacttacagaagagagtgactagaatctttgaattcttttatattggtgttgaggtttctatccaagttacgcagtttttcattcattttagaggaagattttctcaaacaaggattcttcgtggttgcaaaacctatccccagagattccagtcaacataattcaagttgaccagtggattctaagtgtgacagtacggtgtttagcaagtccaagtgaaaccagatggaggtcagagaatatgcctggcttcgtccacattatctagttatctgcctcaaccctctagtttcaaccagcttcaagtgaatgttaaaccagactgctgtaatctacacatgctttcacacttcaaaaggtgtgtgttagttgatatttggtttagtcatttcgtctcttgagaggaggggttgaagtttttatttccagtagtattttattttattttattggatgaagttgtttttatttcttttctccagaagaggtaaggaaggttcctggattattgtatttggttggtaaactctcctctttttctctttctgtgtctgcatctcctcctttttctctttccctatttcttcttcctcttccttaggtttatatgaaatagaaacaattttctagcacaatgactaagtgaattgctacattaaagactggctggccaagaaatggttaatctttgtatggcaggctttagggaccaacatcaaatacaaacatgttggaaatctttttgtcattccagctcaattgattcagaaaaattttaagagcaatagtcagtgcttggaggaaaaaagaatactattgtaaatttgagacgttctcatcttgaacatggctcttgtaaatcacaagcttgacaaccttacagagtacatacaagccgtggttgacttcagaaatatgtgttttagacacagttttacatgaaagtcatgatattgtaaatataatgatttattaataagtttaacttttgttaggatactttgcgcataactaccgcaatgcattaagaaggaagtgttaagaattttcatcccacagatctgatgatttaaagtagtgttccatttgtgcagtcaatagaaggaggtgcaacaatgaaacagaaacaaggcaaaatctatccatatgggctcatcttatgacctgttcttgctggtaattttggcgtattttgtgatgatttttttttcctctctttttgaaggctcagtagctgtactactcactctaccaggccaaagagtcagcgtgatggagagaagattaggaaatcatgttttaaaattcttctaatgcagatgaatatgtcaacatgatttttctttcatcaggagcctgtaagagaatttccaccttgttcgccttggttttggtatatgaggtggactttttacttaggtgtcctccctgttgttttgaggctatgtgccctacgccactgtggtttaccctgaggaagtttgcgtagctcgcgtgccaaccacttctcttggagaagacggagtgtcataactacagctaacatttattaaggatcttgcatgtttttcattttaatcctcacagctccttaagtattatctccattttgtagatgggacatctctggctcaggctcaaagatgttaagtagctcacctaaggtcattttgccagctaagtaaccaagctggggtttcagcccaagccaactttaccgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatcccattaataagatacaaagttatatcccaaaagtaccaaattatgtaattctttttctgattagttcattgcaacttgttcagcttcaaataaattaaagatttcttagttattgtgattcttaataattttgcaaaagtctctgtatttttttttttgaaatctttttctcattatttatggaagatagtgattgggagaaagcaaaatattaggcattaaaacagattatactggagagatctattccagtgtgatcaccaaatccacctattttgatacttgacttatgaaggggactgcctttttttttttttttttttttttttttgagacggagtcttgctttgttgcccaggctggagtgcagtgacttgatctcagctcactgcaacctctgcctcccgggttcaagcaattatcctgcctcaggctcctgagtagctgggactacaggcacagacagtcacgcccagctaattattatgattatgattatgattattattattattattttgtattttagtagagacggggtttcaccgtgttgtccaggctggtttcgaactcctgagctcaggcaatccgcccgcttcggcctcccaaagtgctgggattacaggagtgagccactgcactctgtgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttattttcaatataatatggttcttaattgtaacattaatgaacactgaagacatttttaagattcatttatgtaaagtgatttgatgaagtaagctgacatttgatggacttagtggaagtttagacccaatttgcatttcagtggtattttatggctgactttagaaaactttttagataggatttctcggtaaattaaaggatttagagggatgattacgaaataattgattaaaaagtgtgcaatattggttttcattgaacttaagcttgtatgggttcaatttaaaacctaattcaatacattttagattttatatttccctgaacctcttctgctgtattaattttgtcatgcttgtcattctaatctaatgatgatttaatgtttgcaaacctgaataaatctgtatgcaaggagttttgctgtgtttttaatcaatgaagattgaaatttggcaactgaggtgataaaaaatgaaaaattttaaatagaaaatgaaaataatgattatactttagaaagtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggggctgtcacttagttggtgtgggacctctcatctctattgccaacccaagtttttgattctttctttcctcagtaaactcttaatctttctgtccttggaatcttctcctttcacttcaaacaactcatctgtctttatcctgaaaagtttatactttactaagttccatcattggcagcaaccctgttttcttcccctttgtattaatattttttttttttttttttttgagatggagtttcactcttgttgcccaggctggagtgcagtggtgcgatcttggctcactgcaacctctgcctcctgggttgaagtgattctcctgcctcagcctcccgagtagttgggattactgttgcctgctaccacgcccagctcacttttgtatttttagtagagatggggttttaccacgttggccaggctggtctcaaactcctgacctctcgtgatcagcctgcctcagcctcccaaagtgctgggattacaggtgtgaatcaccatgcccggcccccctttctattaattatccaacatctcaaatgtgcagttcatcacatttttggggtggtggttagacacaatatagttaacctatttagataaataaactcttttatttcccctgagtgaacatttcatctaaaacgtgtgtcgctttcttgcttaaaaaccaataaagctaatgtttctcaagtcatcatatatgagtagcatgcaagctccggatgcagctgttcctctagagactactgttgcgctccttacaagcctctagagcactagtgaagagtaatgttagattgtttcgggtttggtcaacctttcctaagactcagtggacagcaatcagttaatgtgccaagaagcataagctaaatccagattgcaacatactactcattctgaatctgtaagggaatgcctctgtgagtcactgttgtgggaatgtcctgggatggcatagttaatactttctaatgggatttaaaaagtcagtacatttctctttttgaatttgtttcttaatgatctgatgcacttttggataagatacagcttgctttatagaacagaaaaaacattgtcatttatacatgatttagctttatgatcatgatttaaagccaccagctttgtgggaggaagatagtgagaatggccatgacagctttaactacacccttgaagacctccttgcttactagagggcactgtgctgtcctcagatgccctgaggcaggtcagattgggataataattacattaactcccaaactaccctgtgctggactttttttttaagttatagctctatggagatataattgaaatatagtaaatgggaaatatttaagatatataatttgatatgctttgacatattcacagtagtcccctctcacctgcatattcatttttttgtagtttcagtcacctgtggtccgaaaacattaaatggaaatccggaagtaaataattcatcagttttaaattgtgcaccgtcctgagtagtgtgatggaatctcgcaccatcccttgtgccctgtaaaatgaaggtgtattccagagaacaaaggaaggatggagcttttatagagcatctttctgcccaggtttgcattcaggtatattttttcaaatgaaggagtccaccttgcttagttcaggttgctcagtgcaagtgatttctgattggttggtgcaggctatacagtctgttggttcaggtggcctgaacaggaatggtaagctgcgaaggttcggagttaaacagatgtgtaggttttctggaaacttggggtacatgtgtgaccattagactcagttagcccctcaggattcatcttgagggatttgctctttgaggttcacagtgatcagatcaactgttgcagtatctcagtgcttgtgttcaagtaacccttattttaattaataatgaccacaaagtataggagtagtgttgttggcaattaggatgtgccagagagaagatagaaagtgcttcctttaaatgaaaaggtgaacgttcttgacttaagaaggaaagagaaaaatatgctgaggttgctaagattaagaacaaatctatccatgaaattgtgaaacaggacaagtaaatttatgctggtcttgctgttgcacctcaaactgcaaaagttatggccacaatgtgtattaagtgcttagttaaggtggaaaggtaaatttgtgagtggaagatacgaaccaaaaagatgttccaattgacagcaatgtgttgtgccagaatcattcagcctatatgacgacttgagcaagggatcccttgaaatgagttacaccaagtgagggatagttacacagattcaagaatacagataatcagtagtagcctaatgctgcgtcacaatgcatacgtctttcaccctacttcatctcattacataggcattgtaccatgtcacatcattacaagaagaaaggtgagtatagtacagtgaaatattttgagacagcccatgttcacataactattattacagtatgttataattctattttattactagttattgttaatattttattttatgatttataaattaaactgtatcataggtaaatatgaataggaaaaaacagtatatatagggttcagtactatctggtttcaggcattgactggggcctttgaatgtatctcttgcagataaggaggactcttgtacatcatgacatgtgtggatccaaaatctcaaaaaaacaaaaaacaaacaaaaaaaaaccaaaatctctttttgtgtgtgtacatgaattgttccagcaccatttgttgaaaaggcttcccttccttcactgaattgcctattcactttcttggaaatcacttgtccatgtatgtgtggatctatttttggactctgttttgttccgttgatacatttgtgtctctttgcaaccactctattttgattgctgtcacttcatcataattcctgaagtcaggtatcattagcctcccaactttgttttcctttttagaaacagcttgttagtttctaccaaaagatatcctgagattttgactgggattgcattggatcttgtaaatcaatttgggtagaatagacatcttaacaacatcgagtcatttctgagtctctcacatgtaaaaccattatctgcgtttaaaatgtaaaccactcagtgtcaccgatcataaaccaaaagtgatacttagggtaccttgaaattacattaagcagaacactgggaattggtctttttgcttgatttgcctgagtgattctccacaaaatccccacttaatatgataggtatgaatacgggatgccttatccagagcagctctccacaagcatcctcacgccacagatgccagttgaccgttacgtgtactcacctagcctgctggtacctgccagatggtgggcattttgggtgagattatgatagatttaagccagaggttcaggaatatccacattctccaaaaaagaagattaagccattattattgggagcagcctaattctagttatgaaggaaagagatcagggtgccatatgtacttagatagccatgtcttttatagcacatagcctttcatgttaaagctccgcatttttctaaaggagtattgattatagtaaggaagccaaggttcaactcgtgtatgtgtcaggtagctggatcattcattaccaccataggtgacacccatgttgatcagttacataaagaccacaaatggaatggtaactgggtcattgcaaattaaccctttctgaaagacagttcaggacatatttatccttgagagtgagcctacactatcctcctaagacctctcttttaagtggagaatatacattttggaaacaaggttgtattgtggttgagggcatgaagtcaacctgcctgagttcaaatcaccactctgcccttttctaacttttcaaatttagggattcacttagtttctctaagcctattttctttgagaatatggaaaattattatagtaacatggggaaattaaaagtgagtaattgtacaagtttagtgcacttgatatgttttgtttttagcatattttctccatttttcctttttccttttgtgtgttcttgttgccagtgactacctgtgaaatgtaaactgttgagtgaactgcttttgctttactttctgtgaattacttgttctactcactgtgttctgtctcttccattccctccgaacacttttgatcttttcgttttgccccagtcttctttcatttaaaaactaatttctcccaagaagcctgctctataaaggatgtgtagattagatgaggtgtgggaagcatgtttacttataaagcaacacaataccctatccatatccagcctgtaaaaataaaaatctaagtgctttttttttttttccctcccaagtaaagagaaaagtttcagggttatatccttaacatgtaattaagagagttcaagatattttatgttctatatagcaatgcagagaatatttaataagcattaacaaaaaaacttaaccttgtggtagatagcattgtactaattaacagtttattttatttagctacaagaactatgtcagcatgagagctaacactacttatgtttgacaattttagaataggaataaggtaaaaatactcaacagagataatggtagcttgcaaaccgtttatgtcaaatatattaaaatttggaatagttgaagactagaatccaaattcaagagtaattaaccaaaatagttgacagatgtcagccatgctaataaaatttgtataccctgaatattttccagcttgtaattaactgcacagatgatgtgatctgattttgtcactaactgcttattaatgaaggagatgatgactagttacaaaatccatagtgctagctgaattccaagtttaaatgtttctcatacagccggcattaattggagccacactagcctccatgctggtttgatttgtgcttactttcttcatttgtaattgcgaaggggaaactgaatttgttaaattcagctctgagtgaccttgaagatagtaaatctgtttttatttggtggtcagcagcgtaatggcttttatttttagattctttcttataaatgtattgtcatcaggctagtgatatcaccattggaagttgtataataaagtgcaaactgattatttcaagttcagctaaaccacagcagaacatgatgtcaatatgactgaagatgtgaacacagagtgctattaacaaatggtttaataacaaaagagcattatttatttctatcatatacatagcacggaagcctgagaagaagcaaaaggattcaagagaggcggttgtgcagccttcctgcctgcgccagctctctcccagactcctatactgctcttccttctttaccttacgttgctgtttccctttttacttctttccctggaaagggcgggtttaattctgtccttatttataagacagagatgtttgctacctcctgagcccaagtctgccagctgttggccttcttctttgggtggtctccctggcagtgtggtcttacagtatttatgtctgcctgctagctggttttgcctgttggacatctccacttggatgtctaccagacatccccaacttccatgttcttagtgtcactttaattttcctttccccaaattattttctctaccgtagtctcttctttcttatttttgtatttctgtgtttaggagtgcttaatgaatatttattgagtcaatgggtgatttcatgatacaattatagtagcaggtagtactaaaaagaggaactattttctccttatttaagaactttttataagagaactctagtttttcaaaattctgtttaaaatgggccacccagaactggacacactcttctgttgttcgttagtgttcgccttagatggccccacctctctgtcccctctctctagctatgtatatttcttttcaacagtcagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcacaaacaaaaatgtaaggtctatgtgatgtagagtaataagataagaaactatttcctacttacaaactactttgaaaaattttgaaagatgagtttaaaatgtttaaaacattggtaataccagcagagtcagtaggcatatttgtaggatacttagtataaattttggtgtatttattttcttaaaataaatcacagtgaaatcatattattgtatcttataaaatgccttactctgttgaaaaggcagatttatattaaaaacctactagctgcatttatattaaaattgttcaccttattaacaggtcaaacaatatattcttttaagaattcacattttaacacttgggtttcagctgataaaacttatatgcatttgggtataatcttagatacctacaaaacagcaccaagacaaaaatgggctcaataataatgagagagcaagtattttaaagaaaacagaatttactgacttttaccatggttaggttaagttaggttaaactgtggaaggaaattgtgctgtctctcccctaaaaagtttaagagcaaattatcatcttgaatggtttagttattcacatgactgaagttaggaaccattccttttaactttttattttgaaataattatagatgtgtaaggacttgcaaagatagtacagagagctctttgtgctcctcacctggttgctcctaatggatattgcttatataatttagtacacatcaaaatcagaaaactgacattggtacaatgtatatgtgtggttctatgtcattttatgaaccttccttgaactcttcttaccccacactgtttataactgtcttacatatttcttctacacacattaagaatcacattagacaatattatttttgtttcagccatcaaacataatttagaaaactcaagagaagacagtctattgtgtttacccatatttttgcttatgttttttcttccttcctttccttcctgatgttctaatattctcttatcacttttgtttttttcaactttctttacatattcttgagggtcggtctactggagacaaattctctttattatttcaactgagaatgtcttaatttttatcttcatttgccaaggataattttgctggatatagaatttgcagttgacagctcttttctttcagcccttgaaaaatgttctattgctcccttctggtcctctttagtttctaatgagaaattctgtcatttgagttggtttccctgttaggtaagatctcatttctttctcaagacatgctaataatcataagattggttattgtaattcaagcagctactatgtgcttggcatggtgtatgctgtctgtaaccttgaaaccctctattatctctattttgtggataaagaatctgaaactcatgcaagtacattaacttagctaaggtcacacaatttagaaatgtttgagttaaggtatgaaccaaggcttgtgtgcatctaaaatttttgcactttatcatacaattgcggaaagttggagacaatcttatagttgataagttttctaccagcatcttacagcaaaaattacaatttttctgccagtcctttctttgactttgagtagaatcttaaaaagacactgtgtaagagccacgaaacttccttgcagaagctgtatcatgctaaatgttttggatcaattcaactcaatttaataagtctctgcttttaatttcattttctcaccgtgcattataaaatagcatttgtagaataagttaataataattttaagcaatacctattttcaaacaagacaaaattattattctatttgaattcaatccctaacaaataactagtatcaaatcagtggtactgcaaagaatagttaatatccagggtattgttttagctgcaagtgtttgtggattactgaacagtcaagtgggtttgctttgagattattgctttcccatgtgtttattctcttcacagtctttttcagttgttgcctggttcatctttttagacatcatgtaattggtagaacaacagtcaagaaaaaggttgaaaaaaaatacagatgagttctctggagatacgatgaagcaatctgagtgaatcatgatgtgcagtgggctttaggtttctatttttgtgcaagggaccgattatagagctctgaacttgaaatcttattaaaatctctgaagatgcagtagaatacatctcatttaagaagtgttctctaagagatttataattcagtattgtttatatatgtcttagtatattagatattattcattaacctatattagaggagacaatattttacttaatattttcttaagttacaaaagtaaaataacttaatagtaacaattggaatgattaacatattgtgaagcgaaacttatctttaccctagctgattgtgtaccatctcttctcaaataatgtgatattaatctccaactgatgttaacattgtagggtgtatctcttcatactcttccccatgctcaaacaagtacacacacacactcacttactcttcacatgtgttggacttcaataataataaatgtatgcttcataaattggaccattcgctaagttgccccccaccccattcttctaggacagtatgtatagaacagaatcacttaaaattaactggagtgtattctatagtatgaatgtactaattaattcagttattgcatattgatgtacatttgggtggcttcctgtgaggtattgttttttgtttctgttataaacaatgagacggtaaatatcttagcttatatatcttttttttttttttttttttttgagatagagtttcactctcgttgcccaggctggagtgcaatggcatgatctcggctcaccgcaacctctgcctcccgggttcaagtgattctcctgcctcagcctctcgagtagctgggattataagcatgcgccaccatgcctggctaatttcgtatttttagtagagacagggtttctccatgttagtcaggctggtctcgaattcccgagctcaggtgatccacccacctcagcctcccacagtgctgggattgcaggtgtgagccactgcacccggcctatatatctttattcttacacaacaatgctttgatttccagagggtaggtttctgataatgggactgacagttcaagggatatgtatacttaacattgtatagatattagtagatttctttcctaaatgtttactgcagtcttgtataaggttcattttatcacatctttaacagcactaggtgttatcactctttaagcaaatgtgatcggtgaaaactgctatctcgttgctttaagttgcatttgctgaatattggtgaagttgaacggcttatgtttattggccatttcagttttgtcttgtgtgaatttctgctcatattatctggccatttttctattgagttgccttttacttaccagtttctgggagtagtttttatattagggatattaactgtttggttatttattttggaagttttcccagtctatgtatttttgaagtggtttagggtatttttttttgctctagaataaattaaaatatatgtaatcacattgatctatctttgtttaggttttccatcttagttctacaaatatttgcctaaattctcttatgaatgttactgtcttattttttatataaatatcttttaattcatctggattttacttctatatatggtgagatatgtgagtcaagctttgcatttttgtagatatctagccacttattatgctaatgccatttagtaaataaaccaccctttctttctgaatttaaatgccatcagtactttaaaaaaatatttaaatggttacatttttccccagcttaacccattttcagtaaggtaatgactttttaaaagcaggatttagtaagttgaaaaggttatttctctttgctcaaatgtcaaatgctacctgttactctttattgtttctggctaaaattgcgagcacaggaaggattattcctgcgaacaaattcactaatcagcttgcaacctaacaattttaagaccctggggaaaaaagggaaagtttgggatatttactcatttcttctgtaaaagcaataacatgtaaacatagtgaagaaaggcatttatggaatctaagaaggaaagctctttgcttttcacatacagagaaattaggattcattgagtcctttctttacaacataagctctgtaggaatggttctccaagtaaagctgtgtgtcacgttttggggctaggggtgcctcaaagctgcacctacagagagatctgaaggcaaattgccgatttcacacttttattttgggctcatcctttatgccctgcacagagcgatcagatccatacacatcttactttcattcattgtggaaataatgtcctcaggcttggtggtacaaaatcgtgctttctacagtcttctgctaggaaatgtttattggatttagctgccattatacaaatgatgaaggagaggcaaagtaactccagtatctctagccaggagtggcttgaagaattgtatcagttacagatttgagaagatttgactatatgttgaattaggttagatcatctttataattagaagtaggcttttggagtacaaagaattcttctgtaaacaccttgaatatttaacaggaaggccataaggaaatataatgtgctacattcctaggatagaataacatgcagctattaaatagcacattttgtgaatatttaatagtagcatttaaacccaaaagacactgagcggcagagacctgtgtaactagtttgttcgttcatttcttcattcagccaatatttactgaacatcagctgtgctttcagcattttgtgaggctctggggaataaagatgaagggtgtagtctttgccctcctatagcttaggagctagtggacactcaggttacatcattgcagaactgtttattaacaattagccacgtgtccaggatgccatgaaaacgtagaggggaacacacaaatcagactggctgttggggggtcgacgagacttcatggaagtggtcacatcggagctgcgctccagaggaagaaaggaattaaccaggcataaaggttgagggtggttggagggagaggagctttcaactaggggtgaatagtaaatatagacactgaagaaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtaggccagggaagaatgcgaatagctgcgtttttgtttgtgaattaaagggtacattctgaggaaatggagggaagagagagggtcaggggacttggacacggggaagggagctgccttgcactgaggcctctgcagatgatcacactgcatcaatgtgatcaaaatgacgtcagtgttatcagcagtagaatcagaaacaagtcgatttcatctaatttccattatctttcactatgtgagatatttttatcctgaggatttacatgtaacataggactgagtgatttactgaaatttaagctacagccaatatttgattaacaatacaggtatgaaattaaacagtactgtcggccaccaggggttctactctgcgtgatcactttccattttgctctccttcaaaacgtccacattttttctctcagtcataaacatttaaaaaccaactgtactgggccaatcaaactagtgtagtaagtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcattatgctgcccctgttaaaatcagttaccctattccacctgattcatccttgagaaaactactcatggccattgtgggttttaatgccactgccatccccgtcttgccattgcctcctcagctctgtcctgctaccacgatagagtggaccctgtgtcacagcaccattggtacccatcctgccactggtgtctagaactttgagcagtttaaccccccccggttttccaactctttccctcaccaacttgtgaagcctctgaactggtatctgagcagagccagtgccttgcactgtgggagtttcctgtcctaatgcttaaacaatggctctagaacttggctgggcatgaggaacatcactggcttgtaagggatgcagagccctggtcccctgaataagttgccctggtgggccaaataatgttattcctcacatttggtatccacatcaaatccctggaacctgtgaatgtgaccatttggacaaagggtcttcgcagatgtaattaaattcaggatcttgagatgaagagattatcctggattatctggtggaccctaaatgccagtacaaatatccatatgagagagagacacagagggaggggaagaaaggagaggaggcactgtgactgcaggcagagattgcagtggcgaccacacaggaaggaatgccgacagctgcctactgtaagaggcaaggagcagatttccccttagagcctccagagggagagcagcctggaacttctgggctcaaaccatcctcttgccacagtctctccactcactggcactacaggtgcaccaccatgtctggctaattttttttttacttttcatagaaacagggtcttgctatattgcccaggctggtctcaagcgatcctcctggactcaaatgatctcctggactcaagtgatcctcctgccttggcagtattttttttaatggcactgagagacagtattatttcctcccggcacatttggattgactgttaagtaatcacattcatttcctgattttgatacaatgtacgactggttttgtaggagaaaaagaattgggaagttttaggaattagaagttatgtagatttttaaacattgagaactttgtcattttcattaaaaggctaacttttttgttataacttatttcctattcacagtacatcaccagctgcttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattctagatacttgttctttgctggatatgtgggttgcagatattttctctcagtctgtagcttgtctcttcatcatcttacgagggttttcacaaagcaaaattttaaattttgatagatctaatcaattttttctatatggatttgcttttagagtcaattctaagaactctttacctaccattagttcctgaagattttctttcctttttttttttttctaaaagttctatagttttaagcattacatataagtgactcatttcaagttcattttctataaatgtgagacttgggtggagattcatttttctttttaattgttcaatggatgcctattatgccagcactgtatgttgaaaagaccattcttgccctgaattgctttttcatccgtgtaaaaaattagctgggcatcttactgtgtgtctttctggcttctctactctgttccattgatctgtgtgactcttcctccaccgataccacacagttttgattatggagctatatggtaggccttagtattggatagagtgattcttctcactttattctctgtcaagattgttttagctattctaggttctttgccttttcatataaatttttaaatagtcttatctgtgtctgtaaaaaaactttgctgagattttgataggaattgtgttaagccaatagatcaatttggcgaggagttgacattctataaggtgacattctatgcatataagttgacattctatgcttagtcacaaattctttcagttttccttgtcttagaatgttcttatttgttgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgcagtcctggctgcctgggaactttaatgggggaagggagtctggaaagaagtgcttctgaccactgttgtcagtgcggttctctgttgtccgcttttctggtgccactgtgcttacttgggtgtcgttactgggattctgtttggtccgggcaaggagtgagcctgccttagctgctgcctttggttgtttgtaggtcaggaaacacggggcctggtttgctttcttcccttaggtgaggttcataagatgccctgccattacgttgtcccttcagtcttggccttcctaaccagttagtttgcctctttccacctttcttcttgcaggaagaaaatttaacttttttttctgattcttgtgcctttcccgagccaatccccacagacactatacacaatgtcttcttatctccctttaccttcccactgtcacaacttgtggttcaatcataatgtggtgtgtacatccttatgactattaattattggtcatagctgacccatacagcatacgatgaggatagctcctctctttccaggtttctgttttgcctggttggattctatgtatttatgattagctcatctctaaactgtatgaatttcagcttaatatggccaaacttgttgactggcttattatttccttttccttttcttcctggagatcttcctctaagagctacacatcagtatgagctgattgttctctgggtcttccagacagctctcatcttggcacctcacaccaccaccttctccctgtctcctttgttgttaccctgattccttggactccatgtctctctctctttctggttttacttgtttattggagcacaccttctgggagtttcctgagaatgcatgtgtaagaagtaaatgtttagacacttttgatctttggaaatgtctatattttactctcacacttgtctaggtaaaaagttcttggttgaaaaccattttccttgagaattttatattgccctttgccttatagcctccagtgattctcttgacaatggaagtgacacttggattcttttttgtgtgtgtgtgtttttccctgttggaatactcttacttgtctttttctttgatggtttgaaattttgcattgatattcgttgatgtggcatggtggccttgatctgggtcttggtgggttatttaatctggaaactaatgtttttcttttgtgggaagatatattattttcccagaaagaagtaataaaattatttctttcccctgttgtctctcttttctctttctgaaattcatttaggatataagctctaaaagtagagggatttttgtctatcctaagtgcctagagcactgtttccatagagta

SEQ ID NO: 60 - DNA, 8062 bp, Homo sapiens
tgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaaggaagtctcaaagagaaattacatttgaaatagtttattctaaaaagttttcaaatacttcagttacagaacttaaagtttataatgtatactaaatgttaatatttggttcgtactcaaaattttttttttaaggacaagagatgtaggttctgtgggtctaaaaataatacccatatgtgtcactatatattagttcttataataagcaattaaaaatgtataaccatatacataattactcatttttctttgatgatagtttaaataattaagaatgtgctaaatatattctgaagatgagcacaatttcaagtaataaattatgtagggctggttctaggtttaagtgaataaggagaagatagctgctgagtgctggaccagaatcccattttatttatttacttctacctgtattatgctctgggaatcagcatttcctacactataaaggaaatttccaaggcagagcagctaattttaccctggatattctcagcacctcatttctaatccttgtggcatacagttcttttattgacccctatattctcaaacacatctcccattgagctatgttcctttggggtgtacttctgtggcactctgcagtatcctcagtatctttctattatggccattggattccactggatcggatatcgggtcatttttgtagtgtttgtatgtgaatacatttatagtctcacatttggtgccattgtgttagacatagaacattctcgaaactatatttgaaagctgaatgtctggaagttgaacaataaacttacattataaggtcttgaaaaatatatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctgagctcaagcaatccacctgcctcagcctcccaaagttctggtattaaggtgtgagtcactgtgcctggccaggtcttaaaaatatttaatgtttaactgtctttcctattggtatggcgttcttgggctaggaaattaaggatatatgtgagaactatctcaggtgacaaatgactgagacgcaggaggtggtgcttagttctgggagcctgccagccagacatcctcacttcccacaagcccattggatttttttcccttactctcatccttgttactaccatgattgtaagatgaagccgtccctaaatgtgaaattttcttataggaatgagaggctgaatgaagtaggcaaaaggcatctttgttttcttttgccatgagaggacaaggtaagggaggcttctggcagtcactctacttacacttgaggacaagcctgaagctgtctaccttttacttcttttaactcacacacacctctggctgaattcttgccgacttcttgcatatcttctaccaggcttccacccggtaatagtaagtacagcaacaaaagtggaggaaggggagaggacttggtttgctctctgccctgaaagacaatcatcttttatattaggaagctccaggcccctggcaggtcaggatttccaaggatccttcttggtagatttagacaagctagattttggaaaggagagttgttaggtatagctgtggttcagctggcagttaaaacttttgttctgttagagcctgttactactggaaaccccgtttctactaaaaatacaaaaattagctggacgtggtggtgtgtgcctgtagtcccagctaatcaggaggctgaggcaggagaatcacttgaatctgggaggcggtggttgcagtgagccaagatcgcgccactgcactccagcctggcgacagagagagaaaaaaattacttatgctttctgtaatagatgttgttggttcagtacttttgttctttcagtagtaccacgagtttcttttggagaactcttttgccaatcaaagcaattgtgcaattttatttttttaattttaatttttttttgagacagagtcttactctgtcacccaaactggagtacagtggtgtgatctcggctcactgcaacatctgcctcccgggttcatgcgattctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaatcattgtgattaatatatcagcttagtttgacagatatttcttacctactaagtgctagacttggaccctgttttcaaagctctttaattctagctgggtaatatggcgtgtgttttttgtacacatcactctttattgtagttacttttgtactgagattttctgacaaaatctaatgtgctgtaatagttcatattgttaatacacatcttaagaagtttccatttgttattactacctaattctaataaaaattttattgcaaatattcattgaaaataaatataataattagttttaataatcaaatataacattttttccagatttccatgtcaaaaattatagatagtcctctgacaaaaattgggttaatattatttgtaacttggaaaacataatttttcagtaaaatggctaataattttttccctatctgacttgacctgctttttagatccttttatataagaagtagtaattcttttaaagtaaatatttctctaagagcctgctttgatagtccatacatacttttctcttctctgtagctagagcccctgtattttcagctatgccccagggttcaggactaatcctgtctatgaa

SEQ ID NO: 61 - DNA, 5718 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaa

SEQ ID NO: 62 - DNA, 1890 bp, Homo sapiens
tactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccac

SEQ ID NO: 63 - DNA, 4381 bp, Homo sapiens
actttccccaaagatcttttttaatgctgtgtagattatacctaagtgacttaacatgcatatcattgtaattattctaaatttagcttttttttagagtaagattttaccactgtgggaaaaacatagctgtttaatactctaggttaagagagcaatgatcttctttatcatctcaaaagaaagtggactgagttcttaattgtcttatttgtaactttagtggaaataatatcttctaagaaaatctccagctcaatttggcagctgaagttttaaatatatgtctcctttcccatgtctaaattgtggccaccaaatatcataacattaaacataaggaatgctaacattctttttttctttttaagatcgggtctcactctgttgcccaggctggagttgagcattgccccagctgcactgtatggaatgcagtggtgcaatcatagctcactgcagcctcaacctcctgggcccaagtcgtcctcgcacctcagcctcccaaataactaggactacaggcacacaccaccacacccggctttaaagaaaaccatcttctaattattcatgattattacttccttttcaagttcagaaataccacacctcagctttttatgccaatcatccaacatatcctgaagtataaaactgcaaagtggaatagagagagcatgaacactggaatagacagatgggaaatgaggaagatgaaatgtgcatctgggtgttaagtctcaccctttgaaagccgcttctccatagcacctgcctgctgccttagagaggcagagaacccacctgtgccaggcgggcgcaagaggacactttacctggccctctgccaactttggcccctccccccatttcctttccctgccaaagttttctttttttcttttcctttttttttgtgacagggtcttactctgtcatctaggctggagtgcagtggtgtgatcttggctcactgcaacctctacctcctgggctcaggtgattctcccacctcagcttcccaaatagctaggactataggtgcacaccaccatgtctggctaattttttgtattttttttggtagagacggggtttcccatgttgcccaggctggtcttgaactcctgaattcaggcaatctgcccacctcggcctcccaaaatgctagaattacaggcataagccccgccctcggcctccctgccaaagtgttctaacgtgcatgtacctgccctctccctttgatatccagcaacctattgcatcaccagggtgctccaggtcacctgggagccctctgccaccagacagaagagcctcaccccagcctcatcctccttgactcttcctgcagagaactctacgcaaatgcccactggaagctttctgtgctcttagcttagagagacaatgtcctctgctgattctcctgcctctctgaccattccttcggaatgtccttctctctcctttgtcaaggctgtaccccagcccctgtccgattttctattctcttctttagagacttcatctacaacccctttgctgacaactcccaaatctcaattctttctctccagttgctacagggcacttctaattggaggttgtgctgtccccgcttgaccttcctgtctttccagctgtatggtcctatagcaacttccctctggccggcccttggtgcctcatttctggagcactgcagacatcctgggctgttccagcaacaggccgcggcccctgcagcccagtcggcaggcagacccagctccctaacacagctctcaacagtggcctgcctgcgtgaaccctccaagcgttcctccatctccccccaagtctggttcaggctcctctgcagctcttggggcctctcttacctggccccttgccctcagtccagtcttatttcccacttgtctgcacaatgtctgcaggcaccgttccttctttcctcactagcagtgtcctgcccactgtcctccatccaccaagtcacagtcaaacccgcagcacctgtggcccttcagccttcactcacaatgtatcttcccaattaacaatcctgctaggacaggaataagctcttaaacttctccctctgcccacagcatatagcaccagtccttactaacccatgcactaaccgtgccgcacgcagagtgacagagccctgtccctcacctgccatctactgatgtccaagctgggcttctggaaggacaggcctctgagcccaagcgagacctacgagttttcctaattttaacttactcagttcttatttcacctactctattcaacctgcacaagttagtacctaccatttcagattttggcatggaactgaattatgactgatgcaacaggaagtgtaaacgttctgcagtctctttgggaccaagctcattcttgggttagatgatccattttatatattctaatttattgcttcccactcgttatttggcgcatctttacttactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccac

SEQ ID NO: 64 - DNA, 2722 bp, Homo sapiens
aagcctggtaacatttaagcataaggggatatcattagttgtttttgaaagacgtagtttataataatcacctggtgatgatttagcccttaaggaaagtgttaacgtcttcatctaatactacagcctagtagcttgaaagggtcaggtaactttcaaatccttgcctcatacttcgtagtgatggagggttggagaggatttggtttgttaaaccagactttttctttctctgactctccttcatccagaaaaggaggagactaccatttccagttggttggaggagggtctcttgcataagcaagggccctcaaagcatgggcattggttagcaattgagatggggttgccagattaagccaacaaaattttaggaagctcaattaaatttgagtttcaggtaaataatttttgtcataagtgtattccatgcaaaataaggataaatatgtaatatacatataaatattgcatgggacatacttgtactaagaaattagttactgcttacctgaaatgccagtttaacaaggttttctatattttatctggcaaccctaatttggggtatactgcaggtctgcctttgaaaataccggttgggacctccgagtggactggcagaactggaagaggcaatttatcacagacctgtgttgctttatttaccctcatggctggcccttggtagtcagagaagagccctgatatactgatgcaggatgagcttgatcactcgtctcctagcaaccgcacagctagtggaagggagactgctgacccagagatggttctgtgttgaatctagccttgcaggaaggcagcaaaggaaaggctttttgactatacctcttcttttgtcttgaagggaaaaagcaaattaagtgtttttatttgaaatttaattgtgcattcagtatatttttaaaacaatttttgggaaaataacctaaatgtccaaattatagtaatcatggataattattattctcttagagaaataaattgtcctggaaatgtaaagcagacaagcgatgtgaaaactagacaataagcagttatacatagggatttacagtaatctattcttgccacttttctaaacaattataagtaatatttaatactaaaggaaaatgttcatgatataatagatgaagaaagataagataacctgttcattattattctggtattgttttttctaagcacatttgtgtaaagattggtaggatatatatcaaatgttagcctagaaattgggaagatttaaaaattttctgtatccatattttctaaatttcctataacaagtacactacatttgaaatagggaacataaaatttttaaattgtaaaatcatcttttgaaagaattttttaagttaaatttagtttctataatgttcctaatttggagaattaactgaacccagtttttagagctgaaaatggtctcaggatcacaaagccaagtggtacctcaagttaaatgtcatgagatttgtttgtcacaaaatagacatagtttttgtagcttacctgagagtctccctctagctctgtgtctcagaatgtcaggtcggcagtttacttcggcagcccgttatgcattaggaagctcggctatctctagtcatgcatttcattcagcgaggtccatttagtatatgataccccttatgtattaaaatataattgtacatgtttatagagtatagtgtgatgtttcagtacatgtatacattgtataatcaagtcagggcagctatcacatccatcacctcaaatatttatcagttcttaagatcagttacttattcctctttacagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaat

SEQ ID NO: 65 - DNA, 10677 bp, Homo sapiens
aaaagtcaaaattccaaactcacctaaagcatatttttttccttccgcagtagactttgggcttgttgccagtctctcctgcttagctcaggctaaaacggtcatgtctctctttttttttttttttttttttaaagtctgggccgggcacagtggctcacgcctgtaatcccagcactgtgggaggcggaggagggtggatcaccagaggtcaggagttcgagacgtgcctgaccaacgtggaaaaaccccatctctactaaacatataaaattagctggctgtggtgcacatgcctgtaatcccagctacttgagaggctgaggcaggagaattgcttaaacccgggaggtggaggttgtggtgagccgagatcaagccattgcactccagcctgggcaacaagagcgaaactctgtctcaaaaaaaaaaaagaagaagtcttaggctaagcatggtggggcaagccggttatcccagcactttgggaagccgaggcaggaggatggcttgagagcagcctggacaatatagggagaccttgtctctaccaaaaatttaaaagcctgatgtggtggtttagttgcttgggaggctgagataaaaggatcacttgagcctgggaggtcaaggctgcagtgagccatgatcatgccactgtactccagcctgggccatagagcaagactctgtctttaaaaaaaaaaaaaaaaaaaaaaaaaaaaagtagaaaagttagtttttaatgcttaaattatattgccttagctccaacttagtgtagtttactttataaattatggataactgtagatactgtgatatttatagttttagtcactgatttgttagattttatccagttattcagctgttttacctgggtagatgacatgtacacagccatcttctaaaaaaagtttcaagcaacagtgtttttatatactctatcaatcaaactttgtgcattaattaaatactgtttgtatttaaatcattatggaatctctgacttctacaagagttgggtcaatgagaatcaaagcaaaacttggctccccttggatttcctcttacgtataaaacctctttatacgtaaagaggtttgctttaatcccacttctgacaccaatctgcttcgtcctcacaggacagtgatgttagtgatgtgaatgatggaaaagtgattgtataaaagttaggtggggccaggtgctgtggctcacgcctgtaatcctagcacattgggaggccgaggcgggcagatcacctgaggtcaggagttcgagaccagcctggccaacatggcaaaactttgtctctactaaaaatacaaaaattagctaggcatggtggcgggcacctgtaatcacagctactcgggaggctgagggaggagaattacttgaatcactccagcctgggcaacaagagcaaaactccatctcaaaaaaaagttagatgaagtttctgtaattttagggtatgcagaaagctatagatacagttacataaggcaggagctaatagcaatttttaggcggcactgttagggcttcccaagtccctctcatgcctcagtgagacatacagccatgcttattggcatttttccaagcacaagaggcttcctttatttctctgagatgtattttatacttttctaccatctcctcctgaaacacatacccaaatgtttagcagaatctgagtacatgcctaccagctcccacagtataagtaactactacaaaacagttctaacatactttgacacgtccactatgggaactaactgactttggcttcaacagaaccctgcctcaggcccaggcttcacgctgtctgaggttctcttcagcacaatgtgatgggttccttggacatcttctggctgcacctgttcggatctctgagaagattttgtttgtctttgttctgttttgccaagtctgagattggcactggggaaaattgcctttctgagggctttatttttggtttccgtattatctcatttctgttggtgggagacctgggagttgccttaagaactgaacaatcacaggcccttgctgttgacctgatcagggttacacgtaaagctctcctctcccaagtaggttgtcaactctgtgaaagcaaaatttctgttttatacactgctttatctctataatctagaacatgctggcacttagtaaatgtgtgttgaatgaataaatggattccttaacaacaagatttagattcattttcattctagcccatggattagatatcaaattctgagatcttgttgacactttgtcattaaaatccataatccagctaggaaatctctgcttctaagcagttggcctccctggtcatccttccagcgctcaggctgcagcattctccatctggcttctgcctttaggcaattccaagtagtggtctgaagtggagaagcccttgccccagactgcatctcagtggtgttgagggtagttgtctgctttgtctggcagggaatgtgtgatagtggatgtttaggaggggtctagaggatcaggcaactctcctttctctgtcatacttgctgtaagtttacttccatgtggatggatgagtactgcttccaacagtccccatggacgaggactcatttccaagtaccagtagccccttgtgatatgcacccatatttggctgatcgcagctgtcagcattccatcattttcaatagcccccacttgtggaccagcaggcatgtcataatcctgaagggtgatccttatcctccccgctccctgcagtgcccctgcctgggttctgctctgtctctcttgaccctccctccaggcaacagcagaggctaacaactttcatacaagagatggttgtcctggtttaatgagatttgggcatcccatacaagtctaggggtgtgtcccaagtggaattcctctcccaattctctgtgaagagaggggaaaggaaccatttcacttcacaaactgccttccactatagaggcaacttaactctccagccatctcagcggcccggcacaagcaaacacgaggaggcggtgccagaattattcttagcagcagattataaaggaggaatctgtgaatattctgcattaatattttagtccttgtggaatatattcactgtcaatctatggcatatgttccttaggaaaccaaggaacttttaccaaaccaaaattagaagtagtttctaagccttttataaatggtggtgcccttacctgtgaactgacaggcgctagcaccaaatgacctcaaaattccactgtagtattagcattttccagaatttttattagactgtgcttacagttgaatggataaggcattaaaacctatcttccacctcattctttctgagttgatttgaatgggtttatgaactgaaacaaaaagaaagttctataaagaaaactatatactgtgggcttaaaaaaattttatggggtttcagagattttttttgtttgttttggtcatgttttggtttcaactctaaattaatagccttctttaatccttgattccttaatttattagtctgtggcgtcaatataaaatttcactggattataaactgtgtaggattatcagttccccagtggctggtactgtacctatcatgggaccactgtgtgtctaacgtggtaccttacacttaatacacagcaaacaaatacttttcaaatgaatagatgaatggaccaatttacttagcctgattctcttaatatttaatctgtcttcaagatgctgtgcaagtccattcttggtcagcgaccacttttaccttcacttcattagcaactatggatggtctttgtgggaaatgatgtgactgatgtagaatccagggtgccccagttggccctgggactgcacttggcaaaatgactttttgatctttgtagtatctgtccttcaggaattacaatgtttgtttggtttaaatctgtttaaccccaggcaaaaggaatcaagaagattctgtgtcactgtggctatcatgcctattgtacacaccaaggtgctttgtcagcaggtttacaatgaaacaaagaacatgctcataagtgactacgagaaaacgggaaggatgtagacaggtttccttcagtcaccaaatcaccgtatataagtaatcccagttttccttctaaccttttatgctgtgcttggaaacagaaatctgggagaagttgcccccagtttgtatttagtttctaattttttaattgacatgcaataattttatatgtttataaggtacatagtttcaatattttcaatgtatagtggtcaaattggtatcattagcatatctttcacctcgaacatttgtcatttatttctgttgggaccattcaaaatcctctcttctgctgttcactcatatgtggaagctgcccccagttttttttaaacgccttatttaatcaggagatctgtgggaatttcaagctcgcctgaggcatgatgagcatggtgaagtggcacagtgtcaacggcaaatgagcaacctgtgctcccagctccttcctcagcgtagccggacagaggccctttgttgtcattgatcaatagctgttttgtgggcctgtattgttagagttgctaagaactgaccatcctgctaagctaatgctgctggatttaccatatagagattgatgaaaactgctcaatcctatcttgaagcttggcccaataaatggggaggaacttctagttctacatttccatcccgtttccaaggctggagtgagcttacagagcctgagagttggtacagagatctgcagttgcatgtgtgttgtttaagctgagcccagctctccccatgggagagtgatggcacacgcgtagtgcacgcagggcgaggagcactcctgctccagagcccttctctcgaagctgcgttcttcttcatcccaccccttcgttctgcaagagttctgcccgcatagctgcagcgagcaggtagaaatgcaagactcctgttctttatgaagttggaagggactgaaattataatatctattaaacccagaaatgctgaaattaatcatctccaaggcctattgcttagttaggtaactccactaaaagctgaatcattcgttgatttttttctaagtgaatatgatgctattttcataaatgattttctttattcaaaccccttgattttctgtattggtttgaagcaaagcaatgacttctgtctgataattttaggcattaaacctgctgttcattatagaatagtttcttcacttttgatgacaaagagtggccagtgtataaaaatccagaagtaaagtgttggaaaatgatttttagaagcttaatgtgcctaggaaatcacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggttacatcatcaccaggaactcctttgtccctcagtgtcttaaccagctgtcctctggatttctcattcccgggtacacctgatcttcatcaagacaaataagtgcctagacaccttcatttttccccaagttcatcagcccttcctggcctcactttttgtgcctacccaaatgccatttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaacaggtcctttgattaatcttataaacttacacatttctgccgtcaccttccttccaacctttttcctttctcattcaggccttgtagtcttttcttcattctctatcctatctcatctgtcctctgtccctgccattctgctgacatgggggctctttaacccctgagtccagtgactctcctctctctgtcttactaagagaacttgtttcttctagagtagcattgtccagtagaaatatgtgagccacgtgtataaattttctagcaggcacattaaaaaagttgagatggtgacattgattttaacaatatattttaactcgatatattaaaaaatatttcaacatgtaatataaaattatattttacattctgttaaaaacttttcagtaggacttcaaattccagtgtgtattttatagttatagcacaattcaaacttttgaaagccacatgtggcattggctactgaattggacagtgcgtgttagagaagaatataaacgttcttctctcgcctttttgaaagaatctctcttggcccttctggtgcctccctctctcttctcagtgtctcacctctgcttcctcttccagccccttacatgctgttggtcctcaggattttacctttggctggcatcttttcaccctctaccatctaccctctctcttaattaatcttttatatcccacccattggctagtgattcccagggtcatgtcactgactcccatctctcagtggaacttccaactaacaaagctatctcacgggtgttcaaagctcaacgtgccaaaattgaactcatcatcttccctcattgatattttctctctgtctcattccatgatacaaccatctgtccagatatgcaagctggaaaactggtattgcccttgagttgcttttcctacttcatcccctaaagactctccatgacaaagtgctgtgaagtctatttcgccaacctttctttaaatattcacctgttttcttctccataaccactgctccagtcaagtgcttcatcattcctctcttggatcatcacagtggcctcttcagtattctgcccatctttacttagttccctttacgccaccctttgtactctcattttttcacccaaataactttgtattcacctaaaatagccaagtctaagacgatatccccattttttaaaacaacaacaaaaagacacaaagctgtgtgataggcttcagtcaagagcattttcaagagggtaggcttctttcaggacatcctgcagttcttctgcctgaatcctttccatcaccccatcactaagtatctctgtacatgattctggaagacataggaatacactcaacagagtccagttcttaggaatactgttaacagagtccagttctgaagaatgcacttgacacagtccagtttggtcttgataacagagaggccccctggctttggagatttttcctaaccctggatttatcctagagcagtggttgctaatttctctgtgtttctcgcccctccctttctccctcccctcccccatccattcctccctacccccctccttccctcctccttcactccttccctcctccctctctgcctcccccttctcccattcctccctctctccctcctctcccactcctccctctctcctcccatcccattcctccctccctcatccctccctacccctcctccccctcccctctttccccctcccctctctcccctcccccttctctctcccttctctctctccctcccccttctctctcccctctctctctccctcccccttctctctcccctctctctctgcctcccccttctctctcccctccccctcccctttggatttcccaagacattctaaaaccattggagcattttatgccacattttggaagctgaagaaagctgtttcctccaaggacactttgaacattgtctgatgaacacgactcaaaacaacttcaaacttgaatttcttggctagttggaactgagtttccccacactcacacccacacccacacccctctttatagaaactggttggaacgacttggtttctcacaggctgtccaagcctcactccccagttggctctcatgttgtactcatcttgggttgcaactgactcgtgacctcagtggtttcagaagcttccctgagcactttggccctgaatgctcttacacatttcaggtcattgtgtgctctgctccacctcttgctctgtcagcccagtgccttggggagggggaaaggagggacaagtacccaggcattggcctgccttgcgggtctgtgcagggcaagagcccgtgtcaggataagactccccacatctttagttgagtctaagctttctcttcagcagcccagcgctgggcagtgggatgacagcaggaattggccttcccatgatcctgccctgcccacagaatgtgccaactgtttccacagggggtacagggttgtgactctccccacaggcactgaagagcagggccgacttgttactcaacaccaagccccaggctggagttcacagcctctccctgggcttcctgccttcactctgtcttcttggcaggcttctcctgctctccagagcttcggcctgtgtgccaccctctctcctgattatccagtttgtttgctgtcttgccaggctccctccttaaatttcttgccaatggaagctctttctcctttgttccctgaccctgcccccctgcccattctcctcaaagcctacttgccccaccaggcccctttgtgtctctgctcctcccacctccagtctctcaccccctcaccttcccagatcttggccccactgggtctccctgccaatgccgggttgtgcccacagccttcctcgcactcctgtcctgtgccagctgggaatgaccaactctaatgagctgattggactgaaagtgagtgaatgtcctcatgcctccactccttcccacctcagcaaagcttttcagagtcccatttctgatggaatctgaatctagaaggatttagatccacggaaaactgttaaacctccagtgtttggctacgtgtgaagtctctggcagtccctcccacatctgatgttatgaacactgtttatagatgcctggaaagaagcttttaatacttgtattgtgttttaacttgctttcctttggaggcagggaattgtcaagtaagtattcacaccgctctggagacaaacacaggtgtttggtgaacatccagtactaagtgttcacgcagaatccacaaccgcgaagggtcaatacttaaaatccgctgaatttgccacaatgcaggtttcttccccttgctcctctcatcttcagttttgaagcaatacagctgtaaacatatgcttgcgaaatgagaaagaaacattgagattgctttacctttcggtttttttctgaaaatcaaggtgaaaaaaaaaagcatcggattgcgtctgtgtatatatatacaatctcctgtatatataaatacacggtgtttgtgcttgtacgcatactctatattcactgtataatatattacatattatacaacctgtgtgtcccctgaaatcgagccctgtgtttatcctcaaataatgccttatgagccatgccatagttccagtgtcctcttgctctcctcatagcccctggcttgcttttgtcatacacttaaacgttcttaggtgaaagaagaaacccacggatttcatttgaaagtcccactaaaacagaagaaagagcagatgtcctgggaagcgataattaatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcag

SEQ ID NO: 66 - DNA, 44124 bp, Homo sapiens
agttccatagacttaacgctgaatccaatggttagtaacattggctttctattcccttctccatccgccccaccccctttgccacttgcttacatttcttaataaaatgaggcaggtttgctatctttttgctttttattctttcttatatccatcatctgttatcctttctctttcatgtgttctgtctctgcttaattccttcagcactttggttttattccaataaatagcttctggaagatacttgcgtaaacaaacaaaaacagcaaaaacaatgaaacatttaatttttagcaagtgttatggtgacctttagaaagaatgtgctttccggccgggcgcggtggctcacgcttgtaatcccagcactttgggaggccaaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattacgccactgcactcccgcctgggccacagagcgagacttcgtctcaaaaaaaaaaaaaaaaaaaaaaaaaaaaaaaaaaagaaaaagaatgtgctttccaaagtagacatgggtgggacgtaactggcccacctgatgttgtcttccgtacttgtattggttttcttctcttcttctgtcatgtgccagatactgtattggatgctttacaaactctaccttatttaattatatcctcatgatatccagaagggagttaatattctcatcttgcagatgagcaaactaaggctcagacatggtcctaataggtagaatagaaggaatttgaatccagagttaactccagcacacatgctgctttccttaccagggcttgcttctacctaaatagtaagtacagggagagctttatgacacagaatatctacaaatactgattgacttctctggctcttggacccaaatgagaatgagcttcatggtatgtgtgtgtggtggggattcatcttatttttgcaatgcgtatatgtgttgtatttttaaatgatgaaaaatgcacaggtaacctgtacaagagggagatctaagaatagtcagcattaagtaaatatttgttcaaagaatgtcttccgatgacattgcataatttcagttcatatatctgaaaacttagtaatgactagtgatttttataagagagattgaatagtgggcacttatttctaatgagccaattgaaaagcaaattagataacttgctgtgtgtatggtgacaattcatccactttctattttctctcccactgtcttcccacatatgtatatattgttttcattgacatattagtgagttaactaggttaatttttattgtgcccagaaaatacttaggtaatttcagattcattgtggagcggggaagcaccctaactctgtgagctgtactctgaattgcagagtaagtttacaactagtgggaaatataaacattgacaatatttgcactcttaatctgtgtgtacaacaccatactctattgtcaccacccatttcacggctggagggtccattcttgtatcattcagataccagcatttggaagccaaggacctacattttaatagacttagaagcaagaaactggttatatttttgacgtacttatcaccaggctttcccacagttgatcattcacatccatattagtatcaggaccctattgtgtatagaggacattggtaacttaattttcctttttttttttttttttttgagacggagttacgctctgtcgcccaggctggagtgcagtggcgcgatcttggctcactgcaagctccgcctcccaggttcacaccattctcctgcctcagcctcccgagtagctgggactacaggcgcctgccaccgcgcccagctaattttttgtatttttagtagagacggggtttcaccatgttagccaggatggtctcgatctcctgacctcgtgatccgcccgcctcggcctcccaaagtgctggaattacaggcgtgagccaccgcgcccggccggtaacttaattttcaaactttgaagcaaacagtcacaggcctaagttattgcattatcaccattcagcatttcttctgaataaatattacaaaaaatataataggtgtgaagagaaattcagagaggtgagggaggacgtgtagggttttcagctttatttcctgcttctcctgagttgcacgtgggaacacagatgatgccagtacatgcctgatcgggaagtgacggcacagttacagtcctgccggtatgctcacgcaagtgggtctttttctcatctcttttgaagataatttattgggaaggtgcctacattctgtccagtttgatttcaacagtggtttgccaaaatgagaatgagtccgaatttctcactgaaatctatgtatcttcaaaattaagaaatccagcagtactaccccttcctcttgtacctgtgatacaagtttatccatcattgttggagttcaccagcaatgtaaaccctgaagttgatcagtttgtccccacttctagttccagtcagtggattctataattagaagaaagaatggctgaggtactataataaaatatttaccttaaacaaagccacaccggtatcccttttgttcttctctccatggctctgggtaaacactataactgtgatgttagcctgcaggctagagccaagagaactgaagattgacaaaaaaaaatgatactggaggttcagtagtgtccaccctaccgtttgccctccgcttgtgaagtccagccctggattatactacaaagtagctgtgctcttggacaagtcatttctcctctctggctttggttttcttcatatctgtaaactgagagggtgggatgagattttacttgagtttccttttagttctgattctatgaaggagtaacatgtcttgtttgactcagaaaatcctggcgatctctttcaggcttattgtagtgtttattacagcaagctctttagaagcttccgcataagcagacatcagaatgcgcctggacctcccaaagtcatctggttttcttcagttttttaaaagttcagaaatgtgatttgtagaaggagtaatagaagggagtataaattacagtgggaaatgggaaaacattcatcttaaagccatatatttctctgtacccttttgacatgtaatattttcttatttctattgtgttgggcagaatgaaaaatgggtctcgatatattttgtccctttaattgtagcctaatttattaatgccccctgggcttcccctatattattggtggcagtttctctttttagtaagtcattatgcagatctttggggatgactgtcaaaatgcttaataaaaacttgatagctaagctaacttttgatttggggctttgaataggcatccgatgcccctgcaatctcactcctagatatctgaccaagtggaaaacttattttcacacaaaagcctgtctgtaaatgttgatagcggctatatttgtgattgccagacacaaggggcacaggggaaatttggaggtgatagaactgttgcgtatctgcattactgtggtggttacatgatcacagatgtttcaaaactcacagaactgtacactaaagggtgaattttcctgtatgtaatttatacctcaatttaaaaatgtgaaaaaatactgctaaaaaagtttatttgaagtattttttatacctaatactatgggcactttgggataaaatagaaatacgctatagaaatacgacattgttcacaagggccttttaaggagattgaaatttaggatttctaaaaagatgttatgaggacatacggattattggaagtagtagttacttctgtcagacaacagaggagttataaaaagcaaaaaaaagaaatgatttttaaagttatagcatctgagctttttcttaaagttggtttaaagtttttgatctttaggcttggtggagtggctctcaactataatctcagcactttaggaggctgaggcaggcagattgcatgaggccaggagtttgagaccagtctcgtcaacatcgtgtaactccatctctacaaaattacaaaaattagctgggtgtagtggtgcatgcctgtaatctcagctactagggaggctgaggcaggagaattgcttgaactcagtaggtagaggctgcagtgagccaaatttgcaccactgcattccagcctgggcaacagagcaagactgtcacaaaataaaatttttgatctttcagcgtttgcagggcagtagaggggaggagaaccaagtcataaaacacggatcaactttattttcctgaagaagtataaggtaaatatgtatgagtaggcttttttttttttttttttgggtcccagcatatcgtaactacttttgacaatccctgtttctaataaaatgtatgcaagcatatctttgtatatttaattttttctgtgcaattcaaggaaggcaaatggttactatgaacactaaatcctgtcgaacttcctcacacgcccgcaacataggcaattgtttcaaaggctgtggaagagactgccagttgcctaccaaatatctattcttcccttccttagcaacagtaccccagttcttttcaggaaagcaatgtccctgtaggaaacattggccagttttcctttgagccagatgtggctggtgactacataagtgttgtggacttccaggaagcggggctggtttggtgagtaggggcagcagtggcagaacttccccaactcccacctcctggtgcctggaatgcagctgtgatggctggaactccctggaactccagcctaggtcttttctcttccttcccctagcccctcaatagcctactaggagacagttctccttctcaaagagaaagtgtctacttgacagttgatggaacagttgttactggtttccctgaaatagctcttcggtcaattcccttgcctcacctcatctaataaacatgaaaactgacccttaataagcattttccactttgctggcagtgtactaagtatattccatatattatctcaaataaatcttatcccagtgaagtaagttgtgttattatccccatttcggacaaatataaaggctaagatagattaggcagctggccctgctgcttggtcatgcagcaggggagctgggatttcagcagaggcctgttggcttctggactgtgccattacactcagctgcctattcatctttactcaagtccctgttaatgtaggtcactcagaggcattaaaacaccaattcatggatttctatcgcccttttctctgttcttattattgatattatacaaatttttcttagcaaaattcttaatttgaccccttgctgaccatgtgatttgattactaaaacgttagttctcagtcctcttccctggcagaaacatctgagggagtagggacaggacggggaagggtcaactcagttcccttaattcagatactttcagcacccctctggcttctgtaaactggctcgtcctgatgccccctaaaggatcctgtctgcctaatgttttttctaggaaaacttatcttaccaatggcccttgcataatgcccctttttcctttcagtggagtaaaggctgggccacctgtaaatggttagtgcactcagggattaactttaatagtaaaaaggtcctaagcattcttaaacaagtgttcagcttacaaaaattgtacgacattacgcttacgtgacaagtgtaatacagttgtttggtttagtaaatgcctaaaggagggtcattggagatgaatttgtagcttcagtaggttctggtaccaagaccagccctcatctgtatgatggcaactgaagactttcaggatattgattaccttaagaaggaatcatttgttaattcactgaccacactaggtcccaccgacccagccttcttgaaactcctttacctcagaattttaccacgccattcttacatagtactatttattcgtgtttttttgtttgtttgtttttctagattggttttgctttaacttggtcttaagcttctggaggatataaaatgagtatagtgagtttgttttcacactactataaagaactacctgagactgggtaatttttaaagaaaataggtttaattgactcacacttcagcatgggtggggaggcctcagaaaacttagaatcatggcagaaggtaaaggggaagcagggcatgtctcacatgtggcaggagagagagcatgtgtgaatgaggtggggaggtgccacacttgaaaaccatcagatcttgtgagaaatcactatcacgagaacacaagggaaatctgcccccattatccagttaccccccaccaggcccctcctctggcgtatggggattacaattggagatgagacttgggaacacagagccaatatcagtgagtctcatcaaatacacgtgtgggggaggaaaagggaagaggggaaggaggaggatagggaccaatttaaaaagcatggtgtagcatcctgccactgccagcaaggagcatatgcccccagggaatgtctgggtctggcgtcctcagtgggcctcagtactgtacagtcatgtacatatgccacatgcactgcgctgccccgatggtgctctaaggaactgactataagcaaactttagtatctagcccctagcataatatgtgatttcccccgaattcaatacttaatacttgagtgagcctgattcccaggtgaaaacgctgatgaatgcagaggcatagattagggtattaggcagctacatcttaagaatttaagaacagtggtactcattcagcttaaaaagctgcttctgtggaatttgcatgatttctctttcatggacatactcactggtgggctacaactgttggcattaaaaatccagcaccaaaatctagatgagatgctttcatcatctaaatctcaaaacactgaatacgagataaaattacacaaataagtctttaaaactttctcagagaaaaattataacaaggatttcaaaagattctgaagggaaataaaggcaagtatgatacaaaatccgtctaatagtatataagtaaaatcccaagatatcatatctatctatgacatctctctctccatatctacatctaattttaaccaaaagaaatctccttgggaataagtctgattaatggcttctaaaaatgactgaggaaatatttcctcctgaatttccttattcagtctttactcattactctcaaaataacacaataggagcctaaagaagctaaatgacctatttcttcagagaatccatttcttaaagggaaaatgaaatattcccacttcaggtggaatcacatttatataacctgtgcattttttttgaagtgtattgagtaaagtgagcgcttttttgttttggtaagttttttttttctttttttttgtaaatggaatcattttaagtatgctgagagcttactatcttaaaggaacacttaaatcctttcataatgaaaattgagtatattaaatgtgtgtgcttgcatacacgagcgcacacacacacttaagtgactgttagttcagtgccaaaagacttacagaaacagggatttaagcatactaggcatccagaaaaggttatggggatctacaaagcgcctacttgggagaaaatgttgtgtttcttgtggtaacataagtgaatgcatagaacaaaccgttttagagcaccgccaggctattatagagggttaagtgcaggagtaaatgattcagacaaggactcctcaccctgtggccaggtagtcacaaggcggggatcctttaaaaaggtaagctctgcagcactttgagaggccgaggtgggcaatctcgaggtcaggagatccagaccatactggctaacgtggtgaaacctggtctctacttaaaaatacaaaaaaattagcggggcctagtggtaggtacctgtagtcccagctgctcaggaggctgaggcaggagaatggcgtgaacccaggaggcagagcttgcagtgagccgagatcgtgccactgcactccagcctgggtgacagagcaagactccatctcaaaaaaaaaaaaaaaaaaaaaaaaactgtgatcttgtaggtctaaggttgagtctgaggagctgtatttattataataagccccacctgttgaggatggatgctgctggtctgaagaccatactttgagtagcaaggggccagtatagacaataacagccatcggagttcaaaggagagaaatgaatatggtctggccttgagacctctctcaaacctaaccatgtcttctagtaatacgaatcctgtcttaatctgcttaggatacaccttaaacaaattaagtcatgatttcatacacaggtatatatcggatggagggtttggtttcagaccactgcaataaagcgagtcacacaaatattttggtttcctagtgcatgtaaagtcatgtttatattgtagtctactaagtgtgcaatagcattatgcctaacaacatgtagaaaacttctttattgtaaaaaaaaaaaaatgctagcaatagttgaggcttcagctaaggtctttgggaagtggttggtttctagtgagactgtactgtggaaaggcagcctgtgtagaggttataagcaccagctttagaatctgactgctagggtataaatcctgtctctaccacttatcagccatgtaatcttgggcaagttacttgacttctctgggcttcagtgtcattgatagattttttttaatccttatgccaatagcacattgtcttaatttagctttatattaaatcaagatttaatatagtgtgagtcctctaagttcattgtttttcaaggttttagttttttaaaaaacctattctaggacccttgtacttcaatataagtgtctggatcagtttgtcaatttctataaaaaagcttgttggaatttcgattaggattgcaatgaagcaatttgaggaggtttggtaccttaacaataattgagtttttcaatccataaacataatatctcttcttgtctttaatttttctatgtagtattttatagtttatttatttatttattttgtcagatggagtctcgccctgttgcccaggctggagtgcagtggcaccatctcggctcactgcaacctctgcctcccgggttcaagtgcttctcctgcctcagcctcctgagtagctgggattataggtgcgcaccaccatgcctggctaatttatttgtatctttagtagagatggggtttcaccatgtttgccaggctggtctggaactcctgaccttgtgatctgccggcctcagccccctaaagtgctgggattacaggcgtgagcgaccacacccggccattttatagtttttaatgtaaaggagctatacatctttttgttaaacttaagatcttaagtaccttatgttttttgatgctattataagtggcattaaaattgttttccaaaatattgctaccggtacctacaaattgattttcgtatatgatcttgtgtcttgcaaatattgttatactgaattctagtagggtttttattgattaggataataggattttgtaactgtagattaattaggatacacaatatcatctgtgagtagacagttttactacttattttccaatctttataccttttatttattcttgctttattgtactgctaggacctgcaggctaataatgaataaaaataaaaatccttgccttggtcttcatcataaagagaatgcattcagtatttcagcattaaatattttagcttacaggtgtttcatagttgccttttattagattgggaatttccattctattcttaatttgctgacagcatttatcatgaatggatgttggattttgttaaccagcaaatctacatctattgagatgattgtattttttttctgctttattctgctatatattctgctagatttttttgagacggagtcttgttctgtctcccaggctggagtgcagtggcaccatctcggttcactgcaacctctgcctcctgaattcaagtgattctcttgcctcagcctacctagtagctgggactacaggtgtgcaccaccatgcccagctaatttttgtatttttagtagagaaggagttttacaatgttggccaggctggtctcaaactcctgacctcaggtgatctgcctgccccagtctctcaaagtgctgggattacaggcatgagccaccacgcccagcctttattactatttttttttaagatggagcctctggtgtgtggtggcgcgatctccgttcactgcaacctctgactccctgattcaagcgattctcctgcctcagcctcctgagtagctgggattacaggtgcccaccaccacgcccagctaatttttgtatttttagtagagacaggtttcaccatgttggccaggatggtctcgatctcctgacctcgtgattcacccgccttggcctcccaaagtgctgggattaagggcgtgaaccatcgtgcccagctgtgcatggttgctttcatactagcatggcagaattttgtagttgcaacagagaccatatgaccatcaaagagtaaaacgcttactatctgaccctttatagaaggtttgctgaccccttatataatggaaaagaaattgagattggagaggtaaaattagctccaagttttcagaagcagacaaaactcattttgagtctttgctcagtttgttactagatagagctctctgacctttgctagaaattatttaaaaggaaagtgaatgtgaaaatgtccagcaaactggttggtacactttataaagagatttggggtttcggccaggtgtggtggctcacgcctgtaatctgagcaatttgagaggcttgaggcaggtggatcatgaggtcaggagattgagaccatcctggccaacatggtgaaaccccgtctctactaaaattacaaaaattagctgggtgtggtggcacacgcctgtaatcccagctactcgggaggctgaggcagaagaatcgcttgaacccaggaggtagaggttgcagtgagccgagatcacactactgcactccagcctgacatgccatgcaaccatttgatttcttattttgtttgctctggaggagttggattgaatgaggtcccttaaagggtcaaatagctcagatgtagatgttaaaggtatcccccactgttccatcagattggaaggtgatcctcaaatgacgcttgaattcaggaataaactttagccacacacacgtacatacacacatataaatatatgtatatatattttggggtacctattttcaatataaggactcttaagcatcaaacatatcctaaaataatcggtcttcagagacccctcccacacagatgcttttatttttcccaaaacaagcatgaattgacttagaggctggctcaaagatataacggcaccctccagcatggtgaatgcactcaagagggcattgtcccttaccacagcttccattccttgcacctggctccaacccctaggacatcagatacttggatgggtagatggatgaaccaccattctggatagtaattttcgtggttcccaagcagcttttttactctcagtggatgaaaaccaatacgggggaagagaagggaggcagaggtgttacttacctctgtataatagacatgtaggatcctcaactccagcccaggtagactcttattggggattaaatttgatctaacatgtgacgtctctggaacaggagctggtaaatggcagactccaatttcattaggggtcaaggagctagaataaagttacccttcatgttatctgtttccttgaattttcttagccctggacattaaattctgttctttaaaagtcgctcattgaggccgggtgcagtggctcacctctgtaatcccagcattttgggaggctgaggcgggctgatcatgaggtcaggagattgagaccatcctggctaatacagtgaaaccccgtctctactaaaaatacaaaaaatcagccgggcatggtggtgggcgcctgtagtcccagatcctcgggaggctggggcaggagagtgaatccgggaggtggagcttgcagtgagccgagatctcaccactgcattccagcctgggctacagagcgagactctgtctcaaaagaaaaaaaaaaaaaaaggtttctcattggaattgaaaatttcttcctatgacgtgtctgagaatatgaagtaatgaaaagtgggctgggtcagccttggcctgaagtgatgcttacatgaattaaccatctctggagggatactcgtgtcaaagtaggagtttattcatgcttgactctccagtgtgatgtctgggattgcttgcgccagctctgaggagggcgtgcttgtctttctttgtgaaataatagaatatggatgaatccgtttccccatgaaaccatttctgttgaactaaaatacaaaggaaaatcggtgaccttgaattaggcttgtttgcagtgttattagctttcaaaggccctttcatttccatttaatgattttcttctgaacaaactattgtaagaacctaatgcaatttttcaaaaccaacatcacaaacgtggttattattttgtagctaatttggttagaaaactatgaggccctatgtattaaaacgtcatgccatcacttctcagaatggcacttttaaaaactggattttagtcttctggataacgatttcttgaactactgttatcaagaataagtggtatttttcatgatctttcttgtctggagagttcgtgacaggaattttgtgcatgaaggatgcctgtgttgttgaatgtgttcttgcatccatcttgctcttactcagatgtctgaagctatacatgtcaacttactcattcaacatgtatttataaaagtgtccattataggctaggcacggtgctgttctgggggtcatcaatggaaaaaacagactataaaatccctgccctcctgtagctaacattcttttaaaatactgatggcagaattttaaaacactgatggcagaattggaaagaatgcccccgatacaagcaagaatgaaatacagtttttattttctgcatctaaaaatcacaataagtaacttacctcgtacttctaagagtttgaatttttttaacttggtaataattttagtaggcagggtgcagtgactcacgcctctaagcccagcactttgggaggctgaggcgggcagatcgcttgagcccaggagtttgagacaagcctggtcaacatggtcaaaccccatctctacaaaaaaataaaaaaattagccagacatagtggcatgtgcctatggtcccagctactcgagaggctgagatgggaggatcactgagccctgggaaggtcgaggctgtcatcatgccactgcacttcagcctgggcaacagagtgagaccctgtctcatactactactactactactactactactactactactactactactactgctactactactactaccaataataataataatttagttgctctgataaaaggccatgttactttacttatggctactatttgagtgcccactgtgtctcacaccctgtgctgagcgttcccatttaccccatttggcagatgaaaactacagcatgttctcaactcagtagagagacacactcttacacatggaatcttaaaaaggttttaattagtcacttacaccaagttctgtgatagttccacagtgactgaatccaaactgcgcagaattgagagtagtgggcaagagtcaacgatgggtttccagttctgggaacttgggagactggggtgaaacaggtcccctctttcctgcccacttactcctccaaacaccaacttgctggatgaaatattacatatgatcctcattgaaagagaaaaaacttggaaagagaacagaagggagaggaaaaagatgaaactgaaggggaagggagttgttcttaaccacaagagcaaaacaaaagccagagctccgtgtgagctgccatagtgtggtgtctgtagtttctgtatggccaggaagtgcccttggaagcaagtttcatgaacataaatgatcaaagccaactaaactggtcaattagtcaaacttggcttccttagaaaagaataggacctcaatttagccctatttgtcagctagaggagtcaatgcaattgaggggtaaggggttgacagtggtaataaatcattgggcttttttctcggctgtatctttgcctcataccttcgtcaagccaccctagaccctcctctagcagctccaagccccttttgtttgttgtcacttctatttaagcctttgccttaggtaccaattagtgaagtgattatcttaaagttgccattgtcaatgctttggagaacgccttgcattttgaccaagctggtgagggaattgttaagttaaagatgaactctgcatgattaaggtatcaaaacggcttgaagactgccattttaatgcacctttcacaaggctgtgcaactctatacttaaataagtggccagttttgtttttaagtgacgagccacatggagaaaatacttccaggatttcagttttgaaacaattgaaattctcctcctcttagagtgttagctcctgtgtgtgtgaaatacagctggtcacctctccctgtggtgctgactctccactcacggaccgggcaccatctgagatgtttgacagaacattctgaggaaatggaaatgatgaaatcacattgaattcaacagtagaatgataggccatttaatgcagccttaatcttgtggctcagttggtgtggtgtaatattaggcttgcattctaccttccaaatcccttgatagtataaactagcaaattaagacttaccctgaaaatgactgtgtgctacactacaagaaaggtagaatgctccaggagcagtacagatagaggtagtaacattttgccatctggcaaagccactagaccagatggattcattaatgacttctctaaagtatttaatcagacattactgaaacacatgactggcatatttaattatcctaaattaacaggacttctgccagatacaaccctcaatgcttgagtcatactccttgcttaaagagaggaggaaaaaaggatgactagctccagaaagctggatttcacatagacctctctcattagtgaaacttctcattagcaaattgttgtgttacagtcttaggcagtatttcttctttttcaaagaatgcactgtaagactagccatgctgatcaaattcttttatcagtagcaattatactggtgagaacctctgcgagttgataaatgtgacatagccatcagacaaccctgcccacttcctgcctgtggaagacttctaaaccaacagatgccttcttgtgtcagttaatcaatttatatttctccaggatcacttttgttttaatctttgtatttgtatcagaacaatggagacacaaaataacagaaagcattataatgtaaatttgcccctgctctagtctttcctatctgcaatctacttttcaaaggaacacttctaattttcaggactgttctctctggtggttacttccacatctcaaaacagtatggttaatggctatttcttattttctttagacatgttgacttccttttaacatacatgaggatgtagcttaggtataccattcttacatcacttttcttctcctccctgagggttattttattttttattcccttaacgtttacctttgtagctttaggttatattttcatacctttttatttttgggattgtcaactagaaacagtatgtcttggctcctaacatatgttgaaggtattagtgacttgagtattccactgaatgctccagagttctttcactcaatgtaatatttttgagattcatccatgctgtggatgtcactagttccatttctgtttatggctgagaacaattccattgcatgaatagatgataatctatccattcacttgttgtacgtgtgacctatttccgatttctggctcttttaaatctgtgaagacttgtatgcaagtctttgtttagacatttccttttggtttcccttggataaattctgaagagtggaattgctagatcataatggtacgcatatgtttataagcaactgccaaaagacttttcaaagtgatttatcattttacatttcctattagcaatatatatgcattccagttgccctgtgtctttagcaacacttggtattatcagtctttttaattttagttgtccttaacattgttcaagtcttccagcatattttaaattaagttgtgttcttattaaattataagcatttttatatattctgggtagaactttggtgattttgttgtttttttcttttcattctcctagtctgtgttttgcattttcattttcctaatagtgtctatcaaagaccagaagtttttatttttaaagtccaatttctcctttgtgtaatggttcatgcttgtttgttctctaagagaccattatctttcagaggtcacaaagattttcttatatttttttctatcaattacttggtttagctcttatactttttgagtttttttgcatatggtaaaagggaagagtaaggttcacttttttccatatggatacctagttgttccagcactgtctgttgaaaaacaatcctttcccctgatgagttatcttaacacttttgctggaaatgagttgatcatataaatgtgggtctctctatggattcaattctataccattgatttgtatgtctatccttatagcaatattctgtcttaattccttttaataaagactttaagcagaacttctacttttgttaacattttttctgacatatacatgtatgtatatacatatatatgtgtgtatgtatatatacatgtatgtatatatgtctatattttagatcttttctccttagggaggcatcttcagataactgatcttgtccattccaaatggtttttaccagtttaaatcacagagaatagtcttatttttaaattcaaggagagttcaccatagctctctatgtacatgagttgctcggacttagaatgtctgttcctggccgggcgcggtggctcacacttgtaatcccagcattttgggaggctgaggtcggtggatcacctgaggtcagatattcgagaccagcctggccaacagggcgaaaccctgtctctactaaaaatatagaaaatagctgggcgtggtagcacgtgcctgtaatcccaactactcgggatgctgaggcaggagaatcgcttgaacctgggaggcggaggttgcagtgagctgagatcacgcccttgcactccagcctgggcaacaagagtgactccgtctccaaaaaaaaaaaaaaaaaaaaaaaaaaaaaaaagaatgtccgtttctgggggtgaggggtaggtttcatgtgggtctatcacatggtggttaattaataacaataccacctatatagtgctaggttttaagtgctactgttttaatcactgctttaggatttattaagtactcatagtacctactttctttgaggtaggtactgttgttattcccattcttatggatgagaaactggggcacagagaggttgagtaatttgctgaaggtgatatatgagaaactgttctttgccagtaagtagaggagacaggtttcagtgatgcacttgtcacggaacaaacagctctccaggagaaaaaaaactatgcatacgcattaataaacttatacactttactgacataaataatatataatgcacaacttacaaataataaagtgtcatactttttattccacatggccaatcaattctgatagaatgcttttattgattttttttttcctctttttctaaactcctatatctgtggtcagtctatggttgcagtttaagcatgacttgacaaaatcaaatgaggaataaattcttgattaccatctggttcagcaaagaagttgttcacatcattggcaaatgattaaagttccaatatgtatatgttttacattttccttattaatgtaaataaagctatcagccaacatttgtgttggaactacacttgttggtcagtgatgtgagagaatattgaggacgttttctcaattttatatattcacaatgtaacagctacagagtgacacgcttttatgtttattctgcattatcaacattttatcctatctcttaagtctagacaatcaacaaaacaataaattaagccctgatttgtagcacttagtgatttccatgatgtaaatatacccactatggctgacttcaagccaccaatgtgacatcattgaaaatggagttgggaagaggtgtggagtaacacaccatctatggtatttctaccatatggataggatagcaataaataacctcacaactatagacaacagtgaaatgtagtaaaataattaccaagtgacgagctttcagtatgtattacctttgcttttaatataatttatgtaattgtaaatcaatataatacctaacagtggctgtgattaactggtttacaaagttgctaaaacttaatcagtttttggtggccagtctaagctggctccaatcatgccactgtatggctgtatttttaaccattcttttatacgaaggtattgctggaatatagtttcataccagtaagtatagcatacagttatggcaaggtattaagtttattttactaaatcacattctcattagatgcaccactcatcaagcttgttaaagtccagttttagggaccccccctgcttaactatggattatacgggttctgtggggttcacacaattcaggaaaatggcaatgaattttgctgttttgtccatgttgctgtcattcctgtttgtgctgcccaagcccaccaggaaggcagggccctctctgtggtgtcaagatcacagttgtggtggggtactgaagtgctaagcgcatctcttgggaccaggactggaacacagccatccccatctgaggttccactacctccaggccactgttcaaatcaggcctgcctttgccttttctgccttgcagatgaacatccactgaggttgggtcactcccccttcaatccccaaagcagcaacctccccttctgtcgtcagacaatgcaacctaattttgatgtgcctctgcctctgacatggaaaagctgctctcaaggttatcttcagggcagggagggagaaggctttcatgctttcctggtgagactttttttttttccaaaaacaaaacaaaaacaaaaaaaactaaacatataaattattactgagagaatcactgaagcagcctgggcaaaaatgaaatgaggcttaagaattgtgaacattttttaaatgctgcacttggaacaagtgctcataaaattttttgcctcaaggaatcaagaatgattaatattgatgagtgttttgttgttgttgttaaacttcataagcaaggctgtttccttccatgacccttttgattctcatcttttctttttcacaagatgtttggaaatcttcgtgatcttatctgacatcaggaagacatgcttttccctcctggcatgctagagaaacaaatcaatttcttctcccagataggttgatgaaagtccttctctgcagtgctttctattgctatggtaacagaagatgggatttcccaacagaactaggtttatatattaaaaaacagttctttcaaaacttgatcctttttttgttgccatatataaaatacaataaatggaataaactgagtaccaaaggaaaaacagtcacaccaaaactttttatgtaggtgtggaatgagactttcattgtcttgagactcgcaatgaaagggagtcaactgtaaaagttttaatattgtgacagtgctgtcgtagctaaaataacttgcaaaagttgcaagtcttcttagaaaagcaaagaattaaatatatggactctcaataggcagatagacttaaaatagagataagtagtgtccatacttccagtcataacatggtaaagaagatgacaagaagcccaaggtagaataagcattttgtgtgatggtggcactctccgcttctgtgacttgcgctatgggaggacacaatagttggccatttctcatgagatcttatcaaaagcccagggattcaggggacagggttctttgcatcacagtccctcaattatatgcaaagacctgaccttttaatctgctggttgactaacagcatggctggagggtgacttctgaggctcagagcactcagaaaggagcagagagcaattgtgaggtaggtagaaaaggatggacttggtttcatttggggaaaattcaaacataatacttccctgtcatttaaaatgcttctgaactaaaattccaaagatgtgtggaattttatttattaaataaatacttattaaataaatctgtaactccaccattattgataccttctattctcttgcaaatctagtgagtaaagttcgtgagcttttctccttttttgaggcttaacgtgcttttgaaatgacatgacaaatttaaaatagaagtaaatgccatttggctgtgccctggatgagacatggatgccatttggctgtgccctggatgatacatgtcactgctgaaaggggtggagtttctgggaagcctgatgggaaaggtaacaaatagtaaagtgaataaaggtggttctctgttcttgctattcttgacatggacatagataaatggtaacattatgagtcactctaagcaatcatgttacatcaagccagagaggtgatgtcacagactctggctcatgaaaggagaaaaagctcattttcttaatgtacccaaatggcaaaggaggactggagaaagggctgtaaagagatgatttaacaaacagtgtgaaggaacttctggcaagaaaaaaaaattgcaatgtgaactttttagtaaatgtggtaaatttatgggcttcaatatgaatgagaagaacaataaccagcataaaaatactttaaatccaaaatgtgaggtgttttggggtagcactgcttattgagtaactaaggctcgtaagttatttgaagacttgttgaaatctgtttattccattccccccaaccccgtcattcaaagaactgcaataaatcaggaattatggaattagaacaactgctcggagcagtgatttattatttgcttctggatgcttcagaatctcaagaatctaacaagtatctcaaggattttaaaatagaagctgtgatcacagcaaaatagtataatttatatctcttgaaagtgtttctggccttccaggggaaatatgctcattcttcattttctagtccctgggtagaacctcttgcctattgcagggggagaggcaatatggcagccaagatggttggcagcattcactccctcttcaagtattttgttaatgcctactctgctgtatgatgttccaggaactgtttagagtgatggaagacagcccctgccctcacggagcatacaatctagtcaatcctcttcttcctagcctttaggactccagatgtgatgctaacctgagcagtctccttggtttccccactaaaaattggatagttaggccatcttttcccaggatcaggctcataggcttcaaactttactgtagccaggctctgtgagttacaaaccttgttgcccgcacaaaatcttctgtcaactttaatgtgcccaagcttgtccttgagtctcaaacatactaagcatttccccctctgttctcacccccagtagctcttgactcttctttatcccctctacccatgtcttccctccctgtctctccctggtccctaactgaccaccttgcctctcctaacacccctcacagatctgtccttacccctgcatttcatcactgctaggattaccttcctaaattatggaactgtttatgctgtgtcctgctgaaaatagtcagtggtaccctaatttcctggcctggctaaggcagctttcaagagctgcccctgcctgcctgacccatctcattttctgccattctctgtaagactgaaactgtggaggacattgtcttttcacgtgaatcccctttgcaccttgtctttcatatgaactcgtgtcttccctaatgtcctgggcagctggtcactccatcctccatctttctccatcctccatctttctgtgttactgtgtatgtatattgacatatcgtgattatttctttacatgtctctttcctctgaaagtgggctccttcaaagatagcagtgtgatttctgtttatatgtctatggtactgtccctgacatatcataggtccacaagggcctgttgaataagtgaatgagctaaaatatactggtttatcaacagggttttcaaactgcttccatccactcagcttaatgagcaaacatggcatgccataatcttgcagttttctgggacatctaggtactttgaaataccaggtgtgtctcaacaaaattgagattgggagggtcctttcttattgataatctctcaccaactgaatgctgaagtgttctacaaccttaaaaagttaaaagcttatagcattcacctgttgtgaaaagcaacccttctatatgggctatctttttgtattacttgcttatgaagattcctgaagatatattttccagcaagcacttttcagatgtccaacatggatttaaagtacatatgttgtttttggaagccatattatattcacacaggcatgtttatgttggttatagatatataatgctgattacacaaaagacaaaatttgtattcagtgttcgctctgtaccgggcactctgctaagtactctagattgactatatcatctattttctgtattatctgtatttttagatgaggaaactgaggcaaaagatgaagtaatttgtccaaagaaccagagatactaagggcagccaacatgcaaatccagtgtctgatatcagaacatatactctcattaacaccatgccaaacactgaaaaaaaaaaaaagtctacttccatttactgtgttaagcagatactgaaaattggaatgggaaaatttgtatttgttgattgtataagcagaagtttacacaatgagctagtttgctatataggtaatgtgctcttgattcccaacgtctgttttttagaaagacacaacgcctatacacaatgaatttaaaacattagggtgattttttttttttaatctaggaaaaatacttctcaacggctactgactccttaaaataccagttggtatttgacgaagtttcatttttatcgaactacagagaaaaattgctatacaaaccacaattgtaatttgtagttctttggtgtcacagtgatctatgtaaaatggaaactttaacttaaaatttgtaatctatagcaacagacacagaaacagcacatgactctgggacccattcatgctttgaaatcctaatgaggatagtatctagtgcttctgcaagtatgtttaattccaagaagagaaccttcccctagtaacaacatttaaaaaaaaattaaagtcaaaagctaacttgaaaacaagtaatattttgaatatcaataattaaatttcacaacataaagcaattataaaactatacagacgattttaaattgaataattacaatcacaacagcacctaattttcaaggtaaccaatgggtaagaccaaatgagattgtcagactgtgctaagcctctctgctaaagtgaacatttcaattagtcaaatcaagtaattaattactttggggacagttcagactctttctcttgagatcaccttgttagataatttaaatgagaaacagatttggataaaaggtgatcagtgttttcttcagttggaagatgtgaaaagaaaccttttctctttcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacaggtgtgtatctttttttagttgttttatttaatgacttctcacaactcacttaaaactataataggaatagccagtagattcaaagtccatcaacccttgctggttcttctggcacagcctcctagaatttttcacctgttttttcccctttaaagctatggcactaacaccaaactctggacaggccttggtttttgttcccctagtcccaccatctggttaaaaagcatccataaaagaagtcatgaattcatggtgatcaggttcaccatagcccagtaattctactttgttgtctgttgttagcttcctatttggagtaagggctagaccaagccttattcatagacgtcaagccctgagcatgtctgtagtacctcttgctttcaaaagatgacatcacctcctaataatccactgagaagattatccttgactctttaccccttgatgtcacttttagctgcttctacctgtcctctcccaattcagtctatcatcaattcctgggtattcatgtttctttacagtaactgacatcctctcctttccattcttcctgccactgtcctttaagtgctaataagtcagtgtcatgtctgacttagttgaatctcttagtctcctcacaggcaatttcttgctaatgcatttcatcaactgaaaacggtgtgaaagcattgtttaaaaccaataagagcttggagtactcaatgaataaagtccacactttgtaggtgggcattctattttagccaacttttctagacttttatccgttgtgccctcatagtcgaattggacaaatctgcaagactcctatagcagaccttgcatgtttgtacctctgggccctgcctcagtctgtcctgtccacctgaagtgtcctgctcacccttttgcccattgaagtgattcagtctccaaaggttttcacaaagccttgccaatccctcccaacaacattttctcttcttcctttgacttacagcaacactgggcagaaaagataggttgatacgttctagaaaagaaagtaaaaacggaggggtcattcctggctccggctgcattcatctcctccctaaggcggggcctcttctcctcatctccccaaccgcctccgtttcctgtgccacccttcctctgtctctctcaccctgcgtgtttctgcctgttaattccttcaatctaatttttgacaagtttcagagttaattctgtaagttggtgccatgcaaagatctgtgaaattattcatagaggcttaactgaaagtctgtgggaaattcagtggattataggagttgacctgggttgagtcacttttgaaaaacaattagcatttacttgctgttttctgctattttaagagagcatcgatcactagtcatttttctttctagaactagatttattacatatgtagacccctggaatatatgttctttattttactcctttgtaatctcatccagttagtcagtttaatgcatgcattcccttttatggctacataaagagataatagctggatgctagtatttgttcaggcttgcagttatattgacttcctgaataaactgaagtgaatcagaatccatacacatgtacaagtataaatgtatgcttatgtctgtactggtatgcaccttctctaatcggattttgttattcaagcaagcattctttatcaatttgttctgaagtgtcacaagaaaatgtaatgcagcagaggaaaatccagctttaaaaatccagctttaacttcatttttgtccatgttaatttatgttagaatcctagctattctcctttaggtttcattttgaaggatggtgggtgggggtggattgcatggtacttaactgtcaggtgagagaaataacctcttgtatgttagccatggtggatttcctggcttgttgatggctatttcttcaggtcctccttactccctggacagagttcactggaatcgaatgatatttagaaatgacaaatggtccatcacctcacaatagacaaaaggcaataaaaatgcttttcaggtagctatgggaactgtcactacagatgaacaaaataggtttctttcagctttttctccatcaggaaatgtgggttttacttcagtgcccctatttgtgttcactgctttttttctcttgaataagctgaatggaattcacccattcagattttcttatgaataaaaatacaaccacatcttgtttccattgctgaaaccctcagttaaaaaattatagcaaagaaatttcttaaggacacattaaaaaaccctcaacgatgtgtgttatattaaaaattcctaatggaagccatctttagtgaagaaagctgaagaatccctgcataacagcacatgtatacatttaaccatatgtggctgtctgtttcatccacactgtgagtgtgcatatacacagacacactctcgaatgtactcagtactcacacactcttacacttggggaataccatatttttaaaacccctttaatttacatacttcacttgacccatacaacaatccaataatgcagaaggaatgattattttttatacccattgtacaaatgagaaaagtgagatttaaggaggttaattttgcaaggtgttatgtctggctacttaaaagcaaaaagaaaagccaaatctacttatagttcagatttcttacataatactttctccttataagtgatatcctgcaagaaactctgattttggtatgactgttgcctgtttttcacacttttggttttgtatataatcatgtgggttgcattttattcttactttaaggacaggttctgacctgaacccagggaatttaggctgggaggtgaagtaccagattacttctacttagattatattatcttgtagtcaccttaaatgtttgtgaaattatagaaaactaaaaattaatgttcatttattctattcgtcaaacccttaaattttagcagttggaagcttttagactatagaattctgggttctattaaatctcacattaagattttacctaaaaattttaagttaaaaattccaaatgctgctatcaagttctgtttctgtagtttctattgacgtttcagagatctcctgagagtttatatgtatgtttcttacacttaaaaaggataaaggagctgtagctcttaggttcttgaaatttcagcatatactaatggaagtcatcatctattgtgttatttttagtttggggtttaagatgggttttgagaaatcggtttgttataagaaattcaatgcctaacccatagtaaatagtaactatttcttaacgtgtcagtaagtcttcccatcacttttaggtactaaattattgttcttattcttagcgtttagcctctgtggggttggatgccaaaaacacagtctgcatttgggactggaggaagggaaaacttctggcgtcagccaccggccattctgacagggtaagaacttgttggatcaagctatgcagatttcagaacttggggggacttgtgatatcgcgtctcagacttctaatgtttttaacagtaaatatttcagtatacattttttcctattaaacttataatcatcctcttttttcatgattaatagctaactgtgttaatgtgcttctggtgatcaagtactttatatgaattgttagtgcttttcataggcaaagcaaatttttgatgctggcattttactttatgaaatcaaaatggaattgaatttgaaattatgtgtagtttagatgtattcatttagaaatggaaatagttgttagaaaatagtcacaaaatatgattacaagggtatgcattttaattttgaatgagtgtaatgacaacttcgtgattctttgttgtatttgagaacatagaatgtgacctgcttactcctgttgaagtcagtgtgatcaaaaatgataattccatgtagtcttaggggatgaagggggtatatacatataactggtcagaaatctaatttgccagtgtcttgcataattaaaataatttgactcctttattatcttggtttctctaaacaatgaatttgcatgactgtcttacttgaattcctagttgttttgtatttctgcacaatataagtgttaatgtagaataggcatttccagtcttttggcttccctgggccacattggaagaattgtcttgggccacacataaacaccaacactaatgatagctgatgagctaaaaataaaataatctcataatatcttaagaacgtttacaaatttgtgttgggccgcattcacagccatcctgggctgtgggttggacaagcttcatgtagaatgaggctctaattaaacatgaaattcactgtctcttgcttagaaggaactcttaaaaaaaaaaaagtatgaatggcacattgatctatggaggtttgtagttgtaaggagaccccacagatgttgcaaattctactccaggatcaagtcttcagaaagctcaggagtgaccaacaatagaacctcagtactggaagaggcctggtacccctctcgtccagtagttcccaatcctggctacagatagaatcctctggggagacttcacggcatatatatacactcatacataatattttatctgagttactctgcatttactgcttctatttctgagtcattttatatagtctgacctgaactagtatactgtctgtcagaattttgggccttatcaccttggaaaaagtagaaaactaaagttacaaacagtttaaaccagtaaaatctccttacttagaaaaatagcctaatgtaatcactttggcttgtatagaaagagcttttattgttaaattattactgttaaactaaatttggcctcagctgccctccatatggtaagtctctacaaaatcaactgcaacctagcttgctaagtgaccaaactgaaaatttaggggtatacttccgtaacaaatagctgagtggcagccagcttcagccaatggcaggctgccatctattcagaccatgcccaaataaagcaaattcggtgctgaaactaggaaagctgttcctgtacctcagttcattttccccaggatacatatgcctgcccagttgcagagcagagctctctgaacctcttctggttctgagggctgcccaatttgcaaacagttgtttgctcaattcaactctgttaaaactttagataaattgaacacctctggatatcatgtgacttgcctgtatgtttcagtgactgtgcatgtgctattgctgtgctaccgcttgccagtaagggtgaaatgtaaaaagtataataggactatagtgatgagtctgtaatcttaggatgttttaatgaaatgctttatttggaacactgttctcccagaccccataatctgtgtcacacataattttgctctttattactgataccagtatgaattattgactgcttatgattaacttcaagattatcctcaagattattttagtggcactaaaatacttaatccattacatttatataatgaatgttttataccctgcaaaatgactttatataccttatcttcattgaccttaacaaaacttgaggtggtattatccacgtagagaagatgaggttaaggttagagatgctcagacttgcctgagcttgaatggctgaaatggatacttggaccaagtactttttcttcagtgatctttctggggaccataattgctcctttatatgtgatgaaaagttagtggtctaggttatttctctggtctagactttgtccctgacaagtagtccttccctttctatcagtgtgtcatggaatgcgttccatggatctacctccatcagaatctcctggagtctctttaaagtgttgggtatctgggcccaattccagacccactaaatgagagcatctcagatgggccctggaaatacctgttttaagcaattgctatgggcaatttgattctcaggattgaccttttccttcttgtctctggattggaaatagaactacgtgcaaactgtctggtagctcttgttaaagaatgacaaataggccgggcacggtggctcatgcctgtaatcccagcactttgagaggccaaggcaggtggatcacgaggtcacaagattgagaccagcctgaccaacatggtgaaaccccgtctctactaaaaatagaaaaattaactgggcgtggtggcacgcgcctgtagtcccagctactcgggaggctgaggcaggagaattgcttgaacctgggaagcggagttgcagtgagccgagatcacgccactgcactccagcctggtgacggagcgagactgtctcagaaaaaaaaaaaaaaaaagacaaatagtagttgcagatatattttcagttcattggataattgaaaatacaatagtatgttgggtcagattaaaatgatagcctgagggactatttaagttagtgacagataaatccctctgccttacgtttaggaatattaacttctgtgattactagagactgttggccgcattaaattgtagttaactattgaatgttttcctagctaagaagcattttataattctttaaatttctattgaaaagctatctccaaagtgttagcactgtggagtgctattgaaaaatttgatcaaaaatttatcctaaattgtccatttgtttatctcaaatggacaaaattaaaaatatgacaccagtttgttctaaataattatggtaagttctctctctactcaggccttaaggtaagtagatatgaggtgataacgtgtgtgttagttcctgactcattccaagccaaatcttccatttttattctgtgcaggtaacattgtgttctaaatgttatagtagagtcttggcaattggactagtattgggaaaaggcaaaaatataccaaatgatcaacatggcaacttttaatgttttgaacagatttttgatatttcctgggatccatatcagccaaacagagtggttagctgtggagtaaaacacataaaggtaaagctttttgttttttaattttggtaccttgagtgcaaataattttaggtgtttgtatagataatttgatgttgagagactgctagactttacattttttttcttcaatatagagccctcttacctgtttctctgctcctgaagcaaactaacatcagctgatggggctctctcttagaaatgcaaagtaatgacaatcaagtgaagtgctccgcaggcagctgaaaaggaaattttatgttaattaaatatcgaactgaagactcataatacttgtgggattgcatgttttaaaacagtgcttattttaatgttgtgaagtaagtttttccattataatgaatatttacatatttgcatgtcaacactttgacatgttatgttcccttaaaagaaaggtgtcaagttgtgctctacatggaaatagaggaattcacagtacaaacctatctggaccattggtttttaaacgccccaatcttcctctagactacactctcatctgggtagacctacatttgcttcttactattttgttcacaagtaacaaaattaactgcatcaacatgctttgctctgacatagcaaaaatttctcctgacccctgggatatagcccaggatcttctttctctataggatcgtaaataatgtaagttaaagtccataaacaagagtataaggattactttcttgaatagagcatgcatggattctgtacaaaaatggtacatttctgtatgaatgaagattttcctctaaccaacccctcctattttgcagttcttttagtctagtttttcacgatccttcccattagtcttacttggttagaaggggacagaggataaaatactcaaataagtataagaaatatggaagacttacctaaagaatgttacaaaactctgcagaagaatgtaaaacaatacttgaacaaatggagtgacaatgttgattctggacacgtctaaaatttacaaatgtatcatttatctccaaatttatatttggtagaaatgcagttaaaatccctattacttttgtttttacctgacagaatttccctttaaattatcctaaattaatccggaagcattaaataatgacaataactatgaactttgggataaagaatcatgaagaggatatatgtaccactatttactaaagcataatagaatttaatttaaatgatacaagacttggatacaaagaaataaaaaaagctgaaaaatagaccttaatatgtatgacaacttagagtataatagcatctctaactggcaggcacaaatttatcaattttttagaaaaagtcaatacttcatactatacactaaaacaaagtctatatgaattaaagaggtaagtttcaaaaactataaaataactagaggaatatataggcaaatatttaactgctcaaattggagaaagatttttttaaaatgtaaaagcaaagaaatcgtaaggaataatactgatgcaactgtagaaatattaaaatattctgtataattccttttttccacaaaaagagggaaaccgcaaactagcaaaagtataagcaacacacaaaatagatactgggttgttctcaaaatgcaaagatctcttgcaaatccgtagaatggacaaagaacatagaaaactgacaaatagaaacactgttggccaatagacttatgaaaatgttaaaatctaattaaggaacacaaattttaaaataacagcattttaaatctatcaaatttatgattgaaagtaccgtatcttggcaaggattcagtgaatgaccactctcaaaccttgctggtagagaggggtaagctgataatggtctttcagccaagaaatttggaaatatttatccttagaaatgtcaattctctttgatccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaatttaaaaatggagaacaaaaattttagaggttccactactcaaaagtgtaacatattccatcaacactttagggcttcataaacatttaataatcctgtaccaagccctgatgtgtatatttttaatctaggaaaacatcagctgaaatctaggtagtttgctttattagcagcagctggaggctccttctgtgcttggtacagcatacctgaaagaccaaaaactcattcagtttaatatttgagtttgtactaggtgaaagaagaaaaacagacgccactttcaatttgcttgaagtttagccattaaaacattaagacagaatgttttggaagaaaggtaaaaatcaaagccctctatcgataaagatgacatcccagctggctagaagcatgttgtcaggatggagatgctgcttaggctgagcctcagtgggtgggtgagtttggtaggaagggtcgggaggcagaactaggcgaggggttgcacttctgtcaggagttaagagaggcattggtcacccatggaagtgtgagactggggagctgggtgggtccttggctcatgatatgttccaagattaccaatgttttcatcaccaaagaacctattccatagttttttttagggaacaaatattttgaaagatggcggccacaaaataaactagccaataaatcacgggttccttagcaatgttttattagtcaaagatgttatctgccaacgtgagtttctgatcagactaaaatatgaaaattgtttcagccatgagtaaaaaaaacatgtgagttcataatgatcctgatttctgttaggctgtggtgggtttctggaaatctgggaccctatcctgggagccatcatccatcctgtactcagtggtgaagaaacccaggaccctagggggttaggtgggaatctgactttgatttgtgattgtttccctctgcttgactctgggcaaccatttaatctccctgaggctgaattaatattcattcattcattctctctctctctctctctctctctctttctgtctctctctctctctctcagagagagatcactacctcctaaattaaagataattacattaaagagtatggaacccagtaggggcacaataatgttaatttcgttccccatttcctagggtcacaaaaatgatggcacaggtgagatttaagctcagcctctgactcctatagagctctttacactgagaaatttctttagtgaactaccttgccttaactttttattgggttctaactagatttgctgcttaattgatagaattctcctgattccttcctatctctttctgtccttggttaactctaacttttaaatcggtaaattctaaaagcagaaaagcagagacaaaattctgaaactttatttgaaacaagagctacttatcctgtttaaatttaattgtcttagcagacttggacattttttctaagcaaatacaagcatttttacctcaaagaatctggaatgtctacccagcaatactttattaattttgcttagaaatataatacatttaagcggacttcaaaaaattatttttgctgtctgtattctctatatccaattaccaggatttctccacttttttttccccagaaaacctaccttaacattgaatgattccagtcataaattgagtgcaaaatctttgtactcaaagaaaatactttcatctgaaatttgtatagctagggtgaaatcctttttggctttgtaaatcccctatgttttggcaaataggaaaattgcaattatctgaaacgaatgcttgaaaaacagtaacagttgagcatcggctgcttcactggttttatagcaaatgagcctaccgggtttgtggatactgttgagccgtctctagtcagagacagaagggacttcagggactacctagggctagatgaactcaaggtacctgccagctctaacaaaatttgcattacagtctgtgggtagagactgcagaagataaacaaggtctcctcatttgatgtgaatttaatgatgtgttgctaccctaaactgccactgttttccaagtaggaaatgcttctcaaaaagagataatatttcaggtatttgccattttctgcagaaaataacatacattttagggaatcatttgactctttggaatgttttcatgtgggccttataccatctgacctggtgacttgtcaataaacttttatgtagatcaagtctgaagataatgggttctattttttgtgactgtctgtctggaaatattcagataactcagacggggggtgtatatccaaagttaaaggacaaaataattattttaatcttcatgcatgaggaggtgtaaagagaaagggaactgtctgccttaagcattgctatgaacagcaagttctttggcatgttggtgcaaccagtaatcatttatgtctaatagtttgttcaggttcatagtaacagcttaaatgttttccaaagcttatacctaactagctttttcctagatctctttattctttattaaaaaaaactttattacaggtgtgtgctaccactccaggctaattatttttgtagagatggggttttgccatgttgcccaggatggtctctaactcctgggctcaagtgatctctctgccttggcttcccaaagtgctggtattacaggcatgagccactgcacctggctgctttattatttcaacatatacttcaacaccttttcattaataatacccaaagaaatgagttaccagagctgatacctttttctgagaagagaatccgatttggtccttcattgtgtatctgcccttcattcttgccaaggcatccctctattccttaaccccctgccacgcacacacataggacagccccccacccccagctgcctgaatcctggccaccttgggggtatagccatcccagaactgtttcctctagtacccaactactctgagaggaccatggtttttcctctcctacaggtgtaaaatagtacaatgttactgatttactcccacatgcctgccatgtggcttcatctcatcctgcttctctgaatccagatgcagtttcttcctcactgctgatccaagtcctactcttgttcattctgtttaattcaacttagttctctacctttgaatttcctgccacccgggcacagtctgaatatgctaccttaaaattatctcattgtttcatttgcctctgcattgattcagagttgtcaaagcaaagacaaagatttcagtattttttctaaccccattgaacccttatcttcagtgagctacttctgtttgctttccctcccctccagatggagatgaccatcctgtctaccttagcctattaaaggttttgataggatcaaataacttagcatatgcaaatagcccttataacctgagggggggctatatcaagggcagtgaggttattctagttgatacatgaaaactatgttaaggttttgagaggccaagtggggcagatcacctgaggtcaggagtttaagaccagcctggccaacatggtgaaaccccatctctactaaaaatacacaaaactagctgggtgcggaggcacatgcctgtagtcccagctactcaggaggctgaggcaggagaatcgcttgaacccaggaggcagaggttgcagtgagccaagatcgggccactgcactccaccctgggcagcagagtgagactctgtccccacctgcccccccaaaaaaactatgtcaatacaaaatattttgtgtctgtttaaccataggagtgtccttactgccttgtataaaattgctgaagctttgtgtatggtcttctacacaatggacacattttatgcaactaaaactgaaaagccgagtcaattatttgggtatatggaaatataactcatatttatgaaacgtttctaagtaacatttctacaatgaagatttataacacttaaagttagaaattatttccaaatatatgtacactaaaaatacctagatatagccgagtgcagtggctcacacctgtaattctagcactttgggaggccgaggagggcagattacttgaggccaggagttcgagaccagcctggccaacatggagaaaccctgtctctactacaaatacaaaaattagctgagcttggtggtgcactcctataatctcagctactcaggaggctgatacacaagaatcacttgaccctgggaggtagaggttgcagtgagctgagatggcgccattgcattccagaagttacagactatcacaattttcctttttatacttatctgtgtttctaaacctttctacaataaacctatactacttttataacttgataaaaaactaagcaaaacatgatttgtccacttgattccaactctgagaacattatcttctattaaatcaccattaaacaatgagcaaagctttgaaattttggaactttgaaagttttaaaagtgttgttataggcttttcttatgttcctggtagttagctaaaatgcttttgtgttacatgttgttatgttacagcaaagcaaattaacttatttgtgcctagcttggatagagcacattatgtgaaatgcactgaagtataaataaacaccaatgcaatacatccgaatactctatcttggagatctattttatcacttacattgtagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgtaagtattaccttgtggaaatctgtgggtgacctaccaaataaggtaagaccacgaatccctccctgtatgtttcccttcttgctttagaatcagagaaccctgctgaacactccctactcatgataatttcccatattacatttgctcacctaaaggaaaatatatttcaaaagcatacaatgtaattagccctcaccttaactattaattgcttgatttatgtcatccacagtagtttgacagaacactagaactagctcatcagattcatcttataggcacttctcaaactttaatgtgcccatgagtttctggggaatcatgttaaaatgcagattctggctccataggtctgcgatgaagtcgccacagctcatcagtgacccatagtttgaacaggaaaggtgtagataacgattgctcttgtattggttggtaagatagattttcctcattctttatgttgaggtgccagggtgtcacctccacaccagtgtcatgagctcttaaggtacaatcagaaaccattgataactacatatcttctgatggtctgctcagtaagaacaaggagaaacttcttaccactctgctctcttttttgacacacatgaaaatgactacattgttgtatctacaaatgataaaattgtccctataaatgggaagatgatgtaaaaggcaaagcctatcatagtgaatggaaattgggtaaagatgttattggaaatggtaagcctttagcttattgcctccaaattgattccctatacccttaatatgaagaaaagtttaagcaactcttagagctatgacatttcagatctttcactatatgttgcaggtgaattttcttggcttcactaattatgaaacagctcttaaaataataggtcagtatttgtcctcattcacaaaagcagctgtcttagtaacctaatttctttttatactggatcttatgtcaacattatattcttgcagcacttttgaacaaaccaaataaagtattttcctgtggaggagcatcttgaaattcctaaaactatttcccatgtgaaaatcttcaaacgatgcttaacaagcgaacacaagtgctatttacattttcatttaggttcaagtgatacctttgtgagctcactgaggtacattttgggcacttttgtgcctatgaaactgttcatgttcctagcctcttatctctacttaattattttaggcagcaacttccatgaaacacctccatagttgtcttttctctctaagggccacttatcacataaaataatttgattcccatatctgcattaattatatttttgaatttttttaaactgtaatctttttagtagtggtaaaagagcacttgaactagtttgcttttattattatgattttttaaatgtagctgagatgaacagtgttataaatggctacttggtctattgtcagcatttcaatagagaacaaaggggttttatttttgtttttgacttgctatgtttttaaatcaacattcaactgtatctattcattatacttaggatggttgcaccattgagtattacctgttttaatcaacaggctggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctggatgtgaaatataatgtgaagttctgtattcatatttgtttctctgtaccccattttaaaaaggcagtttatataaatatattgaatacaagcaaaagtatgttaaaagtaaatggatgtcctttttcctaattcgcacaaatgcatctgcatgaaccagcaatgctgcagccaaaataagcattctgatgaagttgctgaggtttcttaggagatgggattgtcagtgacaaaactgagacgttctagacaagttggttaccattaaagtgaatgtacccagcctctgaaaacaaacaaatgagaggagaaatgagacaaattttgttttaaatagctttaaagtagtagataattatagtagtagggattaagagcatgggctcagtcatgtggggtgggttcaaactctttttacctatgagagagttaagaaattgaacggcagtctcaaatttcggggcatctgtttcctcatctataaaatggagataatactagcaccagcctcccatagttgtatgaggattaaatatacttagaaaatgctcaggatgaggactaaatatacttgcaaagcgcacttagcactcaaactgttagctattctcaccatatatagagtgtatatatcagaatacaatacatcttttaaaattctcatggtaggcctgttaccttttggcagacaaagaatttacagccgagaaagattaaagtggaaaatgtaaataggtaagacaagaggaagtcatagcactgttaatacgctaagcacaggttgggaggttctgttcactccccacaggtgggccacagaccctgcgccaagggaggggtacatggtactgtgagccatgggggtccacaggatgaaaacttacccatcgttgttgtgaaggggaatctttttcagtgccgagatgagggagaaatttcctgagcatcttttagagaagaccctgtgacatagggctcaaagtcctcaacaggcctgaaacgagttgtttctcctgggctgttcctcatgaagcccccgctgtgtgacctgatggcgatgctgccacagaggttgttccataggccagatcatgtggcagtgcgcggtgctctctgccggccttaggtagatttcaaaggactgggagaaaacagcctagacggcatatccttcaggccatccttaaatagtgttgtttgcagcaaaactttgccaacagttgagcaacagggaaatgagctggatattgtacttcctgtttatacctggatgccagctgctttatgtatctgtgaaatacaaaaatgtgcatctaagtcaactaatccaggattggactcttgtcttctcacggaggctcaggatgctggtgtgcatacgtttctgaatactaggcacagagtttggcataggaagttgtggaatttggtgtctacctcaatgtagggacaaggagatcgaaggccttaagttctctgccatagagtgtgggccagggaaacttgatccggaaaaaacatgccaaacagatataagcttgcaagtacccgtaagagcaattttttttaagtacagtagccaaaaatgtttggtcctgaaccatgaaacttcttggtatatctttcaaggtaaaccagaaaccaaaacatgtacttagagagcagagtcaacttgccagatgggattagtgaccataaactgcctaaacgttggggagtaccaaccaggattcatgactctttttggcagttactccatttaactaatccaaaaattgtatcacataattaaggcataaattttaaagcatggggatcagctaagaagccattggtttacgctgctatacttttctgcccaatactgagtccttgagcctggctctcctgggagagttcagggaccagttctgaatgaggatctgtgtaaccaggtgtggtactgatcacatcagccccacagccaactcccatctacagagttaggacagtcagcgacgccctccgttatacatcagtctcagattcccgccccatccttaccaagatcaaagcacatctggctggtacacggtggacactgggaacccgaaacaagcctgcacctcataggatgtgcctgccctgtggtgcctgggcttggcgttgaccagggattggtgtgcatcttagatggcttactgataaggcggtagcctgcattttgtagggagaaacagattgtgcttttaaaggatggtatagatcatgttccagtttgagtcccagggagtcggagagggcacaggggctgggatggagctcctgggagagtggagatggcactgcttagcatgcagccccacagtgtggatgctgtggatgatgttaattttagaattgctgctgacgaccagtactcttaattgcttagtattttactttaaactgattaatatatctttttaaaactttgctttaaactaatatttgtgacatgagtttaatatgctggggtttaatttttgcccttggagcacccacctaaaattatcctctccccctggcttgggcaacattgtcacaaaaggccactgtgtatcatcaagcatcaaaagagatgccttcattccagtcctcagtgaaaaaacaatgtacatgtagcatcaaaagaagaaaggctcctggtttgaattactggtaacaactaaagtctggcccacccattgcttccaacttagggagttcttgagcctgcatggacagggtcatgtggggaaacttgctctgaatccctctctaaggtgctctgttgcgctcagccaggccttggtgccattattgcactgaagcaaggaaggaggatgttgagttccagagccaccttccatagctccgaacagggagagactctcagaaccggccctcctgtggtcttggaggctggctgcctgggccatcctgtgatggggcagcctctccaaggcaagtggaggtgtgccccaaatccaaagtgaggtagaagacccaacacaagtgtaggaattaaaatacataggatttgaggagataaaagtaatcaagatgtaaatagctttctggcgtagctcccccttcagccaggcaataccatacccttggttgtttcaacattagcaaagagctgagcaaataaaagggaaggaaagagggtgggaaaagagcaaaagaaagcagagtggacagaagatggtcaggtgtcctgtcctccccacccccccgccaacccctcatcccttccctcaaagaaggcttggccttctgctccacctctctttgcctcaaacaaaccaagtatattcgaaaggaacagattcaggcagagcagtgttagacttccttgccctcagtttggacatgaagcttccttgttctcagtttggacatgacagttttatttttataagaactatcttgatataaatgagctttcttctgtatttttgctatttgtgaaacagcgacactcgaattcatttcaatggaaatgta

SEQ ID NO: 67 - DNA, 1503 bp, Homo sapiens
ccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttca

SEQ ID NO: 68 - DNA, 156712 bp, Homo sapiens
acaaggttagcacatttggtctttaacacctgattgtcaatacatttgccatttttttcccctgtataccacataagagaaatagatgtttggtgtgtgtatgtgtgagggggcgggtgtggggtgagaagacgctgagacgctgaaatagtcacactgaaggtgggcgctgattatctgccacatccaggcatatgtcctatctttttaagattttttgaaataattatagatgcccaggaaattgccaaagtcctgcagagaggtccctgtgcccttccccagcttcccttacagcagcatcctatataatgataacattaaaaccacaaagctgacgttggtgtaatactaccaactagaccagacctcattcagattttattagtttttgcaagtatgcatctgtgcggggcagtgggggataggtctatgcagttttatcacagctagagattcacgtacctgccaccacacacgtgctctcttacctctgaggtgggtgctacccccattctaaagaggaaggagtgaaggcgggtgagaggagggagcctgcccgagggcataggaggagcaggcatggcgcccacgccctgctctacagcccacactctttccctgctctcagttggattttcagtgcgggatgcatggccaacctctacccagcaaggccctcttaccccggccgagtttcctcggaactcgcggagccgccgtcggagctgcaggcagtgctccaggtcctggcccaggtcaccaacattcatcttcacctcctgtgaaggccgagggtggggagggagcgctgtgagcaccagcccaggctcctggcacctgctgctggggatccctcctgtcaagggagggctcctccccccatctctcagcccccacccagctggggctacaccttctcctggatccaggcctctgcaaggtccactctctgcaggaactccaggaagttccgcctgtcctccagctcctggcccctgagggccattgcctgcctcaggtcctcccagtgcttccgcaggccctgcagccgctgggagacctctccggctcgagggtgactctgtgccaggagagcctctcccttctggagggagagaggggacacaggacatcttgcctgctgcacttcctcctaagactgacattgcccctgggccacactttggggcaggcatggggctgagggcccggttgttaccttggcaacagaggtcatgacctcctcatgggcctggacttcagcctcaaaggcctggtgtttcagcaggggcttcagcttatctctcaggtccccaggagggaccggctccttcagctgctgggcccacgcctggatccagtcctcagcctggtgggggtgggacatgaatgctgcaatgttctgcagcctcaggccccagacgccacaggcctagcccccagccattcccaggaggctggcctcaggggtggggcgggcagcacctggtaaatgagccctgaaggttccagctccggaaggttgctgcaggaggcagccgggcagggccttgggtgggctctcgttttggaggtgtggcccctactcctggggccctgggctgctctgctcccttccccacctctcttgccctggcgctgctagagctcgggacactggtgaggtctccacacaaaggggcttagatcccatgttctgggctccagcacagcctctgggaaagccatccacccccgaacctgtttccgcctcacagtgttgcggtgtgaaggcggctgaaaactgtcgagtgtggttccagtggaaggccctgggctgggggtgccctctgacctgggttgcggcctgggtgaagctggccatcagcagggaggcatgcagggcgtgtccccggctctccgccagctccttcactctcatccggcgctgcagcaggatgggaagccggtcccgcacccgggggcgccggagcgtcttcagccgctcacgcagggctgcctcctgtggggcaggggcacagctgctgctctcccaccctgggctggggcagggcctggcctgcagggctcacagtcctttctttgagggccccggagccctttcctcagccccacatggctgaggggtatctgatcctcccagccacaagccagaccagtctgctccccaaggaccacacggtgtggacagagccaaatgccccgtgtgggtctctgcagtgtggcccatctccccctgggccctcttcttgagccacacatacaacttgctcagtcaaccccaaccaggaccccagccttgcaggctcatcagcactgcctccaggaacacaccaagcgccccgtgacccccttcaggactctctcccaaccaccacactctgaccacgcccaggcctcctgactccattaccttcttgtcctgggcagtcagaaccttcaggaagacctcgtgcttgcgaatcaactgctctacctcttccaccgagctccccaaggcactggttttcagggagacctggatccacagaaaagtcagaggccaccaagccttccagccagccagcccctccagctgcagtctgtgcccatgggcactctgggtatggcagggccttaggagtgcccactgagcttggcatggagctgtgaggagtgggagtccaggttgggaggctgcgatacctcaacctctgcaccatgtggggagcatgaccagcctctggccaacttcctcggggctcagtctgggataggggctggggatgtcagtggacgctcaggggcctcagcacttcaccatggccacctggaaggacttgtgcacagctgcctcatattagagaaaaagccagagaggcaggaggaaagggactgagcagagaggagaatagaaaggaggagcaggaggctgagcggagtgtgagggcgggaggggacctgcctcctgggccgcgaggatctcctccaggcggccgcactctctgaggaagagctgctcctgctgctcggcctgcagcctctcttgcttccgtgcccaggtctgatacacctggtcccgctggtcctgcagggctcgaagctcttcctggacctggggatggacacatgaggagcctcagctggggagggtggtgtgggtgaggtgaggactggatcctgagggaagctcctgaggagaggccagcatggcacagtaggacggggcaccaggtggccaggcacaggcttggtcagctagggtatgtgggggcaccaggggagggggcccacctccttggtgggtgtccctgcagcaagaagtgcctgctgccccagctgggtggcctgctgccacagcttctcccgggcctccagctccgcccggagccactggtgggcactgagcttcagcgggccactgctaggctcttgcgaactctcctccacctgcaggtcctggcgcacgcgggctgcccaggaggcatagtcacgcacctgatcccggggacacggagggagagccgggtgagggctgggctgggcagcaggaaaccaggtgctgaggcaactgcagcccacctgagtccactcacacagcccgagccgacctgggtcagggcctcgggtgaggcacatgtggccctttgtcacttggtttctccgttctcatccaacccgatcctcccagaaccacgaaccccctacatgagccagacccttaccacgacacatctctgccctttgttcctcctgccttcccatctctacagagctcacctggatgaggccatgagaggactggcggctagcaagatcagccccatcaagactgcttgatggggaaagaaagttcacctgctcttcaaaggccccttggccgcatttgcctggcaaagccttccctggtatttgacattgcactgctctccttgttctctgaattactaatttaacccttacagtcttctgctgatttgtgtacaactatacaagattggtgctggagggacttcaggcccttgtccaaatgtctcattgcatggaggaaggaagggtaaatggcagaaagagtcttgtaaactctaagtgcatgacaaacccagggttaagtgccttgctcaagctcacactgctagcaaatcagcagagttaggtccctaaactcaagcctttttgcagtgtcagtttgggcctcctggtctgccaggtcccaggacagtgggatgccggggacaccccgtggccaggacctactgtcccagtctgattctctgggtttcgggctcatctccccaggaagcagggctccatgagggcagcagttccactttccatagcttctatattgccctcctctctccacccgtggcttcagcagggagctgaagacagacattaaatagatactgactgatccagaggtcactgtctaacatctgggtctccagttatgagctttcctgggcagttcttactcccagccctgtctgggaccctgcatgactgccctgccactcaccttgctggcactgacccagaccctaaggtgtcactgctatgcccatgtgctcagcccctgaccagccagactgacatcccgtgtgctcgtgctctcccacccaagtccatgcttgttctccctccggagctggagggcctcatgcgtgcatgcccatgcatggtgcagcacacacacatgcacacacacaccacccaaagggcaggagccctcaccgccgtgcggaagcgggccaggaggcgtgcccgctccagctgggccctgcgctgctccatgcgtcgctgcagcactgcccacgcctgcgtcacagcttgctgcctctgctgcaccgcatgggcctgaggccccggacacagcttctgcaccctgcctgcagtctccagcagttcctgcagctgcgggaggggcagggaatagggaggcaagggtcatgtcctcctgattatcccacagatgtatcccttgcctgggaactctggcccccttgggccacgtcctgccatgcacaggaggcccatgggaggccctgagggacagtggaaaatctagaggaacaggcaggccagcctgagggggctgcaggggcctgggtcggagaggcagccagctgggctcacctgccgctcggtgcccacgagttctcgctccagcccctggtggcttctcagctgcgcctccagcccacacaggtcccgtgccacattgttggggaggctcgtggctttctcctgaggaagggagaatgccgaggagatgagggatggagcgtgggcactgagcctggagtgtatccacttctagccacccctccggctcacacctggacctgggtgaggacttccaagagatctctgtgaactctgagggtggtctcggtgtctcggagcgcgtggcctcgggcctgggtcagctcccacagctccgaccaggcggtcctgcccacggcgtgtggaagaccagccggggatcagctgccgggccgtgtcattcctccctcccgctaggtctggtcagcccgctcctctctgagttgtatcgggacttgcccaaagctcctccttcttaaaacctctcccgcctgtggccctgcctacgcaccttcttcctgggagcctgtcttctagctttaccatgaattcagtgctttgctgctgtaatgctcggcactgcatggtatctgtgctgtgatactctttacatcctgtgctttgactcacagtgcgtcacccaggttatgatcacagacgctttgtgggcagaggccacatctctccgttcctcgctaactctgcaactggctgagctcctaaggcttctgccaggccaggctctgggctaggggttatgagcaagtcatgaccttgcctcaaagctcacaggctgggagtggatccaaatcagccaagtggacagctaggaaccacacgaggcatgggctgtcccgagtgagcacaggagctggggtagctcaggggaaggccctgatgtctggccccaccatcttcccacagctcctgctctcaatcctgggggcaggactctgacctgcacacccagcctcaccttccttcacagaccagagcctgtggcgggctcagcttctctggagctaggccccctgcagagccccgtgggcagccagggccagtgtggccctcacagcatgccatcctctcttaccactctgggccctgcctgcccagctccttcccccaaaccccatgctggcctggcccgttgggcactcactgcagatcctgctgcctctgacggaccatggggccagcactgtgcccacgctctagcaggctctccgccagcagccggcaggcggccacccgctggctgcccatctccacttggtgctgaaactttgcaaacttggtgcagaggtgctgagaagaggggagtgggtgacagggtagcccccagctggttaggcgtcaagcagcctgggaatcgaggcacctcagtgcccaactgggtgatgtgggcttggatagccacggcgtctgcccgctccactgaggaggccccacctcagccagggctcaccgctctgctgccaccttcttcctccgccccgccagagccagcttccccaccccataggctctgcctcagggcaccctccttgaccctggccctcttctcaccagggcgtgctcggggtcctctcccaggctctcccctcctttggctgcctgcttctggcttgccagccagccctgcaggtcctcagcctccctcaggaactcatgcagcctcagggtcccctccagttcccggtccctgtggtaacagtccgtggttccccagaagtgagttgcccacccccctgggggccagtcgggccagccagaggggccaatctgaaaactggggttactcatggtctctgtccaagcctgcggctcacgattcagggagtagtagacacagcagtgcaggtgtaggggcagaggagggtgtggacgtggggagatggactgcagggagttgtggggcctcactgaagaatttatggaaagaggtgagcaacacacacccttttcccaatgcatctctacagcctggggtcatgggttctgattgactttgggccatggcatgggaacagtcagctgtggctaggcctcctgtacccactgatgagaggggttatggtgtcctcaccgtgtggccgccaactcctgcagtgcccgcagctgctcccggagcctctcctgcaccacacgctgctgctcagggacttcggggccagtgagggtttgggccgtctggtcaagctcctccatggagctccagtaaatggctagttcctcctgtagagcctatgatgcatgaggacccatgccaggctcagcctgggtgactcatccacccacctgtccgtcccccacccatccagtcaccaatcctcatccattcacccaccactcacacgcccatccatctacctcaactcattcatccacccacccagcatccatctacccattactgatggagtaagtacttattgttccataaagtgaacacctggtctgtgcccactgagggctcattatttagcagggaaaggtgaatgctggctaatctgggccaaggaagggagggcacaggaggcattagactggaccccaacatccatgtgtaagagagaggcagagttaaacaagctgtccagtatagccgggagatgggtgctccgtgaggccaaggctacaggcctttagaaagaccttctctgaaggtcctgtcgcagaacacactggaactggggctgtgcaggaaacatgcccagacaggaggacagttcagtgacagcaggaaccgggactgccgtgggctccaggctttgaagcttgtgtggttctgggagtccgaattcaggagtgaggaaggggacttcgagacctccctcccttcagccaggggatgtttgtgggaggaggtcggcttcatgaagggcatttggttaactcaaaggatgacaggtaaagcctgggaggaagacacctgtgggagatgtggagcgggctgggcaggtgaccttgacagaggagaaaggtgccaggggtggggtagagaggaagcaagaggaggcggagaaaccccaaggccacagggagaggcaagactcgtaagaagatgaagggagaaagcgtgtacatcacagtgcccaggttgccttggaagaaggggcactgtgggatctgggtgggaagtggggatggggctgtctgtgtctccaggaagcaagagcagggctccgtgcctctgagagagggagggtgacagccctctccccgtggtccatcatcacccagaccacactgcaggggaggctcaggacgtggtacctggtgcttgttaatgagcctgagggtggctgcctcgtctctgccatagtcccgactgctcaccagcggccgcttctcctccacccagccctccagctctgacacatccagaaagtactgccaagagtggggccaactcacctggaggatctcagacaggaccctccgtcagccctggagacatctgcccctgctctccagcatcaaaggggcttctgtgcccataggggcacccatcagctcccagcccagagcccccaccactgatccgcctccctgagagtcccacaggtggcccctcaaggagccctgacttctgcctcttcccccaaccccacctctctgcatcctacctgctggaaagtgacagcctgctgcagacactgggcccgcgcttcacatgccctctccagctctgcccagtggccttccagctcctggcactgctccacgatgtgttgggcttgggggtgccctgaggctgccaggctccgcccagaactcagcacccgttgcacctgcccctggtgagcttttacctccacctggagctcctgccacagagtggcttgagaggctgctgctcttaacccaggggcgtccggagcagagccatggatgtggctccaggccccaatcatggcaagacccccagggtcaaaatagctggggcagagatttggaaattgggatacccaggggtgagggcttagaggccaggacacctgagtaggggcagagggtttctaaggtctgggaagcggatgtcggtaatcctgtaggaagaagagggctattaccttgtgcttgcggtgaaggctctgggcaccattcaagcactcggtatagctggtggggctgccatggggcatgtgctcggctacccaagagagctccatgttgctcaggtggcagaactggtgcagctccactgaggcctgcagctgcaggccccggatggccagatgcccctgcagaagctccagcctaggaggaggaggaagagattggagaggttgggaacagagtgagcacaaggctcctggttctttccttggccaagccagggcccgtgaagaacaagaccagggaatagagcaaagcctcatctgacaaagggaggcagtggaagggcgccagggccccacctcatggcctagatgactcgcgtgactgcactgtgggggtcctgctaaggaagcataatggggtctccgaccctcccatcccagaatgactctactcataagggaggaggtctggacaccccggtcctgtgggtgccatcttgtgggaccttaaattcacatggaggagtgacacacaggtgggtgggaggacagaccccacctccggaggtgcttctgggtctcttccaggatggccggggaggcggccatgccatgggccatggaggcgagggcagccatcttggcagccagggtccggctctcactctccagctgttggtgccgtttctgcagcctctggctggagcgcaggtcctgccctgtttccgagctctgtagggccccttcgagctgctccagctgctcctttgcatcctgggagggacgcatggagctgcattaggttctctgtgtacagcacagcaagtggccttcccgggctctgggactgttggacttttaggaccagattcaccagggagctctgtccccaccactgccaaccctcggccagaagtgcccaatcttcccctgttccctcacgcttcttcttccctgggggactcaagtggtgctgaccacccgctgggcacacaggagagaatcctgcattggccgactgagcggaaagccacgctcagcttgtcctaggccagaagcctccagaggctgcagagccagggtcagcagaacacccagacttctccctccccgttctgtccagcccagccaggcctccgtctccctcttgtgccctgtccctcttcccagtggacctgcagctgcctcaggagttgctcctgctgtccagcctgctggagctcgtccccacgctcagtcatcttgcggttcaaagcttcccacttgcttctcaggccttgaagcctggtctgtatgtcctcctggccacagggcctcctactcaacagctctctcccaacctggagtggagataaaggcccagggagtttggctgagctgctggtaccaccagtggccgcagcaggctggacctgggtggcagtggaggtgagggggtgaccacagctgcactccacgggctgcctggaagaaagcagttcatgtggccccaaaactgcaggtaggggggctttcctctgacccctgcaaatagagcggggtgagccggcattaggttggtggctggggagagccgtgttctggtagaggtggccggctctgggacttgccacggagagttgtaggggaagggatggatggcagcagctttgggactggtttgggtgccaaggggatgccagcagcatcaaggaggcttgcagggggaggttctaggttcacgctgaggctgatttttccttcaaagactcttccatgaaaacaggtggtgcagtagggttgggaatttgaagacaaggaggctctgcaccctctgtcccgtgtcccccacctgctgcagggcctccacgtgtctgcgggtggcgagtagctcgctctcagctgcttcgtgccgcttgagtgtctgcaggatgtttctgcgcgctccggagggctcatgcgcagccatcagccccttctcttccatccactgcatcagctctgccacatcctgcttccactcctgccaagaaccaggcgagagtgggtctcagagcacggtgggtgggggctggtgcctagccctgcatctgagggtggtgtggccacagcccctgttttcctcctcaggaaaaacctgagctgtgttgcctgcctcacagaaggtgttgagaggatgaatgacatagcgcgtgaggaaagtgctctgtaggctgcacagagctctgtacggtctcaggctttcttttcagggaggcgtcatgcgacctgggcccagaccctcacctggagctggagggaagccagcaactgcctcctcctctgctcactcctcccctggagcctggtccactgtgcctggatactctgcagctgctctctgaccctggagggcgggggggggttggaggagggcatgggagaggactcccaccccagcacgaggtgcactctcccccaccccctactctcccagccctagggcggccgtctgtgcaggctgagaaagggtcatctgcaggtgctgcagactgaggccaggctcacgtgtgtgcagctgggtgctggctctgaaccagcttctcgccgtgtgcccgcagagcctctgcccgaggccccagggtgctcaggagccgcccaaactcccggtgctgctgcagcaggctcagggcctccctcacgtcctcctgggagtgcagagacctgaggtcatgcctgggagaatgggggtcaggaccatctcacccgccactgccccaggggcctcctgcccagcctggcttctggactcaaggggatgagctccctccagtgatggggagtgacagcctagctccacattcctgctccataccccaaggttgtccaggtgcagccaggcctggtggttggcacaggtggcagtgaaaccatccacttctcggccaaacttctgcagctccagcccctcttgcagccactgctgcctctgctcccacaaaaccttcagctcctggccctgctgccccaggaccctcagagtgttgggcacctcttgggagtctgggcagtccaaggctgccatgggctggctctgagcgtccagctgctgcagcctgaccaggatgacaggcagagagtcaaaccccagcaggctccctcgtcagcctccttctcctctcacctccagggttcacgcatcttggatcatgaatgagacactgaatgtgataggcccagcagagtgcttagggtgcaggggttcccaatcccccatcggctccagccggccgtccttaagtgtggactgccaacagccgatgcccggcctagaggacatgcggaggcagcacagtgtgagagagaaaaatcacgcaagccacaaaagcacctgaccgcagggccactgcaagcccccatggaggctttgaacaatcagaaaaggtgctcctttcagcaggtggcttgggaacaggtaacacccttgtgtgaattagagcaaggctccacttcctctgagccgctgcagaaccaggtactggagtctggcaagctgagggccagatgcatttcagtgcccacttggccacctgtcaagtgccttcaggaggggcacagcctgtggactgtccctggtggccttgcctgcctgccagcccataacgtcatccctgcaggaggagaggcgccaccttactaaggaggtggggatctcagacccgtgggtgggtcctgagccattccacttaggggccgctggggtccgtgttaccaggacggcagggggggctagacgccctgactgaaagcaatgcatcgggcccacctggagggggccagccgggcctgggctgcagagagcctcccaggcagctcagtgtcctgggtctctcctcgaagtgtacaggctgcctgacccagtcctagattatatcctcctctgtgtaaacttgcctcaagcagcatgccagacaccaaccagtctgggcccctccctggggaaatcacactacttcccgcatgctctttctgggcctgaacccagagcccagagccctggtcccagcccaaagtgcaccccttctgccctcctgtcctgacctctcctgccacaggtggatctcctccagcaggtcttggtgctccctcagcagccgctgagccgaggccacatccactgacacctccttgctgcgcagctgagcctggacactctctgcccacagtagcagttgctggctctcttgcaggaagctctgccgggcctgagtctcagcctggcgccgggcccgttgggccacttgttcctgtacttgcttcagcagcccctgcagtgtctccacctgtccttgcagaggctggctctctgcgtagcctggctcctcgaccctgggagacagggtgcgctgcacagtcagtgccctgtcctgggcctggtgccccaggcacatgtcctctctccaaacctgcatcccccagggagagtggtgctgactctcaatgcccaccccacccttgacctgggggcagcaagaacatagggctcgccaggtgcagtggctcaagcctgtaatcccagcactttgggaggccgaggcaggcagatcacgaggtcaggagatcgagaccatcccggctaaaacggtgaaaccccgtctctactaaaaatacaaaaattagccaggcatggtggtgggcgcctgtagtcccagctacttgggaggctgaggcaggagaatggcgtgaacccgggaggctgagcttccagtgagccgagatcacgccactgcactcagcccgggcgacagagcaagactccgtctcaaaaagaaataaaaaaacatagggctcttcctgtccccaggaccattttctcctgatcatccccccatctttgccacagccctcctacctgttgtctccccatcccaatttctgtcccttcctcattccactgccctgcccacgccttcccatggtcctcactgcctcccaatgccaccactgcgctggccgtactttacgaccacactttggaggaagtggaccctcctctccagcaccagggtcttcttctgggccagctgcagggcgtggcaggtgtcctctgagctccctggctgcagggcctccagctggaggagcacgtctcgcagctggacctgtgtgggtccacactcctgcagaaaactgcacacttccacactgtgtgccagctgcacggccttctccctcttcagggcctccagctgcccccacctgggcagagggtacaaggttgtctccacaacagggacacctccccatccatccgggagccttggccagagcctcacgtgacagaagctgccagactggctgtcccttgccccttccctgtgcctcggacacgtccagcctctccatctggcatggcgggaggcaggtgagtcaggcccaggctgggcactgtgtctgcctgcctcaccacctgcactcctgcctcattctcacctctggctcagttcctcctgctgtcgttggatttgtgtggagttcccaggatatctctgcctcagttgctcagcagagctgctgacctcagcccagaggccctttcccacagccagggcagtgaggaagttctagggaaaaggaggacccagccctcttgggggactttttctctttccacactcccctctagcctatgacggacctgagtggtgctctctgctacagggatgctcatgctgcctgcccctggaaagacagccatccgagtccttaagggccaggaggccctcgaaattcaggccagctctctgctcccctcccccaggcaggacggtagttaaattggaaaactgagtcacagcagcagaccacagggaggcaggggcaaggcgaggaggaggtgccaagctcccagggctgtacctcatatttgagctgcatgacctccagggtgtcagcctggggctgcaccctttggagcagcactgtctgcttctccagccacaactggagctccccacaggaactgcagaaaccgaacagggccatggcctcctccaaccgggccctgcggagctggggagaggtggcccaaggctggggtgagggtcagggcccccgacagggctctcagagcgggtcaaaggggtgctcctccccatcccagcccaccagcagagcccagggtcagggccagagggggtccctgcctcactgctgggccccacatcctctctcagagccctcttggcaccacctggagggagatggcaagggcttagggaagggtaaagggcactggcagtgtgctcctgtctggtcttgccctgctgaaacctctcagtgccagccctgctctaaggtgaaatccacgccgctccctctgcctgctccacccccacctgcctctctagtctctcctctggccatggcctccccagcgtctgtgctgcagggacctgggccttcgcttcctccgctgggcccccttcctacctttgcacaggtcctggccagcacccctgggtttacctgctttctgtttctcattcaagcctcagcttaaaagtccttccctccaaggtgccttccctgacctccagcctgacctgggctaccttctcatgtgatcccatcacacctgcatctaatgagttgtctgacatcttctcagccatgataaaagctccttgaggacagggaacatgtcagtcactgccttgtcccctgggatcactgcacaggagctgctggcacagagtaaggactcgagcatttcttgaaaaagaagtgttacctgtgccagggcccgcagactctcatagtcctgactcaagtggtcctgtgtctggagtatagtgttgggatcaaagtcagggtcaggctcagctgggagggccatcttccaggcatccccagggccagggtggcaggaagcctcactccagggccctgggttcctcaggctttctcctggagggctcagggcagagttcacctgtgtgacaaagggcagcgcgtctacaggcgaccccatcaagcagcaggggctttggccaggccacccctacctccgtgccctgagacctggaggcgctgagctgtagctcaaagggtgtgtgggacatgggtctgggggacaggaagcttccttggggctgagggtcgaggggccaaacgtgagcacaggatctgatggctttgatttccacatcgtgtgctgcatacacagcttcttgaaagagggctgtgagccaagctatacgtgttttaaagaactttgggggctcaatgaactgagcaaggggtgtcagaaggcagtctgggtgagtgatgaggccaccccaaaccaacaaggcgggctaagtcaggagagacagtcactactggcctgggtgaaagtggaggggaccttcctggaggaaagtgcttaacggtctgaaactgccggcaacaggagccaggccaagctgtatttggatgccctcggttgacgtgggcagacaggattccactacttctgggctaggtcaacaagtgagatgccactgaggactggggtgagggacacctacacccacgggaaggccacgaatcctgggccagaggccacaaaggccctcccatttttgtcctctgtgtggcccagccgcggtggagcaagggagaccaggcgcccttccctgtccccgtcctcaccgtgaataacgacgcccgggccgaggccgcccgcccctgctcctccagccgccgcagctcggccgcgaaggcgcgcaggacgcgctccagccgcacgtggcgcctcagcagggtctcggcggccgcctggtcctgaccgcaggacgctctctccagcgaggatcgccgctcgcgcagccacgaagccgcctccgccgcgtccgcgaagtactgtgggagggggtcgggggtggtgtgggtgaaggggcgcggctgagcgcgggcaggtgctggcacccccacccccgcctcgccgggccccgcccccaccccgcctccacccctccccactacctgcaggaccagcagggctgtctgcagccgtgcgccccgccccaccacccgggtctggagcagctgccaccctccctgaacggcctctgcccgttccccgggatccggctgcgttgggggcctgcgggcgctgaggtcgcgtcccctccgcacgagatctacgcacacggcctggtggcggtggacctcagcttccagggcctagcggggggcagagcagggggctcagtgaaggcagaacaggggagggggccgggggcccgagagggaagggcaaggcgctggcgaccggcgggcgcgctcggggagctgacaccttgtgtttctgcagggcgcctgcgatctggctgagatcccggcccagggccgcattccccacccgctgtccgcactccttcagccaggcttcctcctcctcacagttgcgcaggaactctgcccgctgcagggtctgctccagcagggcccgcctgagggacaataggggccaccgaaggacatggggagtcgtgaggcatgggcagtgggttcccctccgggtttagacactccccttagacaggatttttcttttccctggatgactcaacaggtgagacggaggctttggaagtgagggtcagtgtggagaaaactggcaggccaacagtactttaacctgggcaggagataatttgggttacagaaaagttctgggaaaggtggaagagttggggcaggctcttaccgggccctgacaagagccaccaggctctgttggagctgggccagtgtcctggccttggcctgcagcacctccacactggtgcccagggaggagtccagctctgctgtctgctgagcaagatggctcacatgggctccgtgggccgagacttgagcctccagcaggtcatgcctctgcagcagctccaccacttctgccagctgctgcccacaggcggtggacctggccggctcctggccagagatgatggtcattgcagtggtcccaaggtgctgggtccctctgagcactggcactggggaagtcccccaccttgctgtgtttcccaagggcctgctggtccagtgcccacctgcagctcctccagctggtgggaggcagcctccacctcctgcagcaggctcagcacagcctgcatgtctgccacctgcttcctctgtccctgtagatgctgaaggagcctctgccagcgcacggtaacttcctcctgcctagaggatatgagaataagggagatctcctctgggttggggcagggaagctacttcagggttcctggtctgtggtggggcttggctgccctggaagagtctgacctccatggctggggcaaggtctatggactctgacagcatcctggcaggcggtggtagaggcagtgtgtcctacctttggacacatgcagagaagccagaaggagggcctggaaggatcaggcctttggggccccctaacttggatgcagtccccatttcagttgatgaaaactccatccttccaggcgcccagactaaaatctttttttttttcttttgagacagaatctgctctgtcacccaggctagaatgcagtggtgcaatcttggctcactgcaacctccacctcccgggttcaagtgactttcctgcctcagccacctgagtagctgggattacaggcatgggccaccatgcccggctaatttttgtatttttatttttatttttattttttatttatttatttttgagacagagtctcactccttcgcccaggccggactgcggtggcacgatctcggctcactgccagctccgcctcccaggttcatgccattctcctgcctcagcatcccgagtagctgggactacaggtgcccgccaccacacctggctaatttttttgtatttttagtagagacggggtttcactgtgttagccaggatggtcttgatctcttgacctcgtgatctgcccgcctcagcctcccaaagtgctgggattacaggcatgagccactgcgcccggccaatttttgtatttttagtagagacgggtttcaccatgttggccaggatggtcttgaactcctgacctcaggtgatccacccgccttggcctcccaaagtgctgagattacaggcatgagccaccaggcccggcctaacatcttgataactcactttctcacatgccacatctgatctgtctgcaaattctacttggcactacctgcaaaatctatccagaaccccaccccttgtcaccactgctgctccgtcctggattactgcaatagctttgtaactggtctctctgcttctgcctttgccccttggatctattcccaacatgacatccaggtgagcatcgcaaaacaaaagtcagattgtgtcactcgtctgctccagccctccactgatttcccatcatctctctgagtaaaagccaaatcgttactgtgccctgcaaggcccgacttgacctccttccctacctcgtcacccctgtgcccccctgacctcagctcctgccacttgttcactttggccaacactggcctccaggctatttttcaaacctgccaggcatgtgctcgcctaaaaggacactgcatttgccgtttcctccgcctagaatactctgtctcccacgtctgcatggccagctcgtcacttctttctggtttttacttagaagtcaacttcccagtgaatcccctctagccactcaaacttagcacctcatattcattcccctatcctcctttattgttattatttttggagatggagtctcactctgtctcccaggctggagtgcaatggcgccatctctgctcactgcaacctctgcctcctgggttcaagcgattctcctgcctcagcctcccgagtagctgagattacaggcgcccgccaccacgcctggctaatttttgtattttttagtggaaacggggttttgccatgttggctaggctgtcttgagctcctgacctcaggtcatccgcctgctacggcctcccaacgtgctgggattacaggcatgagccaccgcgcccggcctctcctttattattattatttttattaccacatgctatgaatttttcttatatgtctgttttccttagtagtgtgtaagttcatgagggaaggaatttttgtttcttctcttctctactaaatctccagcacctagcacagtgtgtgggacatagtagacactcaaaaaattcttgtttagtggatgaatcagaggctacctagaaagtgaaagtgcttcaccaataggaatgaattactgatagtgggcttgcaagcatcactgggagatagatctttgtagagggatccctgaacccataaatcatccctctcctctctggcaaagaatgggcacatgacatggaaggatgggggtgtggtaggacagcctcagccagctgtggggagagttcatgtgctggggctcacctgcgggccacatctgcccagctgtggtactgctcctgccggaggatgtctgcgatctcagccagggcctggaagcgcccctcctggggcaggatgccagcctccagcatgcccagcctctggacggctgcctccactgtggccaggctggctggcggggctctggcctggtctagcacctgctctgcatccttaaggaaactctcccggagggctgccttgtgctggaagcgccgggccagggtttctagccgctgcagctgcagtagcctctgctgcagggcctggctccttgcagcctctgcccactccagccctgcccagcactgggacagctctgcaaggcccaggccctcatgaggcaggaagggcctgcggttctgggcttggagtgctgtctgtagccggaagagcagggcctctgcggcccctcgctgctgtagccggggtggcttctcctgggtgcggaagatggtgaatgctgccagtagctgccgcatggcgggcagcgagtctggaaaatcccgcgcctccagctgcatctgcttctctgcaatccagcgtagaaggtcagccaccagctgctcgtactgggtctgcagcagctctgtctcctggagctgaagcaggatctggtggagggcataggaaggggtcagggtccttctcagggcaggccctggaatgggcactgagtgccagccagagttccccaggtgggctgtagctacttctctgagccaaagatgctttgaagtggtggtacccccaccccagagaactgggtttgcttggattgcacactcagacccaggagcttggggaccctctccatgactgagggtgaggctatcctgccttcttcctcttgttttacccatttggcctcactggtggggttgaggcccttcaggctgctgttctttttctaggccgcctttcccttccctgagcctcctaccccataaagcagctcacagcccttggcctgtgtcacccccacccacaccccaaatgagatacccaccttgagaagagcacttccaggccttagcctctgccatcgtgtccagagagtaaggaagccccccaaaaacatgaattctgcgtagcccccgctggcagagccttttctgtgcctgtccttgcagaatcctggctctctaagccttttaatcccattagaagcttaatagcccgagagtcgggaagaagggggaggcccaggaagggccattcctcccctggcttcccttgtataccaggcaccgtgctgggtccattacccatgctccctggaacactcacaagggccttctgttatccaggcatcatcatctccatgtgatagagggtgcacagtgaagttgggtgacttggccaaggccacacagctagtacgtggcagggcaggcttcacgcttaggcctgtctgcctctggagcccttgctcaccccacccctcctttctcccccaccttagtgagtctcctctggacagtctgcccctgatgcaggcgggagcagtagtggtagtagagggagacgtaggtcatgatagagcgctcatctggctgtgcggctgccacgtcctcggggtccagcagctgagcaatgcccagctcctgctcagccaccaggaaagcaaaagcaaggttgtgcagtgggcggtctggacgcagggagccgtagtccaacaggtctggcctggacagacagtgagaagggctcttcaccagcaggaacctactgctttcctttaagtagattcttaaatgcactcatgctcctattggccattcacatcttcttgtgaattcgttttcccgacagttatctgaggccctgttgaaggaggaggactctgacagagaaagaggagagttcattcggcacagggaccaggctggggggctggaggaatctccaaagggcaggtgctgcagggtgtagaacatgaatagaattgaggggcacagaaagtggagaaggctggggtcaaaggtaaacttggccaatctcatggcattgtctagggaagggaaaggggctaacccatcagccctttctacatctgtgtccactttccctccttcaagcctagggatgtgggagaacgggtgggctgaggacccaaacccaggagctgttggctcagtgggcagaggcctcctgacaagggtggggtcacacctgtgggcatggatgagggcattgaagcccagcccatcgctccagcttcgggagaaatctgtaatgttcacgttggtgtagctggctgtcttccgctggcaccagaccagcagggcttccttggtggacagcagggctgcgctggccccaaactcctcctggcgggacagggcagcagggtcaccatgcggggatggggtggggaggcagagagcctgcaggctgtgggagaggcaggctggccacagcaggatcctgctcctccctggcccggggccagtgtgactctcctctcttcagagtatctgattttgcccaatttcatccacggtgggcaaggattgggggtgagagtgactggccttccaaagaagtggagcaagggaaaagccgtcactgcagaggcgctggctttgtgtcaccacaggtgatcacacagcaacagctcccgttttttgagcccttctgacgggccaggtgctgtgctaactgacctaggctcatgggattgtggctgggcttcatgaaactgggtcccgtcactgcaggctttctgtgagccaggcccagtgttatgggctggagtgcagtggcacgatctcggctcattgcaacctctgcctcccaggttcaagcaattctcctgcctcagcctcctgagtaactgggactacatggaggcaccactatgcccagctaattttttgtattttagttggaacggggtttcactatgttggctaggctggtctcaaactcctgactttaaataatctgcctgccttggcctcccaaagtgctggaattacaggtgttagccaccatgcccagcctcacttcctgtttataaactcaaaatatcaaggctcagcaggctgcacttcccctgccctctgggccccagagcttgggtaggaaggacgtgcatggtgcccacatgagggggagtggagtctcgaggccctgggccccagcgaggtcaggccccagtaccctgcatggtggggccaggctggcagacggaactaaggaaaatgctgggatggcttgtgagggatcggggctagcctgagcccaaacatatctgagtcagcagggagcagggctggagggggctgcagacagacagagacggtgctggtcagggaggatgcccacctgctgctcccaagggcctgggctgcaggggacacctgaaactggccaggggcctgaggaggtgagtatggcttcctgaaagggcttgaggtcagttagaaattcatccgtcccttcagccttcaaatagatgctcagcctgcagacacacaagacccctgctctcctggggctcaggccctgagtttccaggccatcctggacttctgccagatctctggcttcttttcatgagggtttcattctccaggttggctttccttacctactagaattgagttttaggtggcattttggaaatcatgaaactatgaaaaagtataactataaggactctttcttttttttttgagacacggtctcactctgtgacccaggctggagtgtagtggtgtgatctcggctcatcacaccctcagcatcctgggctcaggttagcttcccacctgagccctcccgagagctgggactacaggcatgtgccacaaagagtttatagtctttctgatccagtgtgggggaaagaggtggaatgaaggaagctggggaccatgaaagaaatgctgtatctttggtgtgtagggtgccagggactttgtaaacctccagagctgggactccctccacacatttcatttttcccaacagtacattgtggtgtaatggaagttacagagcctcagtgccaagtggggagcaccacacaggggtgaaagtgggtgctgggcagtgaccctgaaccccccactagtgaatgacttgcccagacctggtttgaagcccatggccctggccctcactttagcatattacaatgttacaatatctctggtatcctgggttcttcacccatggttggagagtgaatatggactttgcagtttccaggatctcctatggggatcataaaagttgtgtggaacttatgaatccccaggggtctgaggtgaggccagggctgggctgggtcaccaggtgctgggtactggggactgagccataccttgtccaaggagatgtgggagatctggaaacgcagaatgatgacccagatgagtcccaggatgagtgtctggtctccgtccacgatgttctctggcccgatgagtggtactggcacctgtgggcacagttggatgggctaagccatgaagcccatgtccagagaggactcagtcaccaaaagcttagggggccagctgcgggatgggagcatcctggaatctatcctgccccagctgggagttccctcagggagaagcaggcaggggataagtccaggaaagcaaaggcttcctgcctggttggagccatggcctcaagcccacctgggtgaagccccaacctggtgaactgggctgggccctcagagcaggaggactccctgtgtgtgggctacaggtagacctgggccaagatcagtggttcagctgcagggtttggaaatgaggggtcataacagtcaatgtgtgagcccaacagacaatagcaactgtctgcctccatctcccagggtgtcctgggatcttcagggggtggctgggtccctgggctcacacccaaatctcagccctcttcttctgttccggctccaacagggccagctataaatccagactcccaggctccacccagtcagactgtcttgggccagagcctgggaatttgcacttgaacaacaccttgggtggctcttaggtacaccaaagttgagactcctctgccctacatcctgccatttggacagggaggatgggtgagtcaaggggagaagccctgcaggatctggcccccagccccctgtggctccatcttccaccctgtggaatcacatagctccaaggcccatgggattcttatagttccatgggattctaagcacaggacttcaggcctttgcagggccgtgcctgctgtctgaaagtattctcccaggtatctgcatggctattcacctccctgcctttaactcttcactcagatgttgcctagcctgaccactttatttaacacagaaacttaaggactatttctcccacccaaatacacactctcgatccccttgccctgctcaagtgaggatcttggctttgttttctggtgtatcctaggggagtggcacacagcaggcaatcgatcagtaagtactgaatggagaaagaaaaggagtgagactttccataagacctgaagggcaactggcttcagccggccactactagccctgtgggaggagctgcaatcctgggtgtccccctaggtaaactttggtatatctggctggcctctaaaggatcccacccatgctcctggggtggattccacctgccatgtcaatcaccttggcttagagttggagcctctggtgagtggggtgtttgtctgctcctcccagctcctgagagcctatcctcctgacttcctattgagcgatgtcacgctggtggcttaaactcaccgtgatggggggtattaacgccataggatcagcgaatacagcacactggagtttttatttcccccagagaatcatttgttaaacgtttaccagcacaccgctgatctgggttcaatgaatctgtctccctttgaagccaggtgccttgaggtgggggtctgggctttgcttagtggagcccagcgcctgcatagaatgcccagggcatgggagcatctccataagcgaatgcatccctcattctgccacacattccctgtgtgtttgcggcaactccgtcatcctttctagaccacagttgcctcctatgtgtatggagacaaggatgtcaccctcacaggtatcagtgacatgctgtatattaaagcttggggagagctgcaacacctctgacaaaggctgtggggcttacacccttccccagttcctggaggggagatgactggctcacagggtcattgtccctggatcaactagggcccagcattctgcagctggcagcgttctgctcttgcacctgctcaggacagcagtcactcccattccctttgcttgggcttctcccctccctggctttcctccaacacaccccaggaggctggatgtaagctccactccaggatatagtgataggcacgcacagtcaggctccatccagccaggcccagctcagtgacttcacagcctccagggacagccacctccaggagcccttggccttcacagttcccggtttccaatgatccctttgccccaccccacccctgcaccagcccctcaccctggccatgagggtccctctgtccctggagctccggcctccttttagtgcccatctccttagcctgtccctttctttcaggtgactctgcctccccccatttgctgaggcctcctccctccttctccaagacaggccctgctcctcttccccacctgccgtcttagtcccacatctgggctctgttggctggttaaccatcgatcttgcctggtaaataattcagggcctctgtttcctcatctgtgaaatgaaaagcctaagagaacgctaagattcttttggcctagaatcctgtgagtctctcttatgacagacagtgacattttccaccccagtagggacctggattgctactgccatggccagctgggtgctctccaagtcaggggtgctgtgcgaggagggcgtggcttctgctcctctgtgtcccagccactcctcctgtactcaggccccagctcctctgttctgcccagtggcctggcgcaggaaaggtgacccagtagttcagcctgtcccagctgcctgccccagcaccatcccagacccctttccctggggcccaccttggccctgaggaaggccagagctcggctgctgttctccaggaagtgcacacgcaggcggccccggctcgggggtggcagggcctcccctgagatgagctccagcagccgcaggaggtggatgccgtcagccagctctgtgtacaggttccggatcttgatgcccgcctggggaggggacaggggtaagtatggggtcagcccagcctcacctgtcctcccatcctgggacctgagaggtacgacccagagcagctgctttggaagaaggagctctggcctcagcttggcctcaggcagatgaccccacagctcaccccggaggcccactggccagagctgggggcctggtatgggtgggctgtgggtcacagctggctatactcacctggccgcactggaagacgttattgatccacttggtgaaagtcttctcctgcatctgcatgtgccgggcctgtagcttgcgaatgtggcccgtctcgtactgagagtccatggtgagacttggactgggcgggacccggagttctgtgctgggcctcctgctgcggtgccctgcagccccgaggagctcccggggactgtggggctgaccagccatcagccctgcagactttggggatgaggagctgctggatggctccctaaacctggagggcatgcagattaggggatgatgtgaatggagatggcccctctaccaggggcctggggtcccgccttgccagactgtcctcacatttcatgggggttgcagcttggagcccagccaggtaagggccagtgcttctggtcccctgtgcttgaatggcccagggccccctttgccccaccccaccttccagattcttcttctcagagcccctgctgccaggtccctccaccacagtgactgggacaggtggaaggaagacaggaaactgcttaccttggtgatgcctgggtcccacagagacggctctgctggacggatggagatggtagatagcaggggctgcttaccttggtgatgcctgggttccacagaggcggcccagctggacggatggagatggcagatagcaggggctgtggagggagggagagggacatcaggagaggccaaggctggagcagggctgcaccacagccctccccttgagccagcgtgctggggtgacggcacacaggcggcattgtcctcccacctgccacagggcgtggcccagacagggagggggtggttcaggaatgctccagggccattgccagatgatgtcctccttcatcatcctcccttccccgccagcaacttctccaactccaggtgggggtcctggctcccaggacgcagaggcccatggagcggccctgccaccgcatggggtgctgcagtctgcgtaggaggtaccaaagggcagagcctctgtgggaagcctgtggacgcacttcccaatctgagactgccctctgtaccctcttggggcctctctgtgagcacccagggcgaggggatgagggagcgtcctgggccgtggtcttctcattcacccccagggaacagcccatagactgagggcctcacagaccctgggcttggctttccaggccctgccagagtgcagcctgcctagcccggggctgaagggtaggctccctggaggaaggggtgacctggaactgcgagggctgtggagtctcctccaaaattagagacacggtgttaactctgggctccacagagctggccgtggcccggggctcggaggcaggggtgcagagggagctggtgggcgcccatcccttcctccccgagcagccgtggactacatgccagagtgaaggcgagttctaattctgggggtctcacccgcctctggctaaactcagggtagcagtgtgggctggggtgtgtgtgtgtgggtgtcttccagcggccctggagcctctgaagcgacagcccgctcctcagggaggcgctcctggcagccacagcccacagcaggacagccgctcagcgcgcccttgagagctgggctagggatgagtcacacttgaaccgcctgggcccactgcaggcagtcaggggtgacgctgagaggtgccgtggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccaggctagtctgcccccctcactctgggtgctctccatgggccactcaccatttcctgagcaggaccagagctctcctgccccaaggctgggcttcagctgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaacattatatttttattatttatttatttatatttaattcttttttagagacagggtcttcttaggttgcccaggctggtcttgaactcctggcctcaacgatcttcccacttcagcctcctgcattgctgggattataggtgtgagccaccatgcctggcttacacagtataaagggaatgcattggcccacacagtggaaaaaaatatctagtaggaataggaaggacttcaggtgaggtttgatccagcagctcaaatgttgtcaccacaggcctggattcctctggcctttctcaaggtctctttcattttcatgctccacaagatggcttctgccaggctgacctccctcccctgaccccagcagctctggacacccctctcagtgccatttatattgttgcatcaataggctcatttctatatactgcaaggttcagagaagacagagtatctctctcaagagttctaacataagtctgggggtcctggctctcataggcttgaacagggccacatgtccattcctgagccaatatttgtgaccaaggggatgtggtcaatctcatccaaacctcacttgaagtgagggtgggaggaggagtgctctgcaaggagactgtaggtctggaccaccaaaaaggtagatgggttggtgggaaaagccagatgcctactatggtagtgggcggggggagggcacactggcaaggtacagcaagaggcaggggcagtgctggacaggcaggggctcctccctagcacgactggagaaaggactcctgtgaagcggtcacctccatgagtccctcctgtcctggcttccaaccactctgaagtggggcttttgtccacagacctggcctctgctgcctaccctcttctgtccccacctgatggggccgctttccttctgaagcggctgcattttgggtttctctccacaggaagagttggggctcacaggcacaccctctccctaactcttctcccccggttcaacctggatccagggatccacactctgctccgagaggccagcacgcagccactggaaaatgagccagtgggagagggcagctccatgtttattgatcagcagactatgtctttttgtttgaaacttctaaataagattacaaaaagaaaaaaaatagaagcattgcgtattaactgcattggttaaccaacattggaacccaatactcttgtattaggcccgcatttacctgagtaaactcagtggttttctgtcctaagcatgcttgcctgctacatcccatggagaaaataaacagtgaaacactttcctcatcttcaaggcaattgtctcaggcatcctccaggcatcatgaaggagggtgagcgagggtgcgaggtggaaaggtccaggccgcggctgtgactcccgcgggtgaaccacagctccacagccccaaatccaaagatgctcttgctgcagcacgacaagtgttcaaaagagaaccaggcccagcccggagaaaggaaagccaaaagccaactgaatgaatgaccctcccccagaagagcaaccctgcccccaggccatccaagtgcggtgagttgagaaatgaattgacagacgctgcagggctggagcaggaggcggaagcaggttggaaggctgttgtgtgccacccctccctgggagctggggagattcccaagtcttagtgcagtgtttctctacaaacggggtcaggagaccctcactggcaggctgacaacttggaagcagactgtgggagcaataggctggagttttcattttccctttaaactcaagaccggaaggtttgtgttatgcgataccatatgctgtgtagaaaacagggcctcagcttcttagatgttgtagttctagagtttaggtacttccaccctctctcctatacataaacactctgtggaagaggttctttgaaaattggggtggtgcaggaagggcaacggtgatggtgagcaggccccagggtcggccctgccgccctgccgtgtggggtagggagacagctggtggtgtggacacattcacagaactttgtactggtcctgggaagatacaagtcctcacttggtcgccatccctcatattttctagtgttttcttttccagtcaacttttcttgatgaatgactgcatgtaagaggatattaagaaaagtggccaaatgatttcctttttttttcctttctctccaagaacattaccaggtgccagcagggaaaggactccgctgcctgacgcctctcccacctgagagcgcagaggtagggagatcacagtgcctgagaggttttcctccacggagaaatcagagacctcaacctgctgccctctaaagcagctttctgtatccagacaaaacttacatatgtacacgttgttttaaaacgacatactcatgtgacacacatgtatataaattcatgtttatatatgacaattgaggagagttaaagaacaagataattctggatggaaaaatcagtttgcctgggcatctgtaaacctttgggcaagtgaattccctcttctctctcagttcaccctttggtgacctccaccgtggctgcagacttcaggtggtcctcacgcattcacagaactgtctgcttaggttacagcactttgggaggccgaggtgggtagatcacgaggtcaggagatcgagaccatattgaccaacatggtaaaaccccatctctactaaaatacaaaaattagccgggcgtggtggcgggtgcctgtagtcccagctacttgggaggctgaggcaggggaatcacttgaacctgggaggcggaggttgcagtgaactgagattgcgccactgcactccagcctgggtgacagagacttcctctcaaaataaaaataaaaataataaaataataaatggttcttttctatgcgtctaatgaatttaagtgcttgttaagactaaaaaccatgttatgcatttcctgctcttaaaactaaattatgtagaaagtaagctagggagtgtaagggtaggcatctggatataaatgcttctcccaaatcaagattttctcttcaatctgtgcctttgaccctgtcaccaaaggcaggtgacagaaaaaaaaaattatgtgccttttggaagactcagtgggacggttctgatttcattcacttctggtgccagcaggcccccataccatgtggccattgctgtttcgtgtctcttcctgcataaataatgcagagaggccatgcaggtatgcaattttctggagatgaggcagggagatttgcaaggaaaagtcacctacctccccaagctggtgcccacagagggggaggcacctccacctgacgcaggtgtctgagcagcagtccagagaggtttactcaggggatttggggagcgcacactctggagcagaagtacaggtatgtgcccgaatcctgcctcgtgatgggcattcatgatacgaaccacacagcctttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttttgccactctaaatatagcagaaaacaaaataaaataaataagataatctttgctgcctccaggtgccctctgagggacagacagctgctccagagttgttcatgaggacaaaaagcccaggcagcctggagacccagctgctctgggtgagccttagctcacttcctgtggttcctgggacttaccaggcccacccccatgcgcatttctccaggcaggttctgaggactctttggacaatttctctttcttctcaacccttcaatctcctaatccacccccctacccccaatattttcatagaaactaagggaattttggaggtgaaagaagtcatctagtttccagtgtccaccctccccattctacagatggggaaaccaaggcacagagagggcagtgccttgcccaaggtcattcggtgagtcagtggtggagcaggcctgaggcccaggtcccccagttcccaccccgttctgcagcccacccctcagtcggccttgggcagggacttcctgtgcgaggggggcacgaggtgggggggcaggctgctgggcagctcgtagccgtcgagcttgatcttgatgaggtgcttggccagcgcgaactcctcctcatcaagcatgccgtcgcagtcgcagtcggccagcttccagatcttgcccaggacgctgttgggcagcttggaggtcaccatctccttcttggcgttgacacctgatatcttgccattgatgggcgacagagtgtagaagagctcgtcgtagacgggcttgtctttggccacgacccactcctcctcgtcggcgccctccttggcaccctccccgtagccctggttgaaggggccctcggtggtgccatcgaaggcgccgccctgcaccagctgcgtgggcgtgctcgtctcctcctggctgatgaggttcatgaggggcgagatcttgttgctcagcatgttgtccactgcctcgatcagcttgggcttcagcgagtggaatttggtgaagtcatagttctcaagctgttcctgcagaaggacaaaccacaggatgggttacatgtggtctcttcagggggaaacagttgggggccactggagggagactaattctgccccaggcagacgtcccacccactactcaggagtgcactctttgggagcttcccacatccagatgtaccacatataggagtggttgttttggaacaagaaacaagtgtttttcctatggcagccaatctctgctggtggccgcatgagcgacagcaacctccgaggactctgagaaaccttctttcacctgcctttttaaaaatgctctagagttagtattctatttctcaagggatttcactacacacttcagccgatcttcatagcaatcctgggaggaaggaggggcaggcatttagaaccacattttacagagagctgtgaggggctgtctggcagagtcaaagcagagcccctgtctcctggctcttgactaatgctctctgtgctggaacacagagctgtgacagaaggactatgtttacataaaacaactaattaaataccttgttttcggaacacgtaaaaaaatgtagtgtaggacagcttcttagtggctctaacctcttatgaatgagctgagggcgctactcaacaggaaccccgtaggaccagccccaccaagtacggcctgaccaggggcacctgtgctaccccaggaaggtatcgaggcagggccacggagaccttgcatatacaacataatcatcatgaatccactgtcatttctaaaatatggacaaataagcaaaagctggaacttgtaagagcagggagtagggctggggagcacgagggaataaacgtagctggtaagcctgagtatcactggccaggtcaggacatatcttagctctacctgttgagtgaggcagcctgtcagcagacagagcagcagaagcacaggctctagagggggcctgggaaacactgtgactgcccaaccaggctggggcagactacaggatgccacagaggctctgtggatggcaccgtagaaactgaccttcctaccttggttctccttggttactccatccatccatccatccatccatccatccatccatccatccatccatccaacaacccacctgtccaactaatcctccaactaaccatccatccattcaaccaaccctccatccatccattcagccaacaattcatccatccatccacctacccgaccaacttttatttgtcatttactctgcaccagcccctgttctggggcttggggatacagaataaatatgaaaagccataattcctgctttaaatgagcttatgttgtaatggaggaaggatactccaattgtttaaaaaaggacttgacataacacagtgaaaaggataacatgaaatctataaagtcattagaaagaaaaaagccaagtcattaaaagggagagaggggccaggctcagtggctcacacctgtaatcccagcactttgggaggtcaaggtgggaagactgcttgagcccaggagttcaagaccagcctggtcattagacccatatatatatatatacatatgtatgtgtatacatatatgtatgtgtgtatatatatgtatgtgtatatatatgtatgtgtatatatatgtatgtatatatatacatatgtatatatatatgttagggagaggaagggaataatcacatcagatggctaaggttaaggaaaactaccgcctgtataaggagaagagctcagttgcccagggggacccctggggaccctcactgtctaaggagagaaaacacttgtttattgcaagagacaaactttctgtggctctgaactgcgagagttacctagagctttacatgacaggcttcaaagatctgatgaaaagtgtcttcaacagtagttttattaaataaatgcagaaatgttccaggtatggcaggttttatatgtgaagtatttctgtatgtacagttctagagggggccaaagagaggccatgcaggtgtgcaattttctggagatgaggcagggagatttgcaaggaaaagtcagacctcgctgttttggacagaagcaatgtgacaggctgctaggaaaaaaaaaaaaaaacttggtgttatcataaatatcatgctttcttgtaaaaaaaaaaaacagaaaaaactggtaagcaaaactaaaaatttaaaataatttataatctcatcatctggcaaaaacctctgctagcatatctgggcatgcatttctagccattaacatacatacacacacacacacacacacacacacacacacacacactgaaacaataccacactcttaacaaataatatgtcatatatttctgtggtattaatttttacataacctttctcttaacagttacagaatattgaacttagactgtagagctgggccattcttaattaaccctgtcccctatagctggacacacaggttgtttccaatagagaatcaaaatcatggtctctagggtggcagggcaggaattctgggctgacatttggaaggggattcctgggtggtagttggtggggggacagagctgagaaatatcagctaaacgggctgacatttctctagggaagggactctgacatattctcaggaagtaaagtcagcagccatcaaaccatgcaaacccagcgtgtggcccctgctcagctcagagcagcgggtactgcaggccgggtctctcaaacgcagtcactagcatgtcactcctgacatcagcaccaaacaatgcggcctgcacttcgggctcctgccaccaacatctcaatgggccaaggagatggaaaagagaacgctaagcaggtggaggagcaggcgtcccccacaaaaatcccagtgctgctgggtcaacgagtttggattccccgggtgcgtgaacacctaccccatttccttaagaatgagcctgcgctcagagcgcacacagagcccctgtgtctggcccagcagacaaaggagggtgatgcctgcccaaacttcccaccagcctgcaggggccgtggattccgactgcagagctctggaaaactggcagggggagtggccgcatatttgcaggggtggacaggaggcagcagttattcctgtcctgggaggcaggcaagaaataaaccctccattctcatccctgtggtcccccccaggcttgaccggggactgcgggggcaccagttaaaccatcatcatgtcactcctgacatcagcaccaaaccatcatcatccctgccctctgccacggtgagtccaaaacagttcttattgggatgaatacacactggggaacttaaaggtatttgcccatcaacagttgtatccactaagccaggaccctggaattgctccctctcaagaggcaaaggtcagttcccagccccgtctctggtggggctgtcccttgcccattaattgccaacattaaccagaagagttttcaaatccaccagagggtctgagcagatggggctgactctgctgccctctgctgttgaaatgctgccaactcatgagctgaggggtccaaattctccttccagtcagaggagcagagtcagcagtaacggtggcccttcgggtgctcatcttgtcctgcagtattaacactgtgctgtcagtcacggtccctccccagagcgtgccaggcacgcacaggcagccacacaggtgggttgcagggcctgtcccagctcagggaagggccttcagaatacactctcctctcactgctacagctaagagtcactctgaccagctggctccatgagagaacagggagaataacaacctaaagctggcatcagcgagctctctgcgtgaccctgatatgtgcaaagatcacagtgtggtcacttctaagcgtatgtcccccctctgtcaaggcctatgttacagaggatgttagactttaacagcctcagggatgggacaggccctaacccacacacgcgcccctcaaagcttccggtgacagcaagctagcttgcagtatcaggtgacactaagcattcctgacaggctccaggctgccttgttccttggggattctccgaaggaatggggtgatgtgactgggcctcagcctacttcccaaggaggcctcttcctgcagcttctaggggttggcacggggaacccctggtctataagccctgtgggaatcgaggctgcgtcagggcctgagagcctgctgtgatatggccttacactaacttactaattcacttggcttgtgtgaattgagcactcaccacgtcctagatgctggggatatggcagtgaacagggcatgggtcactgacctcatggagccacagacttacgtgggagagagatactaaatatcagacatcagataattcaattacatggaagcacaacagtgctcatattgtaacaagaaacatgtgtccttacagtggggttgctgtcaattatttttacccccatttgttcattttttctgttttttgacagggtctcctctgtcgcccaggctggagtgcagtggcgtgatcatggctcatagcagcctcgacctccgggcttaagccatcctcccacctcaccctctcaactggctgggaacacaggcatgagccaaccacacctggctaattttaaaatattttaatggatatcgggtcccactatgttgcccaggttgttctccaacccctggactcaagcagtcctcccatttcagactcccaaagtgctgggattacaggcgtaagccactatgtccagcctcatttgttcatttttttgtgttgatttattccaggggcctagaacagtgatagcagcaggaggcagaaaaatgctgaggcagataggggtgggtctccagtgaaaccctatcttcaagccaaaggcagtttaaagcctgcaggccaagctacaagtcaaatccatggactggattgagaacctgtctttccatttggctgcttttctttgattgatcctcacccttcacctattttacatatacctacccttccctaattgtttttacactgttatgtccacctttgactggtgcctttgttttaaccttttttgcatactcacaaatcaatcagcatgcactcctctatcctgtgcctataaaaaccccagactcagccacactggggagatgacctgacttcaggagagacaacccaatcttcccatcccctcttcactgagagttgttttgttgctcagtaaaatcctccaccctcatcactcttcaattgtcagcatgaccttattcttcttggatgcaggacaaaagcttgggacccaccaaacgcaggtacccagaaaggctgtaacactggccctctgccctcaccattgcagggtagccgtgccactcaacagaagcagtggtggggtcgagctggaccggagccatgggccagagtggggcaagagggtgactgagctgctaacatgatgcacaactaaaagagctaattagcacactgtagcaccccctctggggctttggggttgcgggcatccctgcctgggcactgccacgttccccttggggtgacacacctggtctggctgcagaccatgcacagagcctgctcctatgtcagcacttggagtggctggctggatcctgcacttgcttgctcacccaccttccgtggtgctaaggtactgggcatagacctgagtccaggtgattctcagcaaaggcttggccctccttgtaccctccatctcagtgggccatggctgctcctgagatcatgctttccttgttgccttcccccagctcagaggaccctgggtgtcttctgacctggccagcccaggctagctttgtcatgagtagctctggtcccagagcctgctccctacattatcgggctcacaggggaccagcaggagaggcctggcaagggaggcctctgtggagccccagggctcaagagcagcgtctccctgtggcaaggcactgtagcaacttcaggaagccagcgaggcacagaggccccaactgggccacagctcaggctctgtatttctttataactttcatttaggtcaagaaaccaagttcccttctgaaatatctgaagggtacaaggaaacagctgtcttactccttggtcatgggatacagggcataaccaggggtgtgaatggggaagttgcccagggagactgctcctggaggccacaacagccctccaataccacctggtgaccagaaaaacccaattcagcttgtgagcacaggaatacccatttcactgctggaagaaaagagacatttctctgttgtgtgtgcgtgtatatatttttttgagacggggtcttacactgttgtcctggctggagtgcagtggtgcgatcttggctcactgcaaccttcacctccagggctcaagtaatcctcctacctcagcctcccgggtagctggaactacagacatgcaccaccacacctggccaatttttttggattttctgcagagacggggtttcactacgttgcacaggctggtctcttgactcctaagctcaagtgatctgtccgccttggcctcccaaagtgtagggattacaggtgtgagccactgcgcccaggctctgtgtgtgtgtgtgtgtgtgtgtgtgtgtgtgtgtgtgtgtgtgtgtatatatttatttattttttgagatggggtctgcctgtgtcacccaggctggagtacagcagtgcgatctcagttcactgcaacctctgcctcccaggttcaacaaattctcctgcctcagcctccaaagtagctgtgattatagccaccacacccggctaatttttgtatttttagtagagacagggttttaccatgttggccaggctggtcttgaactcctgacctcaggtgatctgcctgcatccgcctcccaaagtgctgagattacaggcatgagccatcacacccggccctctgaatatattttaaaataaatacagctaaagcatattgggtcagatcaaatatattagactgattcactctgaatccaggtgtaaagagctgtcatcaaaacagcaagaaaaacccacctctgagttagtgtataatttatataaagcttgcattaaaaaaccccttaggatcaaagttcccctctcatcacctgctggcccttgcctcttctgcccgaccttcccttctccctgtatcctctctgctttcacctttccctcctcctgcctcgggctgtacctgcttgcagtttttaatctatgctggcttcaatgctgtcactctgtggctcaaggcaaaagatggtaactggtggtctctgtgtgcagcccatatgcaggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggcccccagggcagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtccagcagcgtccgcagagccccacagcccctgctggagcccttgagcctgcagcagcaaggctgcctgagcacataatcccacggcgtgaggcaggtcagggcagggctggaggaggccgcccaaggtgaccctgaaggccactcccagctgtgattccctcacagttctgggattccaatgtcaccgcaacatcaaccagcctccttggacacagtctaagagggctgctcacctgactttctcatgggagcttcatttacctttggccatgtgtttcctttgtttacgcattttggaagacaggcaatttctgctttattcatagcctattatcatggatcaccattaggaagatgcgttgtccttgatcctaaaccatgggactctcatttgtctccagcaaacagccagacaatgtggcactgcacctctgccctctgcccgtgacattgtagtgggctcccagtacctgcatagccttgacctcagggaagtcccctgcagaaatctggtattctcgctgtagctgaatgtagatttccggtagcctgctgataagctctctcttcttgttttcctttccaaatacacttggcatctccttcttcaggtagctgatgatgtaggcatgcacctggaggggtatagatcaggcagggaagtgtcatttagaattgcatcagagaaggaacaaacaagattgcatcttaactccatcataacacataacaggtacccacacaaaccaggtcccaaggacaggaggaggggagggtccagggggagtggagctgtccaagggtggccggaatgtggccagacttggggaaattctacggctactgttctgttgtgcctctgagtggcaattctggtgtctgtagggagtgagtggtatgggtggggcctgggtgggagagctcttagttctggcaattaaccagaatacccaggagaaagtttcaccaggctggtgcctgggagcaacaggaaatgaaactggaggctggcatcaatggctgatcaacatggaaatctgtacccagtgaacgatgagatgagaatccccataacccccctgttatgggaggtttagactctgagatctctacaggtggaattaaagtcattctgcacaagaccagctgcctgggatcaggctggatggcagaagatccccctgggagaggagcccagaagccccagaaaccttgatcactggggcttggggtagccagcaggctgtcattggaggggcgagaatctggcctcaacatttccactcttctactgatttccaacttcaggatattaagaaatgttcactacaaaagttctctttgtatatatatatttttgagatggaatctcgctctgttgcccaggctggagtggaacagcgtgatcttggctcactgcaacctccacctcctggttcaagcgattttcctgcttcagcctcccgagtagctgggattacaggtgtgcaccaccacgcctggctaatttttgtatttttagtagagacggggtttcaccatgttggccaggctggtctcgaactcctgacctcaggtgatccacccaccttggcctcccaaagtgctgggattacaggcatgaaccaccatgcccggctactttgtatatcttgaacttcagagtaattgtgaagtcaagtaagtaactaaaataagaaaggatgaaaaacagagtggtgattacaaaaagaaaatgactatgtagcaacggaaaatcctattaaagaaaacagacttctactgtaatcttgtagaagttgaaattaaataaagggggtaagcagatacattccatagctcagctgagggcccgtgtgtggacacatgctggacacagccaaaaacattttgtgaggatttggatgctaacctaagtacctaatgcaaggtctgacatgctgaggtcagacaatgtcaacttcccatctgcacaagggtcgtttaacagaagcatgcactgtgcagcctggctaccgctgagaggatggtcttggagagatgacgctaaacctttctgtcaccagcaaacttgtttatgtacttatttttcaaatgaagacaattgaaatgatttacaagattcttagagataacttgagaaacccgaagtttgggatccgttatttagaatcctgggctttaaccgctgtgatgagcaagtggtaagataccaactcctttgcctccgacagtgaatgcctggcttggtgtgggtgggctggggagggccagggctgagggagcacccttggactggaggagctgccacgttccatcagggagaaccagctgctcaccagctgtccttgcatcatttccttggcctccaccttcctggaaattctggattgggcctatgagtatgttctctatgtatacctatgtatacctctctcttctgtgctcaggctcaccccaccctggagccaccccaagggaagcaggaggcccccacagctgctcagtctcccaaacacaagggcttcttattgagaccacccccttccctgctctggggcctagccctggagcagctgcctaggcctctgtagggcttcccaagagccctcaccacgtactagtaaggtacctctgagccgccaggccccagctcagggagggcttagttcccgctcatctggctgactcctcacccactccctgccgcccaccccccgaggttgggcacactgttcctgaacactccctggtgcccagggcctgctttacctgcactgaactcagctgatgtgcacctgccacacccttcacccactgagtgtcacctgatccctcgtctcaggcctcatggtgtttgctggctgatgaccgaggtggccccgacactaggccttcacagccctgataaacctggggctgatcttgtgccaggtctcaactccctcctccttccgccagcttggtgccacctgagtcatgacccttaggtgacctgctcacactgcagctgctctcggtcccagcctccacttctaggaagttctgttagcgaggtttgtggaagtctcctgttacgctgcctctgcatgtccacccgcgtcctgcccttcctggtgcgccctaaacaataacccagggccaacttctgtgcacagacctgctttcagaagttcatcaagttggccaggcacgatggctcatgcctgtaatcccagcactttgggaggctgaggcaggtgggtcacttaaggtcaggagtttgagactagcctggccaatgtggtgaaaccctgtctctactaaaaatacaaaaattagctgggtgtggtggtgtgctcctatagtctcagctactcgggaggctgaagcaggagaatagcttgaacccgggaggcagaggtcacagtgagctgagattgccccactgcactccagcctgggtgacacagcaagaatccatctcaaaaaaagaaaaaaaaattcatcaagtcacaaggtaaattataatccttagcatcatgaaatactgaatctggaagtgaccccccaatatctactttaattcctggttccaggacatccatgtgactcactcaaggtcatacagctagttggtagatacagagctggcactagcatccaagtgcctcgttcctgtccctaaagaactaatgactccctgtgggtatgccctgtgggtatgcattaataatcttactgaagttgttcaaaatctggaattcaaaatgaactgtgtcccatagaatgagtctggaaaactttgatctgaggtttgacttctgctcgtgcctaattcactgagaggctttggaagggtcctttattctccctttccccacacatcaaacacggacacaatgatggcacacaaacgtcgggacaccacgtgggaatgcgggtgaagactgcgagctgctggcaggatggcatcctgtcattttctaaagtcttctggtaaacagacgggacagcttgaatgactaaaatccacagtcagcctccagagatcactcctgcaattatgtgtcaaaggtgtctccaaatacatgccagacccagggccagacctggtggttgtccctggggaaggaggtggaaacacttgggtcttctgacctttataatgagagaaaactaattgggaagaggaggagtacgaaagagaagagggggactagacctggagcttgaagatgaggctcaggccccgtgaccactgcctacccactgagcaacttggggccaggcatggcatctccacctcagcgtgctcatccacaaattagaaatgacaacaacattcatctcacagagttattatgagaataaaagaggtcatgtatttgaatgcactctgctcactagaaagaggagcaaatgttaacttgttatcaactaatggccaaagaccaacagctggaggtacagtaatgagagagagggctcccggctggttactccttaccaaataattaataaactctctctatttaaatagtaatataatgaatttgggttccaagtgtttaatttacattgacccctgggggcttttgaacattcgtatcttgttcaagtcatcctttgccttgtgtaaacttgcagaagccctaaggcatctaatggggatgactgggggaaatcaaatggatcaaaatgacaaaatgacaatttttctctaggctaataactcaatgagcagaaaggaaagtccttccttttaaatgtatatgaatgtatatgtagttcacacgtacactctgacacagatctcattgtgtccaatgatgtgtgtgtgtgtgtgtgcctccaagactgagacacatgtactaaagagtgatactggccacatctactctgggcttggagggtaacttcagcgagtgctggatgctggaagcgaccagtgctggaatgaaaagcttcatggaatgtgaggatcaggcagtagtttggggaaggcgggctgggaaggcatggtgacacactgtgccacgctcatctgcaaacttaacgcaacctgctggagacctgcggctggaagcccagctctggaaacctgcatagagtatttaaagccagggtatcagcacgtttataaagtgggtttatgataatataaaaaattcagttaataagcctgagacccaaaagatgaacccatggggtaacaagagtgtgagactgtgagaggcagagaagggcagctgacttgagcaagggtttgttattctgctcagatcaaaactggcaccaatggcacgtgtaattccgtgcagccttaaaggggaccggagggggctgcacacttgtctgaggtcaaccttcaaagagacaggcttccatttatgggctcaagcactgacacacacacatccacagtagctcagggctgctgactgagttatttttagagccctgccgaggactaggcaataccaggatcttcatgatccattatatcatgattctcacacgctttagcctgaatccatttggtgcacaaaaaatgcctcatttctttacaggagaattttttttttttttttttgaaatggagtcttgctttgtcgcccaggctggagtgcagtggcacgatcctggttgactgcaacctccaactcttgggttcaagtgattctcctgcctcagcctcctgagtagccaggattacaggcgcccacctccacgcccagctaatttttgtattttttgtaatttttttgtaattttttttgtaatttttgtatccagcacttgctgaagttaccctccaagcccagagtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaactacagtgaaccttgaaaatcactgacctctcctcttctttctcagttttacttgtttcttcctcaaatgttgcctcatttttgttgagcaaagatctccaaatgggtgacagcctttcctattcttgggcaatacgcttctaaagggtggggtctgatagtgaacttgcattgtttgggatttgtatgagtctaatttctttaatttggctattttaattatagctgaataaaagtaaatgacatgttccaaacccttttttgggctttcccaaaacagcttcctttaaagaatcatgaaatgaaccctgattggcatctcagagtgtgagccgtcttccaagaaggatgtctactgagattgtaagaagtgatctttgaggctaaccaaaaacccactctaaagtttccctgttccttaaatacagagatgtgaaaaaaatatacaaacagaaaaagaagggaaataaacttcaagagctctttgggaagagtatctatctacttttcatattattaaaatgtcacctttatgacacttcgagtttgattaaaacggcgcacttgctttatctggatgggccatgaatcctggttaattatggtgttctataaataaacatactccacaacccaactcagacttgacatctcttagctgacatctgaaaacttaccctttgcatgttttcaaagtgtcagcttgataaacctaaactttgtagggtttctgtggatggagacttttatggaataaatagattaacagatcagtgcagaaaacaaggacacagggaggaggtactgtagctgctgttcactcccgatttcaggtgactgctttctggactgaggtgtcacactgaccgaggtttgaacgtatactttgcagcttacaggctgtgaagcctcggggacataacttcacctttctgagcttccgttccctcaggtgggaaatgaggacaaaaatgcccaactgtgtagttgtcaacaggatcaaacaaaaaaacacacataatgcagactacagagctttggaacagttggtgtgaaaaaggaaaactggatcaagagaaaggttaataaaccaaaataaaagcacttttggaaaatataaacactccaaaaagaaaaactcaggtaagcatctgtccatttaagcagaaacaagttcagcggtggaacatgaaactgcaggtggcgtgaggtcaatgtcatgagttagtggccaaggccgccgtgctgagtccggcttctcctccgggtgagcccgcttcctgtccccgttcctcagcatggcactgcccacgagcaactggcactgagaagctccggctgcaaatacccatacttcaaacattttcctttgtgaaaaggaacaagccagatactattcttaggaagaaaaaaaccacaagcctttttcctgcaagtaagctcagcaagtttgaccgtcccccactccctgcatccacacaagggttttcattattcacagtgtcagaatacagagcagcgttctgtgcctccaaacccaggccgcgctggcccgttcagagggcccgaggctcaaggatggcagggaagctctacgggttaaggcgcttggcatttccagcgagctttctgctccttatttatttatttatttatttatttatttatttatttatttgagacagagtctcactctgtcgcctaggctggagtgcagtggcacgatcttggctcactgcaacctccacctcctgggttcaagcgattctcctgcctcagcctcctgagtagctgggattacaggtgcctgccaccatgcctggctaatttttgtatttttagtagagacggggtttcaatatgttggccagactggccttgaactcctgactttgtgatccacccgcctccgactcccaaagtgctgggattacaggcgtaagccaccgtgcccggcctccttatttatttatatgactgaatacagcagcatctccagtcactgggtcttcatttaccaataactggtaaatgaagaatgtccatgagcatttaaaaatagttttaaaaaatctcaaaatctgcaaaggctatgacatgagtcaccaactttggttataaactaatgtggggtgtcacacaccttgaaggttgttcagttgtacctgctggagaaaggaaacaccacaaaccaagggatcaccgagtggaaaaacagccttcctgctaccaagcattaggcccaggacaagggcgagggcaaaatcatttcaggagagctgcacgtaagtggatttacaaactagttagcacatctgccttgcagaactggagcaaaaatggcttgtagctctggaaaggaagccacttggaccaggaagaacagataaagaaggatgactcacacaagcaccacaccactgcaggttagctgagccatatgggaggaatgcatgcacacgcactgggacacacgtgacagagagggacacaggacatcgaggtcctgtgtgaggggcagcagcagccaggacggtgtttgttttcacccaggcaagaggctgcccagtgagcacactggcacgaggacaggctgctaatgagcagcaagaaggaggaagaattgtccccaccttggctgtccccatcagggaagccctccctgcctcctggccaggcacgtagtcacccttcccagagcactcatggcagcatccataccatgactggcacatagccaatcacccagggagctttacacacacacacacacacacacacacgcgcatgtttacacacatgcatattcacacaaggccatgtgtgcacgcacacccctatatccgaggctctggggcagggcctgggaatgtatgttgcttctgatgatcagccaggtttgaacttcactaggactagataaaactctaaaggcacttccagcattagaggacaatgattttatgaaacatgcacatattttttaaagagccatttttttctctgtattttctcttggaggagggatatgcttttctctctttggagacatgaattgactctgtcacttgagggatgtcagcaggtcacctctcactgccccattgggcacacactcctggggctgctgaaaggctcagctatgaggcaggcgagccaggagcccaggcatgcaggctaacagcccgcagcccagaatgaggatgcgggggtgacccaaaaccagcacactccaagagtaagactgagccatacttcttcccagggctcccctggatccaggtggtaacactggcctttggtgcacggggactagcagtggcctctcagcatcctgttggtctcaccaatgccacctctttcaggtttggttggttatattcctatcgtcctgacatcctaacagctaccatgtagtgggtgcactgattgatccccctccctgtgcaccaggcactatgccaagtgctctgtcacactgaccaactgtcaccccaagttcttgtgaagtgctcttattagctccatggtacagattggagaacagggttagtcatctgcccaggagtgcagagccaggagctagggtgtcagcagggccacctgacctcgaggctgtattcttaacctagcgcatgttcattccttaagccttctggaacgaagcctcctcccacccatcttgcctctggagaggagacagcagagtcccagcccctggcctctgtgcaaggcatctcctggcttaccttggccagcctcgctcgcttgatgaggtcgttgagcttgcgcaccgctgccttctgggggaggctctggatgtctctaaagaggtcctgggcctcagcctcgaagagccggcggttgtccgtgttctgcaggggctgcgcccagaaggagccaatgtagacgcgcagtacctcgggcgtgttgatgaccttgcctagggaccacatgagggccccgtagacccgcatcagctgctgcgtgtccacttggtcggccttgttcagcacgacacggatcttgtcgtcctggccccggaaggccttgatggcctctgagaattcatctgagatgtccagcttgtgagcgtcaaagagcaggatgatcctgtccaccctctcggcaaaccactgcaggacctggcagaagtcatagcctgggtggagagaaggacacgtcagtgtagccactgctgcaggagacacgtttaatgggcggctcaggaacagtctcgctctccagcagctgccagggagagagccctgtctccaacctggaggcagtggaggcctggtgacatgaaaatcacgggctggatgaatccgggtgggaaggacctggggagcccttccacaggaggagggaggaaagagaatggggctcatggtcactttgggaattgctgactttcatatctgcgatttcatttagtcctcatgagtgttttatttcacctaatacagaccttttgcttgatggcagaattgatcaatggttttataaaaacacaggccatgggtcaaaagatcttacttctgaaaagtctcacttttctgaaagccccaaatacagaagaaagagaaccagaggccacctggcatcccatgggggtatccagtaagcataacagaagaggcatcgccttcaattaacccaagtttgtagagtgctgaggaggtcaaaggttggcccagccagtgttgtgatcaatatttatctttggactatttataactcaggtatattgtgaatatttttttaacattacgtatcacagccattgtgtaaaatggtctcttgccaatttctttttttaaaatggcctggcccacagcaaattctgtccagcctattctgaccacctccacaaatcatgcagctgcataaacactcttcagcccaaggtcaaggctctcaggcctttccccagggaggcagattcccacgaaaagcaaacaagaggaggccaagcccacaaagttgacttttaatctcagtctgactagttgcagaagcagagtctcaatccagcccagctagtgctgagatgtcacctgcctgacccccatgctaggggtcgtctcccctcttcttttagattttgaaaactttcaaacatacataaacatctgtaagtcatataatgaatgctgatgtacctaccacataattttaacaaatgttgacactttgctttgtttgctatttcagatatgttttaaaaccaagtatcgtttctttagataacaaaataccatacggtggtgagaaggaactagatcttcacttgtcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgccacagacatgggaacagaggaaggttccacgccagtactcggcccactgaacgctgctgcttctgggcatgtgaccaagtgaaagggaaaattgggtttcgcatctcactttccatctcagattaaataccagatgaagaagcaggcccatttaaagaaggctgagccctggagaaagacagcaacatggtattatcagtcattttaggctctttgctggagagggaagttggtaaaaaaacctaccaagaaaatcctgtaagtcctggagcctggcttaacaatttcattctgctgggcctcagtttctatacctgtgagtcagatgatcaaaaaggattctttctagatcttaaattttagctatatagggtggttccaaacagtaagcttctttgaaataaaaagccagattcccaggaaaatcgatttagctcagcgtctgtatagtacagacacgaactagttacagtgccagcctaagatgacccttcagatggctacagtagacccttcagatggctacaggaatactgaatgaacaactctaaatgacacaattatcaaacagtaagtttcattttattacatcccttctactggattcatgtgctatatagcatttgggccaatttgaaggtccttgaatgtttctataggtgtaattagttgccccaaagtttaacttattgtcatccaattccaaacaactctatactgaaagaaactatctgaggaagggttgtggaatgtatgacttccaaggatgcttaagaagtcaccccatctaaccttctgatattattatatattaggatgaacagatccaggaatcccgtgtcacgcacatggaaattgtccattcctcatttttcaagtgggctttgtgtataagtcaggctagaaagtctcatacaatatgtctataaatcagacggagttggcgtggcaaacattacttgcactgaattttcttgaggcaaaatgccaacagactccacccaaatgtgatgaggtcaaacatttataagcaaggctttgaccgtgacaatgcatcttgtcattctgtggttcagaagggcaaaggtaatgtttcttcaggctacagttttctaaagagaaatgttaaaccaacgggatgacaactggggtcataaagggctagaaagcaacttctgacctgaagaccccacccctcgccctgccctgttcctcttttcaaacatcttggcattgcacaagtgtcctgcatgcctgtggacaacagctggcactgcagaccagctctagcaattaagttatcagctaaccagctcctcaagccaaactattactcagagacagttatttctgggcttatgtcacagatggaaagaaagacccagtcagtgggaaccatgggaatccacacggggctccttataaaaaaatgactcactgattttgctaaaagtagcccatgtagttaccaacagtatttcaaaacagtcaaatacctccagaaaaggaaatactttaaaaaggtatacatgaaaagatgctcaaccacactaaccatgaggaatgaaaattagaatcataatgagatggtgggcatgtaaacaggcatgccttctacagtggcatttttggcaccagctaacataataaaaagaccgccgctccttttgattccaaaattccacctctaggaatgcatcttagagttacatctgcacattttttggattagtctctatttcatttatttttttacattgataaagaaaaattgtatatatttatcatgtccaacatgttgttttgaaatatgtatacactgaggctgggtgcagtggctcatgcctgcaatcccaccactttgggaggctgaggcaggtgaatcacttgagcctaggagtttgagaccagcctgggcaacaaggtgaaaccccatctctacaaaaaatgcaaaacattagctgggcatggtggtgcatgcctacagtcccagctactcaggaggctgaggtggcaggatcacttgaacccaggaggtcaaggctgcagtgagctgtgatcgtgccactgcacttcagcctgggtgacggagcttcgagatcctgtctcaaaataaaataaaacataaaataaagtaaaattaaattaaaataaaacaaaattaaatatgcattcaatgtgaaatggctaaattgacagtgcaattagcatatgcattacttcacatacttgttttgttgtggtaagaacacttaaaatctactcagcaatttcttttttttttttttgagacggagtctagctctgtcacccaggctggaatgcagtggcgcaatctcagctcactgcaacctccacctcccaggttcaagtgattctcctgcctcagcctcctgagtagctgggattacaggcgcacgccaccacgcctggctaatttttgtatttttagtagagacagggtttcaccatgttggtcaggctggtctccaactcctgacctcgtgatccgcccacctcagcctcccaaagtgctgggattacaggtgtgagccgccgcgcccagccagcaatttctttttttttttaagctcctcccttttcagcaattttcaagatatatttgcacgttatcgtgccaactgtatacacttgcaccgtacatgctaaactgtgtaaatccactgtggcactgtttgtaacggcaaaagattaggaacagcctgaatgtcacccaccaaaaggatggcacctattaattctggtctatctatatgatggactgcgggaggcagctccgaagtacagacatggacaagctccaagatttactataagtgggaaaatcaagacacagggcagtggagcgaatcccgccagggctccacgtgagtgggcgggtgagctgggagaagccccagggtctgcaggcagggtctgctctgggagaggaactgggggatatgggtggtacagacattcttcactatctttttgtagccttttgtcccaagcacatacacacctacccaccgcagggtgcttcagaaaggtgaaacgctgcatacatggtctgatttgtgctttgcatctcgatttggattccaacaggaggcaattttgagaaagagactaagattacaggtgaatggaggtttcttgaggaaactgcatcagggcatgtgtgagaaatatccctagatacaagaaagaggattatggcaaaaagaattggaggagtgccagaagccgggcccctcagccacacccgggaacactgctcccgggtcattctcttcagcaggtttcccacctccagcccttgtctgcactctcgtggctttccatagctctacggtcaggcccaaatacttcacgcaccctcaccgcccctgctttggatctctggaagagcaaggcccttgtctgagtcccaggactcggccatcctctgccctcccctgggaaatgctgagcgcttggccgagagggccctctgagctgggtccgtctattctgggaccaccccagttctataaaatgaatcatgaccgcccctatcaccagttattaatcatgatccatgttaaatggtttacacatgttatcttcaaaacaaccctgggaaggaaaattccctcactttataaaagcggaaagaggctcacagggccccatgctgggattcaagctcaggtcagcctcctccagggcccacaggagtgtgcctgcatctccccacctccctctgtctttctaaggaaaatacagatgctccctgaaagccttgttattttcagcgtttccccaaccacaggcttgtttggatggtcgagatgcctgcctgcctgccgggcacaggtacatgaaacctgaattcaagccacacgtgtatcctggggaggaccttttgctgtttccctctcactctgagcttcatagataacaggaacggctgatatctatggagcacttaggtatgaacacagatcattcagattctcgtaagatcccactgtacgagagaaagtaccttcccctgttttagagcaggggaaaatgaagctcaaagaggtgaagtaactcgcccaggttgcccagctggcaagggaaagagccagggacagggagaaacgtgcccggccagtgtttctcggcatggattgccactgcctctcttccacctagaatcctgcatttataatctttccctcccaccttctaggctgggggttccccactggtgcacagtgattaggagggagagaagctttaccacctctagcaacagggattgaggctgtgtaacaggaatgtccccataaaaccagggaaggttattaaacgtttcaaagtgtacctgaaaacttaaaaaaattccttctttattttcattaggggttcctaaaaatcctagcttccgaagtaggctaggcgggggtgctcctgcaagcagtgagacacagacagaggacccagcatcaggcctcacgccctccctgtcagacgcccatgaggccgacagggtcacttggtgactcctgcgggacagtcacctctgcttccttccaaagccctgccctggaaggaggctggttagtcacagagcctgccccaccccatcgtctctctcactcaagttctcccctccgttctctgagagggcagccttcaccctcgggcatacagagatgcaggacaaagcccaggttggtttcggtaggttctccaagtttgccagccccttctttcacttgttttggggatggcagggtatgtaggagggacaggctcaggctcaggagtggtggctcagccctaacccagattcctcaaaatggggccccctgtatcagaaccctctggaccctgcccagatgcccctgaaccatgtgccaggaagtttttttttttttttttcaaataaataaatggagttttgctctgttacccaggctggagtacagtggcacaattatagctcactgcagcctcaaactactgggctcaaggttctcttgcctcggcctcccaaggagataggactacgagaacacaccaccacacccaactaatttattttattttttgtggagactgggtctctctatgctgcccaggctggtctggaactcctgccctcaagtgatcctctcgactcagcctcaagttctaggactacaagtgtgagcccctctgcctggctgaagcagcattttaacagctccccaggtgataactgtctgtggaccctggggctcaccgtgctagtcttccgagcatcatttgcagccgtgtggactccagagcaggagggggcagcagggaaaggctggcctagaacatatatgccacatgtatgacagagaaggaaaggacagcaattgcacggccgaaggaaagagaaaaaccagcaaccaaacacgcccagagaactgagtggcaggcccagggctgttcttgcccagtacaggaagacccggacattcctaataattctaggtaatcaacagaagattgaaaaagacaatccttcagtggcttcctggtactctcagagaaaaatctatgcacttccccagggcctacagctcacagcaggtggcgggggggcctcctgatctcatcacccaccacttcctggctgctccctagcctctgccttccccgaatctgccaggtctcacctactctctgcctttgccaatgcagctcctcctgctgaagagctcttcccccaactctctgccaggcaaaccctccattctttacgtccagcctaaatgccacctcctcagagagccctccctgactgcccaccccttgctgtgggacatgtctttgtttcaattgcatttgttttgtgttttggctcctctatctcccctagtatatgcttcatgaaggcagccatgaggtctcactgttgctgtgaaacctaaggcacctggcacctgacacatagtaggtgcttaagaaattgaccagggggcacagcagagtggggtgcacagcagacattcaacataagaaaacctctttcccctttccactatcctaggagtgagaatgcagggtagtgtgtactcttttccaagcaaaattatcatcaaaaattgctaaaggaaaaaaataggagatttgatgttgctgggggaaagcatcaattacattttctcatggggtttgctgccttctccgtgtgtgtgactggcagctgtattttgccctggtttgcatccacgcctcttgtggttaacagcacgcactctggaaccagactgcctggtttcaatcccactcaaccacttattggctattttggtcatcagccaccttaaaatgtagtggcttaaacaataacttctattttctctggaggttctgtgggttgactgggctcagttgggttctcgcttggggtctgtcagaaggtgatagtcagacagtggttggggctggagttacctgacagctcaactgagctggttctgtgatggcccctttactcacatctcagctggaccagccaaggaggctgcctgggcctcttggcctctccttgtgactagcttgggcttccctcacagaatggccgtctcagtcacagtatgacaactactaagagtagttggactttttagatggcattcggctttccacagaatgaacacttgtagagatttaggtggaacctgcagggcttcttatgacctagccttaggaaatcatgaagtatcacttttgcagaattctactgatcaaaagtgagtcagaaggtcaatccagactcatgaagagaagactcccaaggcacgaatgctgggaggcacaggtcttggcgtggtggtgggaggaggcagtatctttgaagacaagctaccatacttgctacatgattgtcagcaaatttcttaagctctctgtgcctcagtcttctcttctataaaatgggataattgctcctacctcacagagcttttgtgaggagcaaatgagttaataatatgtggaaagcacttaacaatgcactatgagagtattagctattattattattactcaaaagagtaaggagcaaatgtttttctctgattaatctctgtatcccaatgtctgagatatcccgtgaaatgttttatatcataaacataaatatgaaatgctctatatgcaaagtaagtgaagtgtccttctccccatcaaataaaattttttgtttttcatctaaaagtcaaggtttcaagtttagataaaaacagtcatttctcacaatcaataatgcatttgatgtattaacaaaaactcaaactagctgccggggctggcgaacgctgttgtgagtcacagtggcgatatgctcacatcagggccggaagcagtaacacttgtggtgtggaatttcccgtggcaccagcggaaaaggagtctggatgcgtttgtcaaaacttccccgaaacaaaaagaaatcaggatttcctgctagaggcccaagtggctagtgatgtccaggacctcacaacccaacctcagactggccttagccctggctggaaaacaggatctgccaacaaatcatcagggctgggccccagcctccagggatggacacttttctgtcactgccaaatccagacaaagctcagagtcaggtcactgaatgcaaactctaaataaaaaaatggcttcatgatccacgcctgtggctgcatgttctattctacagaattctccaccacgtcctcccatacctcctacccctcagtattccatgtggccttcaggacaaattcgagtctcctgccacatgcgcccacctgccatggacccatgttccagccacatgcacagcttccgttcctccaagggccctgagctcacatatctctctctgttctttcatacactctttctgttgtctagaagagatatcaacaggaagggcagccacagttctctctccctcgactcggtgctaggcagaggctgtggtaagagtgtcatgtcttcgtctcagtttgtctgcacgctggcctacagcgccctgccttggctggctagagagctcacccatctctccagccaggctctgatcaacagcctttcagaaggatagacacatagagcaatggaagggaactgagggttcttggtcttttaggaaaaaagactcatttcttttttgcatatgtgtgtgttttcctctcaaatccttcttgttaccaaagcctgagaggggaagtcattcttatctggacatctctaagtgttctctctcctttcccgagcaagcttcaaaatccggtcttttgtcttcaaagttcaaaagtggatgcatttgtacttccctgattgtggtctgctggtgcctttttcatttttttctgcacccctcttagtcacagcttggatgtccaggccccatttcctagctctgtcgattcttttgagatatgggttgagtaaaccttatccgaaaaggttgggactggaagtgttttggatttcagattttctgattggggaatatctgcacatacatatataatgagagatcttgggaaagggacccaagcctaaacactaaattcatttatgtttcatagacaccatacacagatggcctaaaggtaattttacagaacatttaaaataattttgtgcatgaaacaaagtttggatcgtgccccgtcacatgaggtcaggtgtagaattttccacttgtggcatcacgtcaaaaagttttggattttggaggattttggattttgaattttcagtttcaagatgttcaacctgtattgtgtttgagcaccttagctgtgttggcaggcccttgaaacagcctgttcctgtttatatcactacccaggcgcctttttgattcttgagggctttccttaacatctccttaacattgcctaggaggacttaaagatgtttgtatatagacgttaaaatggtaatcagtgattctgaagtttctgttattgcccgtcatgttacctgaagtgcagttagatcctcccggcttcatgtactattactgtccactgcttttaccagcagggcattttctgtccttttatttttcattgtcttcccagttctattcattggtttataatgaataggctgggattaagaggcgagagcttaaacatcaggaaaagacactctcgaattttcatttgacagctgttgttcctgagagaataagtcgatctgttagaaaatttagatagagctttttccttctagagttatttaaatttttaaaagggagaagctgtactatttttattaccaaaatcaagtctattgaaggctacgcaaaacctcatattctcaagaaaccataggaataatctgtggttaaaacagcaccttgaaaatgccaaatgctaaatagattgataagaataccagttgctacattataatttttcaaaggatgttatgattggagtcagaatccggaggtttgtactaagtagctgggaacacacttgtgttcatgctaactctagaaatatatcctagattatgtttaggttcagcatggactcaatagtattctaggaaacagtatttcagcggccagcatgataagaggtcgagtgggaaggaaaatgctatgcgtgtggataaaggtgctctttcttctcatcgcagagtcaaacacctggctgctatcaccaaggacaaaggatgttctgaagagtgaaccaactcagatttacccacacacttcaagaaagcaatttagaaaaccgcaggaatccaaacattctttcattggctactaaaatacaagaaaagaaatcaagaaaagtttgtaggacttttaggaagctattacttgatcagaatattattattataaatatatcagaacacttttatccttgcttgatgggaattcaacacttcacgtcagccaggaaagctacaggttagtaactaaactaacctagtctgttgtccctaaagattttctgccaatggccaggcatggtggctcacacctgtaatcccagcactttgggaggccgaggcgggtggatcacacctgaggtcaggagtttgagaccagtttggccaatatggttaccatactgattatcattttaacatttatatacaaacatctttaagtcttcctagacaatgttaaggaaatgttaaggaaagccctcaagaatcaatatggtgaaaccccgtcacttctaaaaatacaaaaattagccaggcatggtggcaggcacctgtagtcccagctactcaggaggctgaggcaggagaatcacttgatcctgcgaggcagaggctgcagtgagcactccattgcactccagctttggtgacacagcaagactccgtctcaaaaaaaaaaaaaaaaaaaaagattttctgctaaccataattgaactaaggaaaacttgaggggtaaggagtttccatacggagtagtatactaaaaattgctccaaaatcaattgccctcatgggtttcatttatacggctcctaaacaggagatttagatgacgtttactcccctggaatgctatgtatttttttttttaaataaatagggatgaggtctcactatgttggccaagctggtctctaactcctgaactcaagggatcctcgtgcctcggcctcccaaagggctgggattataggcgtgagccaccgcgcccagccactcagcttttgagggttaatcatcaaccgcacaaaggggaaaggaggagcagtggagggcagtacacaagcggccacctttcctccttcccaggcacaatgcccataagggaggcaaagacccgccaataaagtcagtgggggatgctttaaacatcttgtggggtcacagtttgtacccagtctattatcccatgttgacattaattcttggcaaaggtggggctgtggtcttatgaagctggtcttacgaagctgggtgtaggtgtgagtatacgtgagaacgtggcactgtttgcaatcgtttgagctgaagctgctttacaacagtatgcattctttggggttagtgtgttgaaaatgtcagctgagtgacttccaccaccagctgcgcccctaacaccgtgtggcaccgggcttgggaaccacagctgtggcccgtcgtgctgtcatcgcttgtggctctgggtccttccccacctgttgctgtgtccgtcggtgtggcagggaccgccgactggctggaacatatatgctatttctgtgcataggatgtgagtaagtacatgccatagtaagtcagaccaggatatgagtcagatcatattataaagtgatacaaagaactgatcttcaaagcattctggaagcattaatccacgtgtcaacactattgtaagggagctacagtttgaaagacacgattactaagcaaaggagagacgctgcaagactcaggtgaacagaactggctaaaggcctaccaatgaaaacaaatgcatatggtgggagccaaaatccggaggccttaaaatttagaggtaaaaagaaagagttagcaggaccacatatttctccagcatattcagtcagaaatggagaagcagtgaaacacgggcagctcagaatagctgtggaacatgggcctgctttattatccatactatctgcagagcaacctttctggggctaaattaatggtcctcaactgactcttaaaaaaaaaaattgattggcactgaggtgtaaagacacacataaaaagacgaccatccacagcactatttgtaagcataaaaactgattaaccatcatgatgtccacaaatcagcaaaatgaactatattatgtcactttcatggaacccaagtagctattaaaaggaatgaaataatctgaatatactggcatggaatgatgtccaaggtagactgttatgaagaaaaatcaaggtgtagaaaatgtgcatggtaatcccatttctattagaaatgtgtttgcatatgcgcaggaaaaagtctctaagaagtgagagaaaaccattaataattgttaaatgtgacagtgagttttttttaaattcttattcattgactgaatcctttgccataaacatctatacttttataatagaaaataaagccaacaagatatttatgaatagcattaacctgttttttggtgtttttttttttgtttttttttcataattgcaaggttcttggaggcccgggaaaggtgaccttaatggcattccatagctggcaagtccctgactgaaacagtgaaggcacagcaggcaccctgggaggcctcggctcagcatagccccgagctctctgcgggaccacggagcagcagagatggcattcccaaaatgccaagagaaaggagggcttattggcctcggaatccctttcttgacccctgtcacgggaccctcactggcctatgtaactgcacttctgctttgtgagctgtggggtgttcactgccttgtcataacctgcgaccgtgaccccacacaggcttctgctcaaccctggcatgcccagacttctcagcacggtgctaccgacttgctgttcaaggggttgtgaagagttctcagccagaagtgatggcagcgatgcatctgctccatctcctccctcccagcaacccgcctttgtttcaagggccagggcaaggaaaagacttgagctgcctctggacctgtgatggcaggaacccatcctgaccctcccgatcaggcatttcctctccgtaagtcaactctgtcctctggtctgcccctgatgcccccttcctccaggacggagggagatagcaggcccaccggttttttgtttttttttttttttttgagacggagtttcgctcttttgcccacaggctagagtgccatggcatgatctcagctctccgcaacctccgcctcccaggttcagctctcgtgcctcagccttccgagtagctgggactataggtgcccaccaccatgcccagctaatttttgtatttttagtagagatggggtttcaccatgttggccaggctcttctcgaactcctgacctcagctgatccacctgcctcggcctcctaaagtgctgggattacaggcgtgagccactctacccagcagacccatctgttttgactacaaagcacaggcctagaagcagctattgcctcagccttgtcttgtgaaggctggagaaacttatgcttcggcacaagcattttctatccttcacagatcccctctgaatgcttcataatctctccctaccccacagcttcccttaggtaattcctactccttcagatcctagttccaatgctgcttcctccaggagcctctcccaacacccccgaggccaagccaggtcccctcacacctcgatacctcccattgtttaccccactcctcatcttcatttactcatgtgtaacttgacaaatgtctttctcacagaatataagcctctggagggggcagagtctttgatgctatgaactcctggttgacacttggggccccttcagctgcccaacagctgtcctggaggacggatagaataatatagggacagaaatcctctgctcacagcagagagggcctcagccagcacttggtggggaggggcagggacaggcactgacctcggctgatgcgctgcttctccccagaaaggatgccggggctgtcgatgacgctgatgctcttcaggacctgattggggagctgtgagcacatgaatctggaagagacggatcaaaggaggggtcagaaactgggcatcacagagtgctccaaccatggggcttcttggcctctctgggcttactgacatctgtaaagtgggggcctgaaggagactgacagaaactgaggatgcctaatgaagttgtttgtgaagtaggagcttggaggagattgatagcacctccatccagccacagagaacagatgctggcccatgggacaggtatgagaggtgcacaagcacctgctgccatctgccacctgatgcctttctgttcattttgattttagctaacatttattgaacatgcaggtatcttacaaatatcctctcatttgatcctcatattgacctcatgaggtgaaggaattatgcttaacataagagaggttaagtaatgctcagggtcactcagagcggtgccttaaaccaaggtcagcctgcctccaaagccatgggcctcacctctcctggctccatgctggcccctgcccaagcatcctgggcctctccccctgggaatcccatgccttcttcaggatgcactggcccactgggctggagagccccaagctccctgcctatttcctagcatgaaagctgaagggactggggcctgtttccccatctgatgccccaggaacttagcatccagcccagtgtcccctatggctttagggccagggaggggcaggcacctgtgacacccaacatcctccaggtgcttaggagtctaggggagctggagagtaggtgaggggaccaggttggggaaggccctggctgagcatctttaggcccctcttgttcctcatttgcctgataccatctcctcctcctgatcctggtccctttccctgtagtcactgcccttgtatccactccacggaagcagagtgcggaggaaaaatctagcctgtgggtcagcagacctgggttcaagttctgcccagcgtttcctgataatctgctatgggactctgggtaagggcctccctgctctgggtcttgggttcctcacatgaaaatggtggcttcccgacagggtctggcgatgtccttttagctttcagactgagtaactccaaaagtgatggcaggaagtgctttgttacttccaccctgggcaccagggtctgggatggacctttgtgaggcactgtgcatgtttaaggcagaaagtgtagaatgcctctccttttcctttactatggatggctgacatctgtgtctgtgtgggcagaaagctaaaagctcaattcttccgtacgatggaagtggtggggattactcacaaagtaaaaatgctgggaatgcaggacagggaggcctggccagcctccacagtgcacatgtggacaccacagccctgggtatgagcggccgttactgacatttcaaaatcactttctctgaaggggcttgggatacgatttttcacacagtctttcctacattttcaaatcggcccaggaagatatagaaaaagacattaggatccttttgcaggtggaaaagttgaagcacaaagcagttatgacattctgaggccatgctgctaatgcacggctggttgcagactgcaacctactgtttctgatgtcagtggggtggaatttaacccacaaagttaaaaacctcataacattaaaagtaaagggtcaagttagtggaagagaagcccccaatttccacctgtctgcagacacttgtgcacagtcccctcctgtaccccaacctttaaataaaccctactacccaacacggggagaggtttgtgggaataaagcacatgaggctcaccaagcattctttgtaagttcacagaaaaaaccccaccatgccattattcaattctctagaattggggtgggaacagggctctgggcacatccgtggtgaacctcgtttcttgtcaggaatgattgtctctcagtgccgtcccattctttccatcagatggcccgagacatctggcggagctgaacatatcacacctacgtgaaacaattttctgcaaaccattcccgtggacaggctgatcttttccccaaaccacaagctcacactcaatatccatttttccaaaacagccaccccctagattctcaggtgaggctaacagagggattcaaaatttgcacactgttcactccctgtgtataaagtgacagcctttccacagctcccaggcctcctgacatgacagcagaggccaggcacgggagccacagagcaagccaccgtgagatgtgctgacgtcaccacatggcatacaagcgggcaaagcgaggagcccaggatggctgaaaaagagaggatgaggagcagcaggtggaggcggagggagagctttggctggggcacctcaagagtgggcagctggggttttgggtgcacagctggactctgctccctgaaagacagtgtccaggggtgaggggcaggcaagagaacagaaaggagcattgagaccctgtggtgccacgctcatgctgcgaggtgacaactgcatatgaatgcattcgtacgaagttatgctgggatcagaaaaaatcctaatggtgttctagcaatcatgcctcatgcttcttctctgagaaagggaggcgcacggcaaacgtacttgctgtgtgtataacagcagtgcagtggtagtcgtagcccagtagtgaagaacctgggctctgcagtcagcactgccaagttcatgtcccgaccccatcaactcacagccgtgggactgggcaaggtatgtcgtgtgactcctctgcgcccagtctcctcctttataagcagaggttcacagccctacctgtaaggttgtggtgagcctggagttaatgtgcacggaaagtgctttgaacggtgcctgacacccagtaagggggccctggccggcccagcttattgaaatgcttccaagcacagatttgctgtcccaagatggatttcctactccttcctggggagattaacacaaggaggatctgtgccttgccctctacatttcacgtaaaatatgcagacacatgctggttcaacccaggagcctcacatggccctcacccgaggatgacctgataaatgttgtcttctgaagtaagagaagaagacggagcaactgaagatcctaggctgccccctcaactccatatcctctccacgtctaaggaagggccaggggtagcagagatgggggataaagtaatggtccaggctatgaggtctcaggcaagctgctaggagtcctgccacacagtaaaaggagagagcaaagccaggcaccatgactctccctgtaatcccagcactttggaggctgagtggggacgatctcttgaacccaggagttcaagaccagcctgggcaccataatgagacttcgtctctacaaaaaataaaattagccgggcatggtggcatgcgcttgtagtcccagctactcaggagcctgaggtgggaggatggcttgagcccaggaggtcggagctgcagtgagctttgatggtgccagtgcactacagcctgtgcaacagagtgagaccctgtctcagataaatacatacatacatacatatctacagaaggagggggcaaggagattacttaaaatttcccccaaacactaaaattccaattaaatgatcagcattttaaaaactagacttttagaagaaccagacagtaccttaatactgattttgatttctcaacaaaacagtaatatctgtagcagttataataataataaaatagcacaaacatttcctcacctcttactgggtgtcaggcacagtttgaagtactttccatgcacattaactccagccttactgcagccttacaggtagggctgtgagcctctgcatttagaggaggagactgggcacagagcagacacatgccataacatgctgagaagtgatggagctgggacatgaacttggcagtgctgactgcagagcccaggttcttcactcctgggctactatcaccatggcacacactggaaccactgctgtgtggcatatcatgtgcagggcaacatcctaaaacaaaggggtgacgtgccacagccctggaacttgcccctaagaggcttccttgtgtggtttgctctctacctagtggtgtggagtgtctgtcagggtggggaacaggaggtaggagatttaggctccagacgtctcccttactcattctgagaccttgaccttgcacaggtctctaaacctctctgagcaattctaccaggcctgcggacttccaggtttgccattaggttcaaataaacctaagcttacagcggagagagtatagaattgtttcaaagtacttcttttcaccccagcccactttattgatgagggtaaaaccagagagataatacaacttcctaaatttgcacagtaaatagaacacaacccacaaaaaagactttgacaactgaactgtaataattcttattatatggtcctaccacaaatggctaatcttatcttccagtgcctaggaagaactaggaactgaatttcacatccagattacagcaaagcccctggttgccctattagattgaaactaattaccacttttaaaggttaaagattatttaagactgccaatttcatatggttcaacctaaatatgtacttttataaatcccctcctgactgccacaggggaaagcccagtgcaatggcccagccaggaaggtctgcctgaccccagggagaaaggcatttctggaatgtcaggaccagaaatgtacaggcagctgctagtcaagaacaatggtttaggccaggcgcggtggctcacgcctgtaatcccagcactttgggaggccaaggcaggtggatcacgaggtcaggagttcaaatcagcctggccaacacagtgaaaccctgtctgtactaaaaatacaaaaattagccgggtgtggtggtgagcacctgtaatcacagctactcgggaggctgaggcagagaattgcttgaacccgggaggcagagtttgcagtgagccaagattgcgccactgcactccagcataggtgatggagcaagactccgcctccaaaaaaaaaaccacgatggtttagtgaccagggaactaccacccagggaaccaccacaaatcttttttattattgttatttttttagggacaaggtctctcgctatgttgcccaggttggtctcaaactcctgagctcaagtgatcggcctgcctcggcctcccaaagtgctgggattataggtgtgagccaccgtggctggccaacaaatcttgaggttaaagaataatggggaaagcttcagcaagtttattatagataaatgaaccacaatacacatgcacaagacaacccagttattccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttcagaatgtctcactaaagccatttccatagacctctgtgtgttctaaactccttttattgttcaagtatggaatttctctaatataaacctttttaggaatttatcttcatttctcagaaatgcaccatagaccccttgtcgctccttagaagccagcctgggaggctgtgactcgggctttgctggtttgcttaatggtggagggtgttgtccccctccaggtatcacctggtacttaactcttttaaagatgcccctgggggcagatgcccaagccagcactccttaaggagaaggccaggtaataacgatctgtcacagggagattctggtgtggctgcttgggagagaaagttctccgcagaaaacaagcaattttctttactaggtgttacattttgacctagttcccagagaagtatgctatgtgaaaagaggtttgcctctagtactaaccctgtgctgttcccagacggaagctataattatgtacacatatttgaacgccctaactaattgactctttcttaaataactgctgtgtgatgcagtggcactgtcctgtggatactacttaatgaggctgtttactcttaagtagctatgagtttacatgaggcatgtcccttacacgtgagcctgacacacacttggctagaaggacagaaactcctcttggccgatgctgagcagaggcatagggtgtgggacaggggagaaggggaacactggattccaatcccctctctgcctcttcctgatggcctctccctgagcaagtcatgtctttgctttcggccttctcatttgtagattggcaacagtattgtctgtgttatcaacgccaaaagaataatgtacatgaaattacgtaagtgatgacttgggacataatcaccgtcatcttcatcatcattactggagggctacattaggaacagccttactaaccctaaccctaaccctaaccctaaccctaagagttaaatagggggcactgggcagtgattcccagtccaaacatcatactattggtcagctggcctgggttccagtcccagcactgatctcactggtggagtgacccccagaaattaaagtaacctctttatgccttgattcctccccctccattgaggataacagtagcatcatgtcacaggggttctgtgaggatttaaagctaatacacaagtctagaacagaatctgacacataaatgccatataattatttgctattatttttctatatgttattctgaattcaactgacacttgcttttattataaggcatggattattttcagcaagttttaaattctgagacaagagctttgccattcaaaatcgttcctaaaaatttcttttctgtactcatctgtcatgtgcttgggatttgagaagaaaaaaacattttttttttttgttaggaaagtaaatcatttgccaaaataaagcaagccaataaccactcttcctggtttctcccttgtgaattcagacttcacaaagtgggaatttgaaaaaactggcagcttatttcgttaagcctttgttgggcaaaaagagccccagacaaagggcagtggcaatgaaaccagaggaccccagggaagccttccacagagacagatcctgtgccttgaactttctggggcctcctgttctggtctacttcccctccaccctgggccactctgtcctgagagatctggagagttgaccctctggggttctcccgcccagggcttaaccccctctcccacaatgagacactctggtgccaaccaagtcagctctggagttgaagagtaaactcctcctagaaaagtcagccctgcaggttggaaaaaaatcacctggacagtgttcctatcaccatcagtaataagatggaactcctctgggactccttccacatcacctgcaggtttctgttcatcccactgccaagttccctggttgctttctttgatttgcaataggatcatcaaaaagcccctaatggagaattcagctccccggagagttccatcttccacagaaggcacctgcggaggggcctgggtggccctcagccgagccagtgcacagcatccagcacatcattcattccccaggccacatgaatggtgcccctggagctgcgcgatgaggcgcttcggcctttgggaggacagcagccggctgggaggatccgttcctatttttaaaaacttctagaaaggagatgtggactgtcagctctaatgctacttcctctccctaaagaggctcggatgaccctccctagctctgtgcctcctacaacccactcctccaaatcagccacacgaaagctagacccaggaaagagggaaatagaggggtgggagagggatgataggaaacaagaaaaaagcattacacaaacgcaaggggtagcaaataggaggtgcaggagggaggaaggaaggcagatccagtgggaaagggcagagttgtagccaggggtaccagctggcctgtcttccccaggccagcagccctcagttccactgggaactctaatgaaaggttatgggaggagtacaaataaaacacatctccaagtgaggcagaacctcagtgaccccacaactttacatctataaaatagtgaccacgtaggctgggtgtggtggctcacatctgtaatcccagcactctgggaaggcgaggcgggtggatcacctgaggtcaggagtttgagaccagcttggccaacatggtgaaaccctgtctgtactaaaaatacgaaaattagctgggtgtggtggtgggtgcctgtaatcccagctacttgggaggctgaggcaggagaattgcttgaacctgggaggcggaggttgcagtgagcggagatcatgccactgcactccagcctgggagacagaatgagactctatcttcccccccgcaaaaaaaaaaaaaaaaaaaaaaacgaccacgtaagaaaatcagcttttcatgtttttcactctgtttccctggccctgctctgatgaataaggaaacagctcaaagctgggagtgagaagcaaaagggacagccagggaggtgaggggtcctgttctggagtcagtgggtaaaatccgagtgtccggtgaaggttaggggtcctctgggctaagctctctgactgcagaagcccagcgcaccatgcctgagaggtgtctgtctaaccagtgcttaacattgccagtgacgaggagctcactgcctcatgaggcagcctaatccatttctgtgcagctcaaattattagaaatttgttccttatactgtaagcatttttattttttaacttttaaaattttttgcagagacagggtcttacttcgttgtccaagctggtctcaaactcctggcttcgaacaatccttttgcctcagcctcccaaagtgctggattacaagcacgagccacacacctggccctgtgcagccttataatgtccagttctgggccttagctctgccctctcaagttacccagaataggcataaatgattatttcctatgatagtctttcaaatatcttaatatgataaacatattttgtatgacttctagagcagagattctttgttcttctgtttttgaacctttatatgtaactggcagtaattcaaagaaaaggtttaaacagcctgaccgaagatggcagcttgctggtccttaccgattcaggaaagcgtttccaaagcgactgagctttctaaacggctttttggggtccacgactaaagcattccctggggtgctgccctcagtctctccatacatcacggcgatgaaggagtctgtggtgggctccggaccaatcctcatgcctgggaaatcctgctccagtaggtatctgggagagggaagaagaagagaaagcttagcatcttatcacaaagtaagaggccagaaagctgcctgggattaccaatttttttacataatcatttaaaaacgtagaaacataacccccaagaaaagcacgcaatcctcctctgcatttctgttgatgcaacagacgctaccccaagggaagtgtaccgtgctggctcctgggcatcctggaagctctgctcaggctcagctcccttaggggagcctccctgacctgcatgtggggacacctcttttgtggtccctgggcaccctgtgcctgctgccagcgtggtgctcagcatgtgtactacaattacttgtttatgggccctgcaaggtgtctgagctgatgagggcagactcatgtcccaaccatgccaggaggatgatcttcgtcttataagccttgaaggggctcaagggaaaaaacctgcacagccttctgcagctccccattcctgcaactaacaatctatttggtcctaaactacttctttgtttctaaaaagttttgactgattctaatgtaagcccacaatctgtgactatttccagggaaagagagaaagtgctgaattctatcaaatgccaaatacaatttttccatctttaaaagaatgagaaattaagccaccatttagacctatgttttctatgtaaataaaactgaaaaaaaatttttttttttgagactgggtcttgctctgttgcccaggctggctggagtgcagtggtgcaatctcggctcactgctgcctcgacctcctgggctccaacaatcctcctgcctcagcctcccaagtagctgggactacagacacatgccaccatgcctagctaattttttgtagaaacagggtttcaccatgttgcccaggctggtcttgaatgcctgggctcaagctatcccctcaccttggcctcccaaagtactgggattacaggcatgagccaccgcaactggcctaaaactgaaattgtttagcaaccttaacgggctatattctaaacctttaattgatgtcattgctagttttcacttcatccaaagtttctacgtttctgtgaagttgtggcaccccagaatagatacaccattaaaatatgtctcctaaatttacagtaaatctgatgatatcttttatctctaaatttagagaaaaaaatctgctaatagcacacggcatttactgagtgcttgctatattcctgatatggcgctgagccttctatattgtttcacctcatgctctgaggtggatgatgacattaccctcgttttatttacaggtgggaaaactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtcctctggctaccctgacaacaagggccagctctccctactctccctggagtaaagctgggctcaggaggtgctaccgtttcaaaatgtgttcagctttaatttttaaaatatcttcaagagtttctccatcaaaacctctgtatccctaatagcctagaaatgttcgtgttgatcaattcttacacattccacacaaatctgagaaatgctggtaaaagttactgtgagggatgcccactctgtgaaactccagcctctatggagtggatgcagagcgtgtggactccatatacccatgggaatgtggaatttaggttttacagcccctctgggatctcaagggtgaagacattcagcagcgaggctggaattcaaagccagatcacactcttgcctccactcacgtccagtttgatttttacgccctgtggcctggatggggctatgtctggaggctggtatgactgagggaggagagactgctggggagggaggggcttgggagaacagcagccagtgtcgcccagctccccgcagcacacacagttcgcaattcacgaaaatgtgaggtgcgggagtgggtttgaagcttgacaggcactttgctccagaatcagtgctaatagcaacggtgggctggccaagacggcctacaaaaggtcacacacactgattaaagggatgaaccagacgagaactgcagcgtgtgctttttggggaagagctcggtgtggagctccaccttgggtggctcgcggcaacacggccccttctcggcaccttcaccaagcctggccaggaggaggcccttcagattccgggccagggaggtgagcatacggatatcgtagttaagcagtgagtcccccagctggacaatcactcacacagcacaggtgttgaagtcagacatcactgtcgaggagtgcctgaattactttctgatgtttcattcctgtacaagtacagcaaatcccactacttttgaaataacaggggtttcaaggaaaaatataaatgaaaaaattgtttaaagaagagcagatgtttcctacattcaagtttatattgcaatcgaagccagagttttctaagtagcgaccctactggacagacctttaacaataaatcatttttaaagtgtgcttcaagtgtgaaataatttgaagtcaaaggtgtccccctttgactgtgaccttggtaaatcaatctctggatctcagacacagaggaagaactagaattaggaagaattactgtattataaagcttgcttgcattatcaatttgtttggtgatactttcacagataatacaaagttaacattcagtgttcaatttcaccatcaaagaaataccagtaaagacagagcacattaacaaatttttgaaaactcggaatcatcaatgctggcaagggtcctgtgagataaacacccttatatatgttggtgggggaataagttggtctaacttcactaaaaagcaatttgacaccatgtgttagaagcctttaaaatgggggtcttgctgggagcggtggctcgtgcctgtaattccagcattttgggaggccgcagtgggaggatcgcttggcctaggagttcgagactagcctgggcaacatggagaaaccccgtctctacaaaacatacaaaaattagccaggtgtggtggcgtgcatctgtagtcccagctacttaagaggctggggtgggatggtcgcttgagcccagggaggttgaagctgcagtgagctgtgaccatgtcactgcactccagcctaggtgacagagtgagaccctgtctctaaataaataaagaaaaaataaactcaaatggggattttgcggagttgacctctaacagctcgtgctggtgttatttgagggcctgtttcctctcctctcttgggctgtcatttcctgcagggcatggtctatatactcagtactttagaaacctggagtctggtaggaatgatttgagtcagcctcttatctttacaagcgacaagactgagggttagtgcaggaacatggcttgttgctggtcaaactcacagggtggccatgcaggatccagaacctgcagcccctttctcctggccccagacttctgctcttacaccaggcacagcaccatcaccctggggtcctacactgcccccagctccctggtgctctaagcaggacctggcagatccctgactttacatatgacactctaagctgattgccctgaagaagatttttcactgggggactgcagaaactcagattcatctgttacactgctgggtaaacaggtacatgtcagtgcagtgagggaactcggaacaaccaagacaccaagtatctgacatggaaaaagggagaatgaagtgatggatccacacacagcaagctggaagggaagagtctgagctgatgctgaggtgcaatgtgcataaatgggtcaatcacacagccacacgggatagacagcctgatcaactgtgttagacatttctcacggtgggagtgcctcagaggctttcccaaagctacgagtttcagggactctagtattatctgcaataacaacaattcaaaggaacaagaggacacaggaagaccaccgtgattcagagctgattagcccctccacaggcatcctgtgctttggagacttgatttttgtccttggctccactttgctccccctttcctgtgttctcggagaggcctgccaattccagcaatgattgctccaaggttctcgagccaagccagccacataaaaaggtatggacatttggattccaagcagctgggcggaagggatggtgggatggatgggagacctgacatccccttgtcctggtccgatgaggtccccagttcagactcatccaagtggctctggggtaccccggttgccagcattcagcccaagctcacagagctactttgatgcaagagtatatatggatggtgtcttctttttttcattgcttaggctagaattttttttttcacttcatagaagtgaatgtcatttatgacaaggggaagaaaaaaaactctcaagatattgaaaacagagatactctcaatatgtccaagcaccatcttctcaacgatgagcttaagaatgaataaaaaccaaacaaatctaagtggcacattattcaaacaaatgctggagtagtgggcaaagcattacactttaaataaatatacctaacgcttgaggactcgttatgtgctaaagtctttacatgaatagtctcatttcatcctaactaccttatgggcaggtactatttctatccctattttacagatgaggaaactaaggctcaaatgggttaagcggtttattaagatgaaggatttcttactagtcttatgaggacaccacccaccctaaatcagagcctgagaggccgacgggttccactgggaatgtttacaggaacgtgtcctgtgaatcataacaaatacacaaatgtaagattttaaaaataatacggcacatatattttgagtgttgtatgagcattatttttaaattatcaagccaaatctaaagaaatggtttgtgtgggctgggcgtggtggctcacgcctgtaatcccagcactttgggaggccgaggtgggcggatcacgaggtcaggagatcgagaccatcctggctaacacggtgaaaccccgtctctactaaaaatacaaaaataaaattagccaggcatggtggcgggcgcctgtagtcccagctactcgggaggctgaggcaggagaatggcgtgaacccgggaggctgagcttgcagtgagccgagatcgtgccactgcactccagcctgggtgacagagcaagactttgtctcaaaaaaaaaaaaaaaaaaaaaaaaaaaagaaatggtttgtgtgatgataaacgagatcttaaaatatgttcgtgcataccttggcatctgtgcatggagtttgggggttcaattcattgctattgcctgaaacatttttaaaataagttttggaaagtttcatgtaatatatttttcttcagaatacttacttgatccactatttcactaggagagggatgaaaaggaagagttactacttctactctgatttgatttgagcctggaaagatgttttaagagcagtttctggccgggcacggtggctcacacctgtaatcccagcactttgagaggctgaggtggatggatcatgtgaggtcaggagttcaaggccaccctgtggcaaacacggtgaaaccccgtctctactaaaagcacaaaaattagccgggcgtggtggtgcgcacctgtaatcccagctactcgggaggatgaggcaggagaattgcttgaacctgggaggcggaggttgcagtgagccaaaattgcaccactgcattccagactgggtgagactccacctcaaaaaaaaaaaaaaaaaagcagtttctattgtttaatctatccttgtgtttcacaccaggaaaagtaagtgggagaatcaagcatttattacttccaaagtcttacaagataggccaagatatataaatatttcctagcaaaacagtatgacctgcactatcactgcttctagatactaacaaatgacaggttactctgaagccgtactgtacagtttataatgcatttcacacattcagcttatttcatcctcactgccatgggagcaggtatttttattcctagtttatagaggagaaaactgcttatgccaagttaaatagcttacaggagaccacattaatactgggtaatgactacttttaacattttgatgtatttccatcccatcatttttcagtaaatgtaattttcctttataaaattgagataaaagttaaacaattttgcatcttgatttttcaccattagtctttcctcataccattaaaaattctttgaaaacatgatttttaatggctgcatactattctaagttgaatatgtatcaatttattttgtcatttcctgttaggcatttaaatagctttctattttttgctgttataaataatgctgagataaacatccctgaacaaacatctcatctacttaaaaaagtctcctttgaattactgaaaaactaagttaggctgatcttcacttacatttttttttttttttttttttgagatggagtcttgctttgtcacccaggctggagtgcagtggcatgatctcagctcactgcaacctctgcctcctgggttcaagtgattctcctgcctcagcctcccaagtagctgggattacaggcgtccgccacacactgggctaatttttgtatttttagtagagacggggttttaccatgttgtccaggctggtctcaaactcctgacctcaggtgatctgcccgcctcagccttccaaaatgctgggattagaggtgtgagccaccgcgccagcctcacttacattttaaatgtgaaaactaagttttattttcatttttcctttagttaaatcattgacatgttatcaccaggactgtttgttcagatgatgtcacctttgaaactgctgtgcctactaagggaatggacattaggtcattgaaccaataaactggaatttgctgggtaaaacttttcgtatctcaggctatttttccagctatggatgggatttatactcctcagggctgagatgtgcttgaaagcacactgctgtctacccactgccattacctgtaagttgctccactccaccttccatgctgttttgggaggagggtgaaagaaagggaggggaatttcactagaatcaaatcagtttcttacagttctatttgttcttccagtctttcagtcatgcaatgactatttattgagtgtttttgatgttgtaacttgtaatttaggagtatgacaacagactttaggttgtaaactctttgatctgggagtactgtaaatcgtcatgaggaggttatggaacacagcatatcccaaagttacttgactatggaacccttttattttctttgaacacttacgaatgatctcccacaactgcattccacagaacataggttaaaggaaaaggctaaaaggcatctaacaaactccatatccattttgtttttttctccaaatagaatcatttaaatgaaatccttttaaaactagtaatagataatttcttaatgcaattaatttatagataagaagccaccagctgacataatctcttaaggtgaaataacataggcaataccattaagattagaagcttgatatgaatgcctacttcctggtattatgaaatatggaacagaaggggagacaaagtaatcatgaaggtaactgatacagttatctatctagaaaacctaagagaatctactgacaagctgtcagaataacttcttgagtcaaatgaccagatataaaacaaaaatgtacaactcagtagcttccttacatatcagcaataccctgccaaaaaaaataagagaaataaaaagcccattcataagagcaacagggcataaaatacctaatacattaataagagctccataggacctgtatgagtaaatcaatcacttttccaagaaggtctgcgttaaagcaatggtgagctgctgcttgggaagagcaaatacaaaaatgtaacttagagacagaatgcagttccaggacaaatggatcccagtgggatttttttttgtttgttttgaagaacctaactaagaaagttcttctcaaagaatgacagaaaatgagaattgatagcatttgaaaaataaagagtaatgcacgcagaagagtcttgagctaaaattattaaaaagtatttcaaagtgacaatatttaagatggtatggtgttggcataagaatttacaaacagaataacacgagacaaaggtcctaacagactcaatatagtatttaataacttagcgtatgaggaagcctcatgtgacagcagaaaaaggtagatttaataatagtgttagaaaatgacaaaagacaaaaaaaaaaaaacccacaacaatataattgagacagattttacttccaggtgggttaaaaagttaaatatttaaaaagtaatcctattttaaaaagagcgcccggccagccgccccgtccgggagggaggcggggggcagcccccacccggccgccgccccgtctgggaggtggggggcgcctctgcccagccaccctgtctgggaagtgaggagcccctctgcccggccgccaccctgtctgggaggtgtacccaacagctcattgagaacgggccatgatgaggatggcggttttgtcgaatagaaaagggggaaatgtggggaaaagaaagagagatcagattgttactgtgtctgtgtagaaagaagtagacataggagactgcattttgttctgtactaagaaaaattcttctgccttgggatgctgttaatctatgactttacccccaaccccgtgctctctgaaacatgtgctgtgtccactcagggttaaatggattaagggcagtgcaagatgtgctttgttaaacagatgcctgaaggcagcatactccttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccccctcggagaaacacccaagaatgatcaataaatactaaaaaaaaaaaaaaaaaagaggcagggcacggtggctcacgcctgtaatcccagccctttgggaggccgagacaggcagatcacttgaggtcaggtgttcgagaccagcctggttaacatggcaaaaccttgtctctactaaaaaatacaaaaattagccaggcatggtggcccatgcctgtaatcccagctacttgggaggttgaggcacaagaaccgcttgaactggaaggtggaggttgcagtgagccgagaacgtgctactgcactccagtgtgggtggacagagtgagagtctgtttcaaaaaaaaaaaaaaaaagaatatgagtgaacatttcctgagtcttaagataaacaaggattttctaaccaaaaaataaaagatattataaaaaaggaaaaattgttagatttgatcacaaatattaaatatatctgcatggaaaaactattacaaaaattacaaggcaaatttcaaactggaaaaacacttttacaactgtgacaaaggattgatatctgttactgagaaaaacatttacatttatttataagaacaagaccagggccaggctcggtggctcatgcctataatcccagcattttgggaggccgaggcaggtggatcatgaagtcaggagatcgagaccatcctggctaatacagtgaaaccccgtctcttctaaaaatgcaaaaaattagccgggagtggtggtgggcgcctgtagtcccagctactccagaggctgaggcaggagaatggcgtgaacctgggaggcagagcttgcagtgagctgagatcgcgccactgcactccagcctgggtgacagagtgagactccatctcaaaaaaaaaaaaaaaaaaaaaaaaaggacaagaccaacacttcaaatgaaaattggacaaagttcacagacaattcagacaattcacaaagtaatatggaagacaactatattttataagttcaacgtcactagtaagaaataaacaaattaaaataagtctgttctggctgagtgccccatggctcacgcctataatcccagcactttggactttgggaggccaaggcgtgaggatcgcttgagctcaggagtttgagaccagcctagacagcacagcgagatcccaactctacaaaaaatgaataaattggctgggtgtggtggtgcaatgtacctgtagtcccagctactccagaggctgaggtgggaggattgcttgagcccaggagtttgaggctgcagtgagctatgatggcatcactgtactccagcctgggcaacagagcaagaccctatctaaaacacttttttttcctatcaaattaattttaattagttttactggcagtttggtgaattactgatcctcatatttctggtgggagtctaatttggaataactgtcctaaaaaagaaagatagatacatagatttaggaatatatataagcctgaaaaaaaaaaaaaatatatatatatattttgagacaaggcctcactcagttgcccagactggagttcagtggtgcaatctcagcttactgcagcctcgaccacctgggctcaagtgatcctcccacctcagcctcccaggtaactgggactacaggcatgcaccaccatgtccggctaatttttgtatttttttttagagatggggctcaccatgttgcccaggctgatcttgaactcctggagtcaagtgatttgtccaccttggcctcccaaagtgctgggattacaggtgtgagctgctgcgcccagcctattatctatattttttgaggcactaatttatgcttaggctattctaagaaaaaaactagaaatacaaagatttatggccaaaaatgttcagttcattgcaacattatgtataacagcataaaaacagaaacaacctaaatgtccaacctgtactatagattatgatgtagtcattgaagttatttttgaagactatataatgacataagaaaatgctcatcgtatcatattaagcaaaaaagaaccccatttattaaattatatttacacaatcctcagttttgtaagcatgaattctatgtcttcatctaagtcactgagagaaatgtgaacagatggggtttggaacggatggaaggttcagcaaagtcagcctcccttttctgggttgaggctagccctcttccattcctccattaactgaaccttcatctggcaatggttcccaaatgtttcctaggggagggcacataagaattactgtgagagatggtttagaaaaacaaaaacagattttggagcctgacccacagagatttcgactcaggaggtctgaggtggggccctggaatccgtgtcaaaaggcctccaagtgattctgatgcacagccacgtgcagaaggaaccacggccttctggttcgaggttttgaaaaggacattgaacaccttttgtaagtcagcttctgaatgtgagttagggaagataatgtcaggatggaaaaagccttccccctcctacatttctccaaatactctgttgctgcttgtcaggtggatgatgtgacaactggcccagctgctggcctgcagcgcttccctgctcggactgcagctgccagcgctcccctgcccaccccccgccccacctactcacctcctgcctacccccaccaccccacccagccccgcctaccctgcagctccttgccctgctcttcaggacttttgctccaagtcttgcctcctctttgtcttctgagatgccagctgctccctctccatggcttcccttctgtccacttttcattctgctgaggttgtgcttgtctttacccaaacccctgtgatgcttgtggccaggcctccttcccccaggcctagctgctgagaatttgacgcctcacatcccactcattcctcaacccgcgccatctggcttccttcaccaccactcacaggcacacctcttggcaaggtcacctggctcccaaaggctaatctactggttctgtttcagtccttttcctggaagcatctgacactactgaccaccacctctctccctggcttttgtgggggtcatcgttgctttacttgcctcgtatccccttttcttggtagcagcatcctcaggagctgccttccccagctctcaggccacgtggttggtggggctgacctccccactccccacatttcatgcccctgcccctaaggattggttcagggatgggcatatggtcagggtcaaaccaatgagactcaagcctgagacttttactggggctgctgagccagcagaattcgaggctggaaatggaggtggccgcctgcccacccctgagaaggaacacaacatgaggagggccacagagccaacagagtcctggtgtgtctcctgcagtcctgggccaagcctgaagcttgcacatcctggtctgatgggtttcaggaaaacgttcttatctttttatctaagctagctttggttggatttctgtcacttgcaacctaaagagatctgagacagcactgagccactaccctcccaggcaattacccacctctttggtactttccccggagggtctccacaagctctgcttcctctcacttaagagtcctgtgcaaggacttctacttcccagatgctggctactaaatgctgacactcccaagtcaacagaccagcccagatatctccctgagctccagacccatgtcttacccctcatggacatcgccaccttggtgtccactcaaacatgacaggtctaaatctaaacttatcattatgccccatccttcctcttcttggatccccatctcagtgaacagctgtactccccagttaccccagaaaccgaggcctcatgggtgacacctccccaccctcactccctggccctctttgggcagctaattctctgctcattcctcagggctcagcttttaggctgcattctcagggaggcagccttttccaacccgcaagcctgaatgagggggtccctcctatgcccccagccaccctgtgtttctagtgttacagcccttgtcactcagagctgtggcctgttgactctcttctgtgatggctggccccaaccctgaaatcaagatcatttgaataaatgaacactagcatctgtaggtgtgatcttatattgtatattgaaaatatagtctaattttctgtaaaaattaaatatctcaatattttagagagatctgtaaagggtataatatttggaacagaagattgattttcaggagccccagtatctggatgagtgtgagaaccactaaataggacccatagtttttctgtgtgagattttatttttttaaaaatagatgaaccaggctgcctattagtgaatgccttcacttcccttttccttaattactgagtctagaaacttatcaagggaatgaagcaggcctttgttcctattcagaatccatttccctgcttttttgaaaatgagaacatctgcctgcttccagtgttccaatacttttcatattcttcacaatttcttaaaagccaccaaatacagttctttgagcagaaatgcaagttctttcatccatgtgtccggccagagatttcctgaacctcgcctgtggcaggccctgggagagctcctcagcctgtggttttaatcccctcttgaacacagctgggctcccttctgccatctctggggcattttctttgaggaaaaggaggaagctgagtagttctgctttctgttaatattgcagcaagagcccatgagtgggccgatcacttcctgattcttgttcttgttctaatcataccttaaaaggcttttttaatgtccaaggcacttttaccttctcagcccactccagcttcttgatccttcataccgcccataaaccttgtctgcacccttgcacatgcacccctgccccttttttcccctattaaatactatagttaaatgttaatatctaaagtttttaaacacaattacggtatcaagcattttattaaaaatttttatcatactttgattttaccaacttgagtgttatgaacaatgaacatgtttatacattgacaagaatactcatacagggattgtgggatggctactttcactcccttttccctcatctttactcctttttttttttttttttgtagagatggggtctcactatgttgcccagggtggtcttgaactcctgagctcaaacgatccacctacctcagtctcccaaagtgttaggattacaggtgtgagccactgcacctggcccctcatctttactctttagttcctttgcccttgggttcttctagcttatttctactttgttttctttctggcatccatttctattttaaattattacacatagatgcagaaattacttggctggcgctagttgcagaatcatgaaaattaaatcacatgatgcttagtgttgaaagactgaattgttttggttttttattgagatataattcatataccagaaaatttattcttttacagggtgcactcctttagtatattcacaaagttgtgcaaccaatatcattatccaatttcagaacattttcatcacatcaaagagaaactccacgcccactaacagtcattctctatttcgtttgcatgcggctatccagttgtcctagcaccatttgttgaactatagtttcccccattgttctaatagtttttaagtggtttcttaggattctctacatagaagatcatgtcatctgcaaagagttttacttttttctctccagtctgggagtttatttcttttcttgccttatttccctgctctctacccttttaaagcctatatagtttcttgagtgacttccctcttttttcctcattagaataagttttctggggagagggaacagagcatatgaagggagaaagtggagctcttaaaaatgtgtagtttgggatggggcgcggtggctcacgcctgtaatcccagcactttgggaggccaaggcgggcaaatcacctgaggtcgggagtttgagaccagcctgaccaacatggaaaaaccccatctctactaaaaatacaaaattagccaggcgtggtggcacatgcctgtaatcccagctactcgggaggctgagacagaagaattgcttgaacccgggagggggaggttgcggtgagccgagatcatgccatggcactccagcctgggcaacaacagcgaaactgtctcaaaaaaaaaaaattgtgtagtttgcattcatttcaaatggacttcatactttttcagtggaaatgtcttccttcacagcacctggggccagggattttctggaggaatctttgaaatctgttttcctcaagttttggacacaagcctgggtgagctccatatccatccttcctcggctagtacagagtctaagatgacatggtcactttcccccatgcccatctcccctccttctctggccaattctttattgccagtcaaaggcagaagagccaacagcaataagagaagattcccaccatgtcagcacaggttctgtgtcatcagtgacctcttggaatgtgcaggaagccagggagataagaatctatggctatgtagattaggtacaccccacagccaagtatgagcttctagggcccaatcgctagaagcaaacaacccagaccactaaccaggctctaactaaggcaggatccaggatgctcagcaccctgggccaacccttccgctcaagatgaatccatggttcatttacagtgtctggggtgatatttaattccaagttcacaagtctccagggtagctgcccttttgtttggggatttcctcccgggtgctaaatcacttcctcctagctccaatctgaaaagcaattcaggtctcctgtggcctcaccaagcttcctgcccacactgattttcttctaacctcactggtctaccttgtgtacatcacctaacaacaaagccacttagctcaaggaaagcctcaagaacaaatggcttcctaataaggtgattcctccctcaccctagggtggcccacagctccagcacctgctgagaggtggccaatttggatgaggtagctgccaggaatcaaatctcagaacccttcataaaactgcgcttagctattccacaaatttctccaaataatgaaacagagagaagagtgagaatataatgagagagaaatctggaaaaatacaaaagataaattcatgttcctgtgagttgtattcatcttcctgggagttgataatcaggctggctagctatccagtctatgggagcagagagagggctgcattatctccaggttggcacagcatctagcaggggctccctgatgacacctgggcacaacaaggacctcacagcaaagacaaacaggaggaaatgcctagggtgtggggacatgccaccactaaattacaaaaatatatgcctttcttctttgtatgtttcaacagtaccgcttcccactcttgtaccacttggccataacactttattatccctagtacctaaaaactagacagtattactgagaccttaaatgtgacatttgtcatctttcaaggtgccagttactgtaatacagctatggttcattttgagtgtctgggtgacggtgacatatttaattctatttttgtcttgtccataagcaccaaataaagcaattttgaaattactttcttcacactcaatttattatctagaacgacatttcaatacacagtatatttgttttgtggaattcattcgcagtgtatctggaggcctggatttaacatatttcctgtagtgatagctactctatttgtaggaactatttaggtcactggagtggagaaaaagaggtcgctacttaacagaaatggcatgtatccaaatatagatgcagttttctcaacacctgttgcacatcaaatgatgaagagattgttacaatttccaaaaccctggaccaaaaccttaaatgatcagcactttgtttcaactgatacacggcttaagtcagaaaaataagttcttcttaccaaaaacagtgagcctaaatatgctggctgctttagaaataaaacaggtgatcaacaaagcaatctgtttctgtctaaataatttcccagcaaaagtcacttcttttgaaactatatgatttgaaccacagggtatgcacagtgattgtgtgctttcagaaacacggtaagcatgacaaatattttcagttgtcaagggtaagcgaggagggaatgacccacctaagaaatggaaactaacaaatagtaatatgacactcccccttagttccacaggctggtgcggctgctacacgcagctcacttcctacgggcggctaaaggcggtgcatgaactgaacgtaggcggcctctttatcccctccccacaacactgtggggtggcacgtaaagacctcaagggaagggggcctgggcgatacgctctcctgctgccattcatttgttcaagaaatagttgaacaaatgaatagttaaacaaactctccaactaggactctgtcccattcggataccctacgcctctccccccatttccatccctaggcatcactccctcgtcaagaatatgctgattatggctcgcgccccctctctcccttggaccctcccgccagggcgaccggacgaggccagcgggagcaacgccttccgaaccgcaaggaaggagggctcggagtgcgcagggcgcgggttcgcgggaccctccagcgcgcggggctggccagccggggcggggccgagggcaccgggcgccgagctccgggaggggtccccgaggtcgcgccggccgggaggggcagcggcgggaggcggccgactgcggcgcacacgtggggagggcggagcggggcgggagccgggcgaggggcggtgacggtacctgatgaaggtggtcttgccggtgctgtactggcccaccagcaggatcatgggcttgttctcgaagtcggcgtcctccagcgcaggcgagtggaactcgtggaagcggtacgcctcctccagcggcagcaccttgcgcaggtagagcgagcgcagcccgcccgtcaccgtctgcaccgcgtccgcgccgccagcgcgttcgcgcccgcccgcctgccgccccatccagctgaacatcctgccgccagtccacgctcggatgggaccctgctccgggttcgactctccccggctcgcactgagccgccccggccgcgctggccgccgcccgaggagggccccgccttgtgctgccacagccagtcttcggccgctacgtcacgcgcgctcgcccactattcagacgagctctctcaggtccttcctgattggatctctgccagagagggctgaaggcgtcagccaattgagaggaggttcttaatgaattattgatgacggagtcattctagaggactgggcggggagatggtgtcttcccggccgggtggcactgaccggtcatgctcagggcccccttctggttgccggtgcctcacctctggccaggtggcatcggcttccgggtaaatctgagctgcccaaagcgagcctccggaggctgctccatctcctggaacgtttactcattcaggcctctggacgtcgatactggggatgaaaagttcagaaagtggacaggcaggttctgtcttcccgggggcgggtggttatgactccgttttacaggccaagagacccaggctcacgggcataattgacacaatcttgaggggaagtggactggaatctatttgagtagccgtttctcctacttctccacattgccctcactaaattctggatcagctaaaggctttttccccttagttttctttatgtgtttttctgtaaagccgaaaatttagtcattactctcattattacattatcctcattattacaactttatttccacatattgacatgtgagtcattgtcacctcctagctgttttttgttgttgttgttgttttctgagacggagtctcgctctgtcgcccaggctggagtgcagtggcacgatctcggctcactgcaacctccgcttcccgggttcaagcaattttcctgtctcagcctcctgagtagctgggactacaggcgctcaccaccatgcccagctaatttttgtatttttagtagagatggggtttcaccatattggtaaggctggtcttgaactcctgacctcagatgatccgcctgccttggcctcccaaagtattgggattataggcgtgagccaccgcccctggcctgtttcttttctaggttaaaaggatactcacttatctaagttgagattgggggaaataatcaccttttgtgtccttgattgtagcttaggaatatttcttagttgttttagagcatttctcaagtgtgatccatggggccacctgcatatatgcatttatgagctgggatgcttgttaaaatgcagattcctggtcttcagtccagacctactgagttaaaatattgaggagagatggagctcaacagatgccctaggtgactctgatgtggcctaagtctggggaaacagtacaccctgcagtacttctccaacctaacagaaatgcggattctgattcggtaggtatgggatggggcccatgactctacatttctaacaggctctcgggtattgccaatgctacccatccctggaccatacttggagtatgagagaacaggactttgcatcaaaagatctgggtttgaaccttgactatgtaaattaatggctgtgtgattttaaatgtgatgagttacctctctgccctagtttccttaagagcaaaatggaaactcctttggagttgttgtgtgggtcacatagttggagggaattgtatgtaactagggaagtgaaaagaaagccaagggaaaataaagttagacatctgccttgtgtcaaaataaaacaaagattgaaatgtaaaaagaaaatgaaaccactgcactactagaagaaggtacaagagatttatacaatttggcggtggaaaagcctttctaaccaacattaaggacagaaattatgaaagcaaaggctgacatatttgacaacaaaagtaaaagcttcgatgtatttttttagaatacataaaaacaaacggatataaatacaatcttaccatatgatgcagaaatcagctccttagtatttacccaaatgaattgaaaacttatatccacagaaaagcctgtacatggatgttcatagtggctttattcataagtgccaaaaattggaagcaactaacatgtccttcagtaagtgaaaggataatctgtggtacatccagacaatggaatcttattcagcactaaaaagaaatgagctatcaagccataaaaagacacagaggaaacttaaatgcctattactaagtgaaagaagccaatccgaaaatgctatgtactgtacgatttcatctttatgacattctggagaaggcaaaattatggaggaagtaaaaaggtcagtagtttctaggtgttagggagaaggaaggaatgaacaggcagagaacagaggatttttatggcagtggctctactttttatggtactataatgatggatacatgtcattatatatttgtcaaaacccacagaatgtacaacaccaagagtgaatgtaagtgataatgactcgtgaatttcagatcagttttaggttcacagcaaaatggagcataaagtaccgagagttcccatatacccccaccctccccgacacacagcctcccccactatcaacatcctgaaccaatggaacattcgttacaatcaataaacctaacctaaatagatacatcactaaattaacttaaaatggaactagatataaaactaatataaatgtagaactaaatgtaaaacttaagattataaaacttctagtagaaaacacgggagaaaattgttgtgaacttgggttagggaaagatttcttaggtgacaccaaaagcacaatccttaaaggaaaaaaaagttggtaaattggatttcattaaacttgagaacttctgacctttgaaagtactgtgaagagaatgaaaagacaagacaaggcacagaatatacttgcagatcacatatctgataaaggacttgtatccagaatatttaaaaacttcttaaaacttaatagtaaaaaccccaattttaaaatttccatttaaaaaatggaaaaaagatctaaacagatattttacaaaagaagatgtatggatggcaaataagcacatgaagacatgttcaacattgttgtttgttaggagaatgcgaattaaaaccacagcaagatactaccacatacctattagaatgtctaaaattaggaaagactgatcatgccaatcattgatgaggatgtggagcaactggaactcttacacattgttggtcagaatgtaaaatggcacaaccactttggaaaacagtgtggcagtttcttaaaaagtggaacgtacacttaccacatgacccagcaggggaggagcagagggaaggattgcaaaaggcactggaaagcttttggggctgaagggtttattcattaccttgattgtggttatggtttcaccattgtatacatatgtaaaaactcatgaaattatgtacgttggatcctccatatctctgtgttctgtatccatggattcaatcaaccacagatggaaaatatttggggaaaaaaatggatggttgcatctgtactgaacacatacagaccttttttccttttcattattccctaagcaatacagtataacaactattttcatatcatctacattaataataagtaatctaggtaggatttaaagtatatgggttcctgatgcatggcgttttaagtttaaaagaaagtatgtggaggatgtgcttaggctatatgcaaatacaataccttttttttttttttttacaataccattttatataagggagttgagcatccatggttttggtattcccaggggtcctggactcacggataaatgtactttaaatatgcacagttgatcatatgtttattacaccttgattagttgttaaatatggtcatactttttgactcaggaatttttatcttgaggaaatttatcctgagggtatttatactgaggaaatgattaatgtaaatttttatctaagacgatggttgtcagcatggagctgtctatcatcatggaggattagttaagcaaattatgggttcctatgtggttactgaaaactatgtcatttgacaagaatattaatgatgtgcaaaaatgctcagaatatatttttaagtggaaaaaggctagattacaaaagtgaatgtacatgcagctgctagggaaaacaatatggaggttctgcaacaatttaaaaatagaactactggccaggtgcagtggctcacgcctgtaatcccagcactttggaaggccaaggcaggcagatcccttgaggtaagtaaggaattcaagaccagcctggccaacatggcaaagcccatctctactaaaaataacaaaaattagccaggcatcatggcgggcacctgtaatcccagctactcgggagtctgaggtaggagaatcacctcaacccgggaggtagatagaggtcgcagtaagctgagattgtgctactgcactccagcctgggtgacagagcaagactgtctcaaacaaaacaaaacaaaaactaccatatgatttaccaatccccaatttgggtatatatttaaaagaattaaaagcaagctctcaaagaggtatttgtctacccatgttcacagcagcatcattcataatagccaagaggtggaagcaagccagtgtccatcgatggatgaatggataaacgaaatgtaacacacacacacacacgcacacagaggaatattattcagccttaaaatggaagaatattctggtacatgctacaccctggaacacggatgaaccttgaggacattatgctgagtgaaataagacagtcacaaacagccaaatgctgtatgattccactcatatgaggtttctaaagtagtcaaattcacagaagcagaaagtagaatggtggttatcaggggctggcgggaggggaatggggagttgttcaatgggtatagagttttagttttgcaaaatgaaagagttctggagatctgttgcacaacagtgtgaatatgcctgaaactgctgaactttacacttcaaattattaaaacggtaaatggtgtgcgtgttttctaccacacgtcttttaaagtggacgtacaggatttttgtacttttgttttaaacagtttaaagtatctaagaaaaagatgggaaggaaaaacccccaaataataacgatgtctgagttttggactggtaaatgatcttagtttcctctttataagctgtagcatttttcaaatgttacacagtaatcacgttcctgttataaaagcagaaaaaattatcaggaagaaaaaaatgtactgtctttaatcttaaaaaaaaaaaagaaaagaagagaaagtcctaaaagcgcctggcccagaggaggcaccagtcccatcttgcttcgctccctgcttgccttcatgcagttgcagctttcttatttattatttttgtaggcacatagtaggtgtgtatattcatggggtagcagcagcttaatttatttttgtgggcacataataggtgtgcatattcatggggcagtgacagctttttttcttatttattttgtttttgtgggcacatagtaggtgtgcatattcatggggcagtgacagctttattttattgtttttgtgggcatatagtaggtgtgcatattcatggggcagcggcagctttcttatttactttattgtttttgtgggcacatagtaggtgtgcatattcatggggcagcggcagctttcttgtgcttgctctaccctcaatgaagccagacagtggcagatcctccccgccatagtcatgttgcatctgtttgcaaatcattctgctctttggttttctttcttcagactaaacagtcccaattgcagtcactctttcatctgaatccagttgtttttcaggtcaaatcctatcacaggcagttctacaagggaatgccactagttgttcggaaatctattgtattgaatgcacgcttgaaattaggaagctggtaataatggtcagaagatttgctctagaccatgttcagtggttggctttaaatggtgatcaagtccagtgttttaccctgaaaactggattgcagagtggttaaaggcctgggagactcgtgctgagaccagaggcagtgctgtggcctggtgctctcacacgctgatggcctttctctgtggccactcacccaagtcactgccaccacccagaggaggggcttataggacacacaggtggagatggctaggaggtacttgcaggaagtctgctagctgcgtataaattgtccttctttcgcagcagaactctgatttttaggtgggcatattgccacccatgcaaaaaacaaaaacttccagcctccctgcagttaagtgtgatgatgagaccaagttctggttggtgatatgttagctgcaggatgtgtgggacttccaggaagtccctttaagaaggagttcaatcttttttctccttccttctggtggcctggaatatgggtgtgatagctggagctccagggcttaccctggaccatgaagccaaggaccacataagggtggataaagcaaagagccagaagaagcagggtccctgacgaatcgtaggtgtgccttgaactgccttcctgtggatgtcttttacatgagtgtgtttaagccaccatttttcagaaataaacatgcaattcctaaccaataatcaatttgttaccagaaatggagtctgccacaacggaacctaaaatgtgacatgtgctcagcggacaagggggaaggtcaatattaaggattcaaatattgtagctggaatttaaaatatggctgcacagttcttgacatgccctccatccagagatgggttcattgtcccctccccttgaatctggactggcttgtgactacttctgccaatagatttccatggaagtggagctacgtaacttctgaggctaagtcataatgggccatgctgctgccactgtaacagacactcttggaaccctgagtgccatttaagaagactgaccatcctgagtccatcatgctggggtcaccaaggtgctctgattgacactcctagctgggattgcctttcatctttcacagacttcccagcccaggcaccagacacaggagtgaaagagtcgttggacgagggcccttcagcccaggctgttcccagatcccaaccactggagtcctcaccagcagttcagatcatctgacctgtggccccaaacatggagcagttatgcccttttcaaattcctgacccacagaatctgtgagcataataaaatggtggttaatttatgccattatacattgagggcttttgatgctcagcagtagataactggaacagctggtaattcttactatgttaagataaaagtttagttctttttcacagagaagaagtccagacataggcagtccaggacaagtttggtcactttgtagtcagcaagaacgcagattcctttatcttccctgctgcctggaatgtggacatgatgggtggggctccagcagcaatattggaccagatggtaatcttgaggatgacagaagagagcagaaaggagctttggtctctgataatagagaaataactctctctcttgtttaagccactgtaattttagatcttcaggttatacggcaaaagcattgctaataggcacagaattggaattcatgggtttagaaccaggagattggcttggctaaagctaaaaggttaagaattttcaaattagaagcagtagttgaagtcctgggtataaatgaggttgcttaaggagagtacagagtgagaagaggaaagagctaaggagcctcgaggaatggcagcagttaaaagagaggccagaggaggggctcccacctttccaggggaagaaacccgagacagaaggtgttcagtgaacacgacttcttcccctctgtggctgggttgggagcccttcctatgcctcttctggacacagctaacatgcagctttctcttcatatcacaagggctctgttttacatgagggcctcccacatgggaccagaaggaacctccttaaagtttggaatcaattgttaattcttcttgtggccccagtgcctacaacagtgactggcatgtaatgggcaggcagtagttatttgcaagctgaactgaattgaactgcttttggcaaggaagtcctgggaagggaaggtttccagaaggagggagtggtctgcggtgcaaacactgagaacaatcaagtcagataaggcctttacaagactggtgggtttggctcagtgcatctggcaatgaggaggccattggtgaccttgaggagaagtgttttcgtggggaggcagcggggacagggtaactggtgtgtgggagcgggtggggtgctggttgctcttttgggaagaaagggtggagacaaggagggacgggtttcattcattttgtcaatttcatcatcttcatcataggcagagagcagggaactgggaagggagcctcccctgacttctgcaggataccatgtgcttgccctgtcagagttgatgacacttttgtcatttccttagccaactcaccatttaacttctcatgtatgcataacaatcttttcatggttttctcccgaaccaaaatgtaagttcctggaaagcagagactgtttacagcttgctgtgcacaaagtaggtgtttcgttggtgttaactgcctctgtttcctctcaagcaatgtttcctgaaatatacctgagcttggaacagcatggatctgtacgagctggtgccccactagttgatgacatggcttcatgaaaacagaggagcacctcaccactagaagagacccttgcagtaggaaacaaagctgcatgagaaaaggtgggatgggatggaaacggcctactcactcccccaggagtggagaggaggaagcctgaagggatgagggcagggttatgcatattttgcagcatcagataatgaaagcagatgagtcagcagcattcacccacatggccattttattccatgcacaaataatatgatgattttataaacctcgtttcacaaacttttgatgaatccaaggcatggctgccttcgccttacgataaacaagtcctgtctgttgcttggctcactctttgatactggaaggagagtctgttgcagtcagaaagaaaagatgtcaaagtggaggcagccagttgctctggtggaggggagggctggtgtcccaggttagcattacctggatggggaccagttttgcaggtccagagctcagtttatcagtggctcaagggagcactgattcatacgttccaagctcatgggagggagtggcgtaaatccaggcctctcaaacttcaatatgcacaggaatcacggggggcgcctggggatgggaatctcctgaaaaatgcagcttctaatttagtacagctgggctaaggcctgagattccgcatttccaaccagctccccactgcactttgagtagcaaggatgtacatcggaggccaatttttctaaacttttggtacctgtcaccactggtttcctcacaacccaaagactgcttagggagcatggtggcccagaaaggggactccgccttccagggttgctgggtttcctgcagacctcatgtcttcctgcctttctgctttcaccttctatcagcctgggcctgtcagtggctccggttatacatttccttggttatgttcccagcctgaagggagacctgctgactttgggtttctctgtgtcccagggttttcccagagattcattaggaagcaatcttaaagggcgggcttcttcctctgacggctaacctagtcctttttcactaattcttcccagtttcagtctctgtgggtgactctccaagagttggaatgcactggtcacggtgttgacaacacagataagaggaatcacatttagaaataagtaatcccatgaggcagccagagagatgggcagtaagaggctgagagatgctcttggagcagggtcgtcagtgagcaccgacagctggagtgggcagcgctggatgcatcgcctgcctggcccccaacctcatttacccacagcctgcctgaccttgctgaactccatcccagatcctcatttggtgaacctgggctatagacttaggctttgcctggcatttgtttggagctggatgcttgggcatggctgtctggtcatgatgacatggatcaccagccctggagctctgggtagctggagagagccactgaaaccggccacctatttggctttgttgtggcagagactggcttatttctagggctccatctagatcttctagcttcatgcttcctattaatactccgattcataaaaataaaaatcatgaaatataattgcctataaaaataatgagactagggccgggtgcgttggctcatgcctgtaatcccagcactttgggaggccgaggcaggtggatcacctgaggtcaggagttccagaccagcctgtactaaaaatacaaaaaattagctgggcatggtggcgggtgcctctaatcccggccacttgggaggctgaggcaagagaattgcttgaacctgggaggcagaggttgcagtgagccgagatcgcgccattgcactccagcctgggcaacagagtgagactccgtctaaaaaaacccaaaaatcacaagactagaattgccttaaattttgaagtgtttttccagtgaaacgccgagtgcctctcaggtccttctgtgcatttccctaggcccgccacacgaggtagaggacagagagaggagggctgccagccctgggctctgcctctgagtcgaggtttctgggggcccagcctcttccccaggcttttcctctccacagatgtgtgggagcctgtggctatgagaccaccttctctatagggaagcacttgaagaaactctagtgggtataaaaccccaacagagctcctctctctctctttctgactttctcaactttttaaaattttttacttttcgttagaaagcccaggccaacctgctcacacccattgccggagagcagagctggctgcgtagtaacctggtcagccctgaggggtcctgcacctctgatggtagaagctgacacagaacaggggaggctccctggggcctaggagggacactggcccttcaggcgcttcttcttctccactgcgagccgcagagcctggaggagagtgtccttattattcaggatgttatactctgagagtttcaccagcttgtcaaaggtggcctctgtgtatgtcagctccttggtggcatagggagttttgggaccataaatgtccacctggccctgctccagctcctcagggcttcgctctacacctgtgggcagcaggatgacttgttatagactctgtcatgttaggttggaatgacttgtttccacatctctccccaaggcccaccaacctgcactcacggacacacacacctgcatgaaaacctgtacacacgcacaccctcacacacgcacctgcacacctgcaagctcctcagggcgtggtgcaggcttgcccattggaggattgccctagcaccaagcacagtactgggcacatggctgaatgtcagaaaatgtagaatgactgaaagaatgggggatgacactaccagcccatgggggtgagggaatgggaggcgcccttctttgtggaagccaaggttggctcaggctggagctgagccaggcttccccgttagtgcccttagagactctacagatctaaaggcattcccgggccaagggcagcaggtgctgggaactgagcacagaggcagctcacctggtgccttgtattttcggaaagtgtcattgatgagtgggaagaaagtcacgatgggggcatcgggttcctgggggttctccatcaggtagcattccttgagattttcattctcatctggcagctcgtatttggggaaggggatgttctgcacagtgcagtactcacaggtttgtttcaggggctggaacagcacagagggcgtgtttgagcattaggaggagtgggagtggaggagaagcacagagttcttagccccagcttcctgatttccccagctaacaactcagctccccaactgctttgccagtgtatggtattttgagactaaagccaggtcaggacaaaaggcccgaggcagtaggtggatgcacctccagttgcaagctgcttccccaagtaaaatggacaaaagccctttcgttggtgttcgcatccaaacacagacttgggtggatgtggtgggtagcctggaagggcgactggaaccaggctatacacagccagagctgcccaggcccctgtgggatgtgcatgggctttggagctgacagtagtacagggctagaaaagactctgcaagggcatctctaaaagcatgatgtcgcaggaagagcactgccttagagtgtcagaaccccctcagttctgcccctcgttcctctgctcactagctgtgtgatcttaagcaagtctctctgtgtcttggtttcctcatccataacatgagaaatgatagcagttgtgccgtctccctccaagagctggtgtaagggccaaacaagatcacacgtaggaaagtgcattgttacccatttacaaacttagattgttttcattgttgccctgttggtctgtgtacacttcacttcgcctggcttcagggtagaactgtatacacatagaactttccaaagtaaattaaaaaaataaaaacttctggttctgacaagtgccctcctctctcgccaggcttccctcccacctgagagcacttgagtgtaattcatggagggtcatataccctgggggaagggagagtgtgatcattttgaaaataggatattacaagctcttgaatggaatgggctctactaaggttatttttaaaaactcattttttgtagctgaagaattgcccaatatggcaaatgctccaaggcaagagtaaaattcgaatttgctaagtcaacatgggcaccatggtgtgagagccagctggctgcccgtgagttctgggtgtctgacttcccatcatgactgctgcttggcttcctctgatgctctctgggggctgtctagagcatgcctcttcccagttcacagcgagtgaggccactgactgcggggcccatcttaggagaggctgcagcccatgctcaggagggaggctgcgcacttgcctttgtctgggacccagcacagtagttgaggtggatgatgaggtcggcttttcgctctggcctgaggaggggcgggtagctggagttgacaaagaacgcagtgtccagcaggcacaggtggttcgcggactcggtcagctggtttgggaaaccatctagcactgtgtctgaaagccaagccttcccgttaccaacacacctggtgccctgacagccaatggacagaggcacttggggggacggagcgccctgtctggagcatccttcgcctcagcctgaccaggacgcccactgagttccagtgccctctgggtggctgaggaagaacagcgttatcttgggcttttagctagtcttttatgggatattgatacttgtggggtataaggggcttaagaccaccccataaatagtgtaaaccctgggccctgagtcagctgtcccattggccccagatggtgaggatgaggcttaacaggccaggctgaagcagccatttgcaggccacggccaattaaaatattaagaaggcgaaagtcaatgccttagggcctcagcagcagaggaggcggcactgagctgacgctgcaggaccacagtttaaggcctggctctgctgcttaccacttgggggttcctgagctgggccatccctgcccagttccaagcgggcaccactcacattttttttttttttgagacagggtcttgctctattgcccaggctggagtgcagtggcgtgatcatggctcattgcagccttgacctcctgggctcaaatgatccttctatctcagcccccaagtagctgggactacaggtgctcatcaccatgcccagctaattaaaaacaatttttttttaagagatggggtctcaccatattgcccaggctggtctcaaactcctggactcaagagattctccagcctcggcctcccaaagtgctggtgttacaggtatgagccactgtgcctggcaccactcacattaaagggcatccccagaacacaactgcagaaagtaagaccccctgtttccccatctgtaacatggggccaacttctacctgctaggactgttgtacagattctgtatagaatgactgtacagatgcagtgagttaagtacccacaccactccctgctgccagacacatacagtgttcaagacgacaccaccaaatgtggaaaacaccatggggagagaggtgcctggcccagtgaacatagccagagaagttttcttattctttatccatggcagccttgacatccacatcttcctcctccatatggaggcaggcctcaaggagtagccaggtagggttacctttccacctagagaactggccattctggaggtagttggtgtgcagctgcagcccagacaggaagttgtgaaactcagacacgaaggaccgatgggtaaggatttctcggaaagaattggacagccatgaccctgggatcactaccgtggtctccaggatgttagcatcacatttggggatttcaggcaggatcggctcgtcttctgcaggggagggagggatgaagggcaggtcatgagaggtggagtccccagattgcctatgcgaagccccacatggttgcctggcacccaggggtgagcactgtaaaagcagctcataccttccttgctgggctctcaaggtcctggcactggggttaggaggattcaggtgagagacatggagtaagcagagaggtagtagagagggagggggagcgagacagctaagaagcgtcctggagaggacagggagtttcaaagagtgacctgtgactgctatagaccctactctcctcacttctcctgggtgctggcagccttgcctccaggccttggcgctggtgtcactcacctacagtcaccctcccctccaggcagggaagacactgtagccccagctgccctcccacgtcttaggccataggtgacgatgcggaaacatgtggcagggggcctcatcctcggtttgtggtccacaccccgccccccatcacccagccatgagggaaagccgggggccgccccccatcacccagccatgagggaaagccgggggccgccccccatcacccagccatgagggaaagccgggggccgccccccatcacccagccatgagggaaagccggtgtcacccatcacccagccatgagggaaagccggggtcacccaccgatgtcctgcactttctcccttgtccacctgtggaaaaactcctccgaggtgtgtgacaggttccaggcatccagcaggttcagggagaagatgctgctccacaggcctgggagccagggccagcgtgagcagctccaccctgcagccccaggccccacactgacatttgattccccactccccccacccccccaccccacgcaagccaggctgctccacaggcgggacagacttcagacttccatgtccttctccccttcccactgcagctcaacacagtgactgaggggctcagctctcagctcttctcttccctcccctcagtgccgggagacgtaaaggtgtataaggcacagccccggcagggatttaatgctggcaagtgcaggctttgagtttaagtccagctgctgtcagtgaatacatctaaagcatttagggcagcacctggcacatggcgagcactcaataaatgcaaatgctatttgttattatgatttttaaatgtaggcattagacattgacccatttggaatctctataaggtgggttttactcttaagcctaattaactaaggagaagatggaggcttcgacaggtgaggcaatctggccaactttacacagctagtgagtgagaagccagagttcagagttcaagcccacgtgttttgcccacagttttctaaaccacatgctcatcagcataggtgttcaggggaaggagaggccaccgtgggctgggggcttctgggggaagaagtgatgggactgagttggatcttgcaggatgggttggtttgggatagacagaaggggaaggcacagacaactaatttaaataagggcgtgttggggctgtgaatgtgggtctgtttctgaagaagccctttgacgggcgcagctaagactctgaagggaagaactcgagtgggtcctgcattcggtgggcccagctcatgaagaaccgaggcgcttagggtgggaggctgggctaggcttctctggtgaccctgccccttaccctgtggtctccctggaccctcgggtcccaggtctgggttggcccctggaagcaggcacactgctggccgaagctagacgggagtgggtgggagttacagaagcttccgtctgagtctgctgttcccagtgtggtgctgagcaggctgcagggagactgctggagaccaggaaattgggagagcccccagaccaactctggtccccagtgacttgggaccactcctaggatgagacaatgctggcaagtgccccgagtgtcacataatcaggggccaacccagggtggcccagcactgggcagcagccccctgtcattccgccagttgcaaggcagtcacctagcatgtagcagattcgagactccgggatcctcttcaccagccgccccatgaagaactcggagccgaagagctcggaggggatgaaggccccatacttctgcaggcccacctcgtagggggagaactcgaaccactctgcacatgaagcagcaggacgggggtcagtctcaggccagggagccgtccacacagccgggcccccctcctgcctgcagccactggctcaggccttggaaagcctgggacagggaggccgcagttcccccaaaggacacatgggggcacccttggccagcttctgctggtgtagcaagggtcagctttgccatgctttgcaaggaggatggctcatttgcacctcagagcctgttgaatgggacaaaaactgaccctgaagcagggcagctctctcgagtctctctctctctgggcagcgtagaaatatcttcctttcacaacctttgtcttccccagtgtcattaaacacatgcccagggaagctgcagacagtgcctgccggcctcacccatgcagcagggcagattggggtagcaaaggtgatttctccagctgtgtgcacagtctggatgtagaggttgacaaagatgagtgggattgggggacctggaggtgctgggtgcttttgcccaccaagaagtccccccctccaccccacttgtaaatcaccagccactggtgttacctctgaagtcctggttgcttacatcatccttgacattgatggtgaggtagatgggcagggggttctggccgcagctcaaagcagcacgctgatctgacagtttgcattcatttctctgtggggaaacaaaatggttaaagagaagcagcagcccagagggtgagggaggcagtgcagaatgagaagacaatctggacccccgcagccacttcctggctcctgagctcaccgggctgctgtatcggccccagctgacaccagccaaatcactctgaaagggcaccaatggcataggcaccaccccctcgggctgcccaccaccagacaggggccgggactggatccgcagtttaggacagtctctcagagtcccagggtcttggtcttaggggtcagcagataaagaggaaggggtgggagaggctagcactgcccctcttctgccccatcgtcttccctctgctagaactggagcagctccatgtttagcatctccattttttaaaaaaaatcagcttggcatgttgagctccctcaactgaggggtaaaaagttgggggaaaagaagtttcccttcctccgctcccctgccctcccctccctccctcccctcctcttcccttcttttttttttttttttttttaacaaaagacttaggacttgaacactagatggttgctgaggtcactctaatccccagagtggggagcctttcagatcagcccgggccacagtccacctcccaaagtgaatcagccactgcaaacgaggcagaatcaaggtcttagaggcccaggctctgaccccaggccaagcagctgactcctgggtgaccaaccctggtcaccccagtgtgcaaaggctacagaacctgtgtggaatggcaaacacatgtatatgcccaatgacatgtgggtctcctttgaaagaaaacagggtcataactgggcccagagatctgggcatcacagagcccactgtcctggaagtaaagctgcaggctcagggaagagccggtccacattcattgtcaaggtggcccaagggaaaggggctcctgtcctggccagagcgcaagagcagaggcctctcaacaacaaccctgcccttgctttcctgggaacccagctccttcccaccaaacccccagaatgctgagactcctgatgtcggaagactcggtgcttcctcctcatcatatgcggcactcatgattgttacaatattgttgaaaatgttaactagcacttattgatgtaattcccacttaaggaatagtaaagagcagggcctgaatttcaaacccatcctgactgaatcccaaggccgatgcccttggcctctgcctgctctgcttcatagggaggacaggttaagtggtgggttatcacaggggcagggtgggtgggatccatcagaagtggcgagggcctggggttggaagccatgtcccattcctttctgaatccccatttgccagcgcagttcctggcatgcaggaggtactcaagtaatttaattgaaggaatgagggaagattgaagatgagggtccggtcattctcaggtgctcaaactgtctggctttctggaagatggaacctactattataaaaaataattgctgcaatgactttctggcaagttctgatttgaattcagaactccccggacacctttggagtggagcagggaaccgtgggcctggacagaggtgggaagctctcctctggggccaggcaacaacaaaagttgttaatctcggcttgtgcaacctaaagggcacagatgtcagctgagcccaccctgatgtccaggatcgcaacaccccttggagatccctgtgctgtgccatgtgtccaggaaaaggaccaccctgtgctgggtagcagctctcacagcagcagccacccaacacaggctggtcctcttcttgggcacgtattagtcagatcactggatctcagaataggaaggaacctcattgggcccactggtggccatgagaacgggccctgcagacctccaactgtagagagtgttattgactgaggaccccagctgctgtgctctgaaatccacagctgagtctgtgctgaggctgcacttcctgtgactgagtggggcagggatactgaggctggcccgttctgggagacgcgggactcctgtgacagccagctttggctggaggaccctccaagggccttgcagaccacatggtggtctgggatgctgccgcctgacctttcttcctctccccacccctagggtcagactcgcttcatggcgtcactgctctccagtcttccccggcttcctccccgtttttccctcacaggtgtcttggcgtggctctcagaggacgtgctgccctaggcaggtttgcctccaacacgagggtctcagccatcctctaaagggtacacgggagacaatcccaccaccttcctccgtcatagagtccgacaccttatcggtcttccagcccaaggatactcccgcaggtctaacctaatcccctgtgtgcaatggaagtcctgactcccctgaggaagaaagagagccaggcatcagccagggcagggtggggcccaggagaagccgagcacctacctcgtcccccaggcaggtctctatcagcaggccccagaagtctgtaaaggtgaccctgtagccttcctggctgcgctgccggagctcctcctggaatttgcggagctggtctgggaacagggagggtagcttgtcctttaccacatgtctccgagcctcaaagatagcaggctccaagtttttggaggaccagtcagggtcacggtacaaggtagccatggtcctggaaagagacaggcacagctgatagggctgacccggcccctgtctgatgagtcctggacccgggcaggagggaaggtgggcaggccattgagaaccctaacctgccaggaggggaacctggagagtaggggtgaggcagagacctggcagacagtgaggagcaggggaggtgaacattattactcataatcacaagtgctaccagttctcaaatgcccactgtgtgccaggcataacagtggttaagatgaagattctggatccagaactttctggatcaagccaggctctgtcgctcactagctgtgtgatcttgggcaagctacttaatcaccgttcccttcagttttcctgtctgtggaatggggagaattacaataattgtacctgcttcacagagttctggtgaagattacatgagttaaggtgatgtggggtagctagaacagtgcatggcacagaacaaatgctggagcccacatttaaacccaggctcgactgattacaggtcctggctgtttctactctgccatgttaattcctataattctgatgttgactgaggatttatttccctttctcttcttaacttacatgttggttgtcggggggagcaaaacaaagaggtgatcccactagccctgggtctggcctcagtctgcctcttcttggcctggatccagcttttctgcgtcaggacaggaaagggcccttttcattctgcgcctgagaatgacctccctggcagtgcagctagtctgcggctgcacatttaaggaaacaggggcctcctccctcacaggacttgcttttgggaaggtgggaggtggtcaggagacttttcaacaaaaagcaccctgctctccataagcttcacccattcattttatactttaaaaaagcttccagaagccattgcaaatgagtttttaaaagaatacgacttgtgctttccccaggccaggggaccccacccatcccaccccggctgggcctgagttcctcctgctatctgtctatcgcatagtagtccgggaggacgcaggtgcccctcaacctgctggaagcaagttaccttcttaacctactaccgggggcagccatttagcatggaggttaaggatgtgggcccgggactaggttcaaattctactccactgctcattaactgagtgtccctggcaaattactctgtttctccagctgaaaaataatgacaatgcctctctcatagttttttgtgaggaagaaacaagatgagccataggaagcagtgactccagtgcttagcaagaggcaaatgtctccttctgtctcacctgggctggcgcctctgccccccgggggggtgtgtggcacaggagcccttggctttccaaggcccattcacatccatttgctcacacgggggctacccagagctcctccagtatacaaggcacagcaagggacctcagggctcacaggcccaccagtcacagacaggacacggccctgcttgataggccaccctgaaccagggccacgcagggttttgatgggccccacaaaaaatgtttatatgttttttatttttgttttttttaaagacaagtcctccctatgtggcccagcctggtcttgagctcctggcctcaagcaagccttctgcctctgcctcccaaagtgctgggattacagatgtgagccaccatacctggccacataaaaaatattaaaatttatatttcatgctggccacataaaaaatattaaaatttatatttcatgactgttgtataaagacaaatgtattcatattatttattaaaacattttcttcaacctataagtttgttaatgaaatgatcctgattttaaaagaaattaacctatttttgtgggcccctaaaagtacagtgagccgcaggcactgtgccttctgtgggtaagctgacctcaccctggcctccctgtgggggaacccagtgctcagcccctggccctgctcaccagcagagggtgagaaggagggagctcagctgcagggccctgcccgttgcatgtccccagcagtatggggtcatgttcctgggtccataccacagccccagggaaacagtaacaccaggaaaggccagggcatacagtgtctctggcatacttagtagcgggagagcgtcttacacccaccgcatgaggtcagagctactgttatccgcactgtgcagatacacaagccgagcctccaaggagtcaagctgcatgcccaaggccacaccactgcatgtggggcacttcccaggcttcaggagtcactttgtctttgggtggcggggaggagcttcacctgagaccccaggccagcctgttcgtggcttgccctgggctccacagacagtggctcatgtctccttaccaggtggcccctgatagaccggtgatgtagctggcacagtccaggaggttcagcttctgcagccccagcaggtggccatacatggaggtcatggatcttgttccacccccagtggccatgatggctatcagcggcacctggggttacacagaggcaggcggttggggaaggctccagaagcaaagcttgggagaagacttagaatgacggcaactttgaaagaacaatggaggaggcagagctggctacagagggcagggagtgcggcgttgagccacctgacacctgcctttccacagagcagtgggtctagaaatagacctcagctccacacccagaagttggtgtcagtgaaggactctgaagcctaacacaggcttggtaaatcacagaaagctgtggctagcagagttcttagcactgttagtctagccctcggttaacaggtgataaaactggggtccgagggtggtgggcagcttgttcaagaaccctactaatgtgcgatccctcaatgggacaaaccaacatcttctgtagctggatctgagggaaggcaccaggcctggcacatggtgcctgctcagcaggtactgtactggcaaggccaagagtcaatggactggtgatgtgggaaggagcagggttgccagctctgggtcagcagaggtttaagaggcccctggaatgtttccctaaagatagggccaggtacaatggctcacacttgtaatcccagcactttggggggccgaggtgggcagattgcttaagcccaggagttcaagaccagcctgggcaacatgtagaaaccccatctctacaaaaaaatacaaaaattagccaggcattgtggctcattcctggagtcccagctacttgggaggctgaagtaagaggattgcttgagcctgggaggtggaggctgcagtgagctgtgatggtgccactgcactccagcctgggtgacagagcaagaccctgtctcaagaaaaaaaaaaaaaaaaaaaaaaaaaaaaaggagggaggaaggggctctttgtcaagactcattctgtctgttttcctttgagtgggggctgtaagaaccttccattggctaaagcgctattacaagtcctcctcgggcacccgccaggtctctgtcctcacctagggtcagcctcagaaagcaggcgcttggagggcttgcctgctgcccaggcgagtgtgggccttggtccacacaagggaggcaacagagggctgtgacagaggcccaccgtctgctcccgtgggaagaaggggcggtctggccctaggagtgcaagttgcttctctccagcttcctagcgctgttatttctgggagtgtgtttacctgtgcggatttgagaggagagacaattgaggaaagaaggacctaaggccttttgggtggaggtgtggggtgcagaaggtggtacagcttaaaatgttttcctggctggggtgaggagggcattttatccctgagtaaggcccctttagccacagcaggaactcttagtgcttgggaggaggcgctggggctctgtcctttctgtctccattttgctctccccttctcttgtgaatataaaacagaatcacttccagcacagctctcaccagggcgcctgtacctcagcagtaaaagcatccatggaggtggcgcctggggtagggcagggcctgggttggctgggagggcatggtgctggaaggaccagctgggcccaggctggccacatccctgattacccacctcgtcctcctgcaggtcttcctccagctgcagcacctgcttcagggccttggccaccacgaccttccgcttctgcagaaactccagctctgctgggcacaggctgaagcccagccgcacgtccagtgtctcagggctggagggagagaggaccctgtattgggcctgcagcctctacctccctggagtagacacagcttcagggtccattggacctaggctcaaagcctacttctgccagcgaccacttctgtgaccttgggtctccactttcccatctgtaaagtggggcgaatcgtgctgaactctcagcactgtcttcagcacttaaagagataacaaatgcaaagcccccaaagccttagctggcacaatgcgagctggtactcaacaaaagataactgttggcactgtgttagggacgctttgagtcctctgtctcctcggccagatctggaaagtccagaaagtcttcccccaggtggcttctctagcccagggccaggcatgggtgacaaaaggcgctgagatcattttgccaaatccctctgaacaaggccccacggtatggactcttctgtgctaggtaaacaaactccctgttcctatggagctcacgttcttcaatgagctcttcctgctcctagaataacaattattctgtgtgtgtgtgcaattgacaaaaaccatcccattcctgatctcattgtgtcacctcatagtctgcaggcaggtggggcaggcacctctgtgacatgcacaatgcttgtcctcttttttttttttaatcacatccctgccccaaacaagtccaggctcctggcctggcatccaagaccctgcctgatctttccaagctcacctcaaactacccgcgaaacttctgggtcaggtcccagagctcccagaagcagtcctgtttccgggtcttggcacaggcccctgccttcaccagaagtgtcttccctttgcccacctccagcctgtgcatcctctgaggcccagctccccagtgactccagatgaatgtaccttgaccatttccaactgagccttggctcactgacaaagccacatctccttgaaggctgggcctaggagatttccatcatgtctcctctttgtccagcacagggctgcagacatggctgttagaaaataattctttctttggcctcaacagggaatgaataataataatacaacaacaataataacaataacattagctgacgtttgctgagcatcccacttgccagatggattactgagtacttcgcacgtgctgtctagctggatcctcagagcaacccagtgatgcacaggatccttgttattctcccaatgtacagatgaggaaaacagagactcagtaagggcaaagagcttttccaagggcaaatagctaatcaaactgtcaatagaaatcatggccacttgatttctgacaatcaagatttctgaaaacgatgttgttttcagcagatggtgctgagacatctggatatccacatgccaaagaacgaggttgagcccctcttttacaccatgtagattgattacctaaaaattgatcatagacctaaatgtgagagctaaaactaaacaagtcttagaaaaaaacatgggaatatattttcaggactttggtcgggcgcggtggcgcacgcttgtaatcccagcactttgggaagccgaggagggtggatcacttgaggtcaggagttcgagaccagctggccaatacggtgaaaccccgtctctactgaaaatacaaaaattagccaggtgtagaggtgtgcatctgtaatcccagctactggggaggctgaggcaggagaatcgcttaacccaggagacagaggttgcagtgagctgagatcacaccactgcactccagcctgggcgacagtgagactccatttcaaaataaaataaaataaaataaaataaaataaaaatttcaggacattggattaggcaatgatttctggtttcttagatatgacaccaaaagcacaagtgacaagataaaaaaacaaatttcctcaaaagtaaagtcctttgtgcttcaaaggacaccaacaagaatgtgaaaagatacgccatagaataagaggaaatatttgcaaatcatatatctgacaagggatttgtatctggcatatgtaaagcactcttacaacttaacaataaaaaaacacaaataacccacataaaaagtgggcaaaggatctaatagaaatgtctccaaagaagatgatatgccagccagcccatggaaagatgttcaacatcattagccataggggaaatgcaaatcaaaaccacagtgagataccactgcacacccactgctatgaataagtgagaggcacggacagaatgcgggtactataccagggtgtagacttcatgtgtaattcataactctcaccctggggagggaaagatgaaaagcttgtcagaggtgacaattcagagccaagtgatcccagatccacactgtccacccagaccccactcagcacacacgtgcacacacaggcgctccatccctgcctctctcttctggacacaatctccccaccatcttcaactcagcctccatacactctttggaccacactgtagctcatcagtctcctgccccacaagactcctccatcctgcctgagagagaccctcacgagtcacattctctcttgtacctccccaggctctccccacctccctaccacaggagctccaggggaagtaagtcaggggcccttcccagactcaggcactcaccacaggcagggtcatcacctgaccatcggaaaggcagtcgaggggctggctgatggggcccttcttgcgagagcggcagcaaagctggagggatgggtgggttctgtgagaggggctggggagctcctctggcaccccccacctgtcccagtcccccacacctcccccagtgtcagccgccttgtaccccacagctccagtgactcttgggcacttccacgtgcacctgggactggaagtacttggggtagtggaagcaggcagcggtttggaagcaggcagaggttgggcagcagggttccaagcagggccggacacgctgggtgttctcaaaggattcgttcaccatcaccaggaggtccttcactgggagagaggacaagagggtgagaccctgggagcctctcactacccacctgcaacttggtccagcaaaaaacctatttggaggtatccaggaggagtttagaatcacctggggcaccagttcaaattccccagagattctcaatctatagggtagggcagggcccaggaacctgcattttaatgaggtttatgaggatgcagacaaacatagtccccagaaaaccctttgagatgctgagaaggtcctcaggaccagtccttggctcagctttgccagaagatgccccaaagtaacctgcccactgtagaggaggcagaccctccgcacactgtcgcttttgatgtagacgcctcttctgtcctccctccctccctcatgtctggtagccttgcatgggcaacatggggtggggtggggagtagggtaggggtatggtattcatggatctcttaggtctctgccagctataaagtgctaggaccctctgtgagctgtggtctgcctagaggaaggggcatagttagaggggtcctgggcttcgggtgctgaccacctcactgacctaggcaatctgaggtcctggcatggcacagcacagacaagcgtggatagagggagcagcactgggaccccagacctgagatactccaaggttatgtgggtgcttgggcgaacacgccctttacagagcaggatgggaggccaggggctcaggacccctgggggtgagatgattctgaggggtttcagccgagcttttggtccccctgagcccagggaagccctggactaggtggagtctgatgctgatgggatttggaagcagctcccccttgtcccccagtaggcagaaaaggcaaaacagctcacttttctccctcttcctccgcctcctggattgtgcatgaacctccaggcaggagacttgtcgagactgtaaaaaacaaaggagggtcacagagtgtctgagcaccagccacctccttgctcttccaggctgaagggagatgagggaccagaggatacattcagcattggtctgactgggctgatgctggggaatgcagaatgtgttgaccacattttctgaacccaatcaaggcatgccatctcactcagagataggatacttgaccacgaagctgtcccaggaggtctaggacccacggtcacagtttactaggggtcaggtcctcagctgcaggtcgggaatctgacctgagggaatgttcagctctgggctttcaaagtgagggcttccgacaaaatagccttgtcaagatgctgaggcagatcatactcctttgccacacattcccaaagactcttctttttgagggagaggtctccttgaaccctgaggcactggatgcatttaattaaaatagctgtaccaacagccgaaatatgaatttttgtttttggcacagggtctcactctgtcacccaggctggagtgcagtgtcataatcacagctcactgcagccttgacctcctgggctcaagcgatcctcccacctcagcctcctgagtagctgggactacagacacatgctaccatgcctggctaatttttgtatttttttgtagggatggagtttcactatgttgcccagacttgttttgaactcccgggctcaagtgatcccccaaccttggcctcccaaagtgctgggattataggcatgagccaccatgactggctatgaaacaatttttaatacagaaattgtgcttgtaggccaggcacagtagctcacacctgtaatcccagtactttgggaggctgaggctggcagatcgcttgagctcaggagtttgaaaccagcctgggcaacatgttgaaaccccgtctctacaaaatacaaaataatagctgggggtggtggcgtgcttgagcacgggaggcagaggttgcagtgatccgagatcgcagcactgcactccagcctgggcgacagagtgagaccttgtctcaaaaaaaaaaaaaaaaaaaaaaaggtaaactgtgcttgtagaattactggggttgtggggtacaggaccaagactgagtctgagaggaggctgcacttagtgggttgttttattggggaggctcttaaggggaagggtcacttttgggatatgaagtgctcggccagggtgatgtcccagctacctcctccctctgtacagaagccccagctcgtgccccagtgctgcctgtgccccatttggctggcctcgtttagtctaactcctgcagaggtcaggataggacagagaccaagctgggcccactgttttctcccttggtcctgttcccctgagagcagcagccagccgtggcctctggagctacaggaacccaggaagataattaccaccagcacgccattggtgacgagggtctcaggtggagagggactgaaaaacaaaaggagaactcctggtcaattctagcattcttgactggtttcttctaatggcgacaaagggaataaatagggtcaataacaaaatatcagagccttctttgttctcataaaaaatactagcttcggaaaccttagccttataggttgtcagggaggaaactggcctacatttgaaacagaatgtccaggaaaaaaatagatttataggttagaagagtaggagagttctatttttttgaaaggataactgttttttatgtctaaccagatgcaaatgcatggggttagaagaataaataggttgtaagaaatggctgcaacctgccagctagagcagacataaacagttttggtagtgaaaatgatccattctccattctgtgctttatctaacttatgcatttaacagtctgacccagctgagagggtgaatgttaaatgcccttgtgttataaagttgagaacataagcctccaaggtttcaattagcctggcagagtccacagcatcccttgtcaaaattaagcccaaggtgactgtgtctccagatcaactttattgttgttgttgagaaggagtctcgctctgtcgcccaggctggagtgcaatggcacggtctgggctcactgcaacctccacctcctgggttcaagtgattctcctgcctcagcctcctgagtagctgggatgacaggtgcatgctgccatgcccaactaattttttgtattttagtagagacggggtttcaccagatcaactcttattaccaagcatgacatgtttcattttgcaagccactttctaattcagcctaggagttttccccgccctctaaaaattctgtcaaatcaagaattggaggggagagcttcgattttcttcaatgttaagtaaataacgttgattttaatttgccaatcagctgttgatgggaagtaagttccctcacatagtttgaagatcccctaggcagaggattctccaagtggcagttgacgagccctcttgtcctgtctcccacctgtcatcctccttctgttcccgggctcatcacaagcatagggggctcagccctgccaggtgaagaagagggaggagtgaggaacaagctgcccagttacagggcactctgcccggcctgaggcgggggttgcctttctttctttctttcttcctttccttcctttccttgctttccttccttcctttccttcctaccttccctctttgttccctccttccagacctccagctctctgagtcctcagcacagtcatgtctccaggatcctggatcgttttcctaattgaaaatgatttgggctgggcgcggtggctcatgcctgtaatcccagcactttgggaggccgaggcaggtggatcacctgaggtcaggagtttgagaccaacatgatgaaaccccatctctactaaaaatacaagaattagcctagcatggtggtgtgttcctgtaatcacagttactcgggaggctgagggaggagaatcgcttgaatccaggaggtggaggttgcagtgagctgagatcgcaccactgtactctagcctggatgacagagtgagacgaaagaaagaaagaaaggaaagaaaaggaaagaaaggaaagaaagggaaagaaagagagagggagagagggagaaagggagaaaaagggaggaagggagggagggagggaggaaagaaggaaggaaggcaggcaggcaagaaagaagattggaaagaaccctgcaaggtgggcctgagcctcccattgacgtggttccagagttggctgcagagttggctgcttgcggccagggttggggtgtttgttctaacagttctggtcaaggaagagacccctgggctctgacctctttctcagctgggcctcaacaaggcccccatcgccatggtggcaggaactcttcccagaagccacccttgggaatgtagggggcctgaggcaggctatttggccagagtactagatctttaaagcaatgctgagggcaggagaactgggtaagtgcagtggggcccaggctcctacactatggagaagctcctgggtgattctgatgcacagtgaagagtcagggttagtgccaggagtgagactggaagagggtgaggcagcaaaaaggccgacctgcctctgaaatgctcgttcccagaagctacttgatggccaggaccttggtgggccccggggcctgggcctactcacctctcctccagcaggaactccacctccagctcttccatgccctggtaggggagggagggaaggcagctgtgagtggcgtctgcacatctctgctgaccagaaccctttgccaccctgggagccgctgtggacctgcctccgtccttcccccacagctgcctgctgccatggagtgtgcttgtggtctcctctgccaatctctgtccccaagtctttgacatcaggagcatcactgacagcccaggggaggtcagggtgtggagctgacccccagccccagcatgtacattcctctgcccgagagcatctcctttctgtcacttccctggcttcccaccgctctcctgccttcccaagggactcagtgcctgtggcaagggagcgctgagatacgccttcagaaagcccattccttccttcactgagtccctcacacctcttgctgtgtactggaggcaagccagggcctcactgggccttactttccccaccagaatgtaagctaggtgagggcagggatgctagttcccaaggggacccagtgcctagaacggtgccggcccctcacaggcactcaaatgctggcagaatgattgaattgacagcatcctgggggctccagctctgactgtctctgatctgcagattcgcccacctttaccctcatctgtcctctgttcctggggccatcccagcaatgggactctgagggaagaaaaggagggaagggaaccaagacttactacctctccattgtgttctgtgaacactgctagttgcctgaattatggtttctcatttaagtcccacaacaaccttgtgtggtaggtattatgatcaccattttgtagatgaggaaacagaaacttagggagttatttttacgacatcacatagtgagtgacagtgctgggatttaaaccagcagcaccatcttttctcaacttgactgtgtacacagagaagaccctggggaatggctttgtgggaatcagcaacagctatgaggttatcatgaagccggagtctgagggcctgtaccctgcacccacctgcgggttgagtggaaacttcacgtgggttttctttcggaaacagagcttggtgaggtcatagagaactgtcaggagatggtcatctggtgtcactgtgtcttcatcacagacactcaactctagcacgttctaggggagaaggaaggatgccagtctggttaccacggttgcattgaccccttcccagaacaaggggcttgacctctgtcctagcaaggaggtaggtctgggggatgggagacagcccagaagtccctgctcagatgtgacagacatttgtagggaaacgaattaaggaaggcaagtgtctattccctcctttccaactccctgaagccttcttggccttctgttctcactttcctgctagagaattttgcctcttttacaagcttggtagagacctgtgaagtatggaaggatttagtttcacctgaggggaaggatggatgggaaagagcaagcaagacccctgccaggatatagaatgtggtcagcactgggcccctgggcactgaagacagcccctttggtgctagaaaatccagattagggaatcgaacatctaacactccagggagtgatgtggcaaagcttgtaggggttctgataattggtggggtatatgaactctatcctttgactcatcagcccctagtaagttctcatggatggtcccaaagcagctaccttgtcatctggctgaactctgaggtcagtgttctcaggtgacatggactaatctctgaggcctcttgttccaaggatcctgggggatgtgggttgaggctgcctcttaaatacatctagtggacataaggtggttctggaggttcccaacgggatgtgattgttgaccttgtaattactagaaacacaggtatgtcccagaaccaacccagcagctccacaatccaaaggaagctcaaattctgatttcaagatggcagactgaacccacatcaaaattctcctcccttaccaaactcacatgtatgatagaaaaggtattttaaaaataataagtataaagcccttcttgaaaagatacgtcacgtaacaaaaataaataagtatccctaaaacatggaggcagtaaggtggagctgtcaagcctcaagcacctccagactggggctgatgccactatgatgaggccaaatttgttgtaagggatctctgctgaggctgtcacaactcaggatgctcaaaggataattatcccatgggagatgtgaactcaacttagagtcatcatatatctgaagaagaccaatcccatggaacaactcaacaaataaaatacacacccaaagaaatggaaataataaagcaatatgaaaagaatttaagagggagagaaccctctggctggaattagactggcctcagacctagtgaatagaatggttctttcactctgtgtattcccctgcttggagaaggctctggaaacacaatctgttttggattaagagacacctagtttcagcaacaattaggacaagagagaccaggagaaaaagctagaaagagaaatagactcagagaggggcaaacatgagacaggcagaaggaagtagtgggtgtgagtgggaagacaggtttgtaggacaagaagtaggcagaaaggaaaacaaagaggcataagaacacagaggcaaagagaaggacaagtgggcaagaggggagtaaaatgcagacagggaagacaggtgcagtcctccatgtctcaccttcactcggctctggatctggaagttgaagctttcattccactctggatttgggcagttggagatggtccttgtcctcagcttcttctgagaggcggtgggcagccagaggctcacaaaacagtctgtctggctcactgtccaagaaagataagtggaaccaatccaggttcagagagaacatgtggagtcaaaagggaacttcaggcaagcctcttccagagccaggccccatctcagctccagttcctctcctcattcatgggtctaactttccagagactcagatccccaagaagtcacagattgcaggctgtgggtctcgcagagggcgacccaatcccactggccattctcatagacacagatggcctccggctcttattagaagcacccttgtccctgagcaaacacctgctggtttgggacaaggtatggtcacacagttttccctctgccaaggtaagatctggaagaccagtccccaagggtccggattacttcttgtcttagcccaggggaccaggaaaaccaaagtagggccaagcactccctctgggctgaggagaagtgaggatgagaaggaacactctgctgtgagtcggccaagaggaagggccccagtgggcaaggacttgagtgaaactagctattcagcaagatctaggagcaggaacccccatctccatatggcttaatgcctccactgcatccagccaggctcttcttacctatcctgatctgcagcatcaggttatggcccaagaaaccctcccctctgtggccacatacttctttttcattctaaatgaacaacccaagtgtgatgttgctggatatgctctggagaagggacagaggctttgaccccaacaagccctcccaaaatgacagaaggtctcctaagtcttccacctggagcaacagaagggatagggtgaaaatagtagcccagactggctccctgctctagtctacctgggaggagggaggcagaggggccatgactgcccctgtcactctcctggcagttggtgagggtgaggcccagggtacacaccagatacataggaaatggtgaaagccagcagtttccagtgtcagagagtcctctcgatggtaaagctggcaggaggatgggagttctacactggtaggactgattcaaactagtttttaattattaatagtcactgatgagagtggagccagggctttcttcgccctgcgttgtcaccacactgaaaggtttatcagaatcaacagccctgatctaaatcacaggtgttcctagcttctgatttcatccctgaagtctggttaatctttgaggcctcatcatccagtgaattggaattcacagccctcctcctattgaagaaaggtgagatgacactctcttttagatgtcatgataatcacttaatccagacaaaaagaatgattgaaacccaacagaatcaaaagaaaatgatgacctcatcaacctactcttcccttctatgctcaacctgctcttccttatcatcactcaggtgtccaggccagaaatcagtgtcatccttgactctcacattcagttgatttaaccctttgtctctctcaggacccccaacttctcatctgccctgccactgccctggtgtagaccaccataatctctgaggccacttcccagataggcttcccatctcctgtcttgccccactctaatcttttctccaaagagaagccacaaggagctttttagatatgaccatgccattccccagttcgagatcctccaggggctcccttctgccctcaggaaggagtcccagccactcaaagtggctgaccctgctcacttccccagcctcagtctcatctctccaccctccctaataccccacccctgccctgtgtgtgcgagcatgtgtatgtgtgcacacatgtacattcacacacatttacacacatacgcattcactcaaacttacacacacgcactcaccgtttagactccagccaaacacagtcacttgtattcaaaactgcctttgcacatgtagctccctctgcccagaacactcttccactttcacccacccttctccttgctagccccttgggacttcagtaggaacctcctctggaagctttccctgagcacccaagtctggaccaggtaccccagagcccagagtcctctgttcctctcctggggagcacccctatgctgctctgcaacaacaggtggactcatctgtctccatcacactgtggccacaggatacaggtacagatacatcactgcagatacaggtcagaggtcagtgtgtctcattgctctgctgatagggagactcaccaggaacctgctcagccctcttgaacccttcccttggcttttccagaacactggcccccccaccccgggcctggaccacacccttcaggtctgtctccggtacgctgggagcctgcaggcagggtgccagctctatacctactggttctgtaatgcacttggcgcgcatgatttgatggaccctgtaagagccccttccctctaaaattgttttcctgtcattcgtccatgcctaaaattctccgataaagcccattaaataaaaactcagtatttttggcctaaggcttaaatgtctagttaagataaagaaatattcctggcagagacaagattgatcagacacccacattccaagcattagtttttcagttcttttgcagagagctgcttcccctgtccacccccagcaatgaatggttaggcaacggtgacctggttctgagaatttcatggactatggggatttcctaggcacagataagttctaatccttgttcctagtggagtgacagagggcttggtcatctgaatgacatgtctcctttcctggaatgtgggtggcagagatgactcaatcatctctatagatgttcagaactttgtctctctaatacctctggagacacctgtctgatatcccttggggtgctggtttcagttttaatttctcaagagaaacaaaaactcctgacaactgggaggtttctaggcctgattgtctctcagtcctggcccaaggctctttcagttatcgaggagtcagccctgaatcttgagtattcactgccatttggcctcttggaaactttaggagactcaggcacaagttacaagactaaatggaagtgctgtttattttggattcaaactagaaggaaaaaatttgggacaagggtaacccaggacctaaaagacatcgggatagtcttaatctaacccaggcaaggtagcaacacagcccagcctgcagcaactgtggaatccagaccagacatgactggggttggcaccccgagatgccacatgtgccttccgccttgttcttcggggaaatgaggaaaacgtaagcaacaggggggtttccaaagagggccaggtatcgcccaaaggcagcctgtctgcccaaggggcatgtagggaagggaggaggcttgtagagccagactacagcctgtttctctagctgcctgctcttcctcacaccccgtcacctgctgagtgacaggtgtggcaggaagaagacagaagaaaggaccctggacagtgggaagtctgagcatgcaggtgcaggcatgcatgggggcatgcagccaggtgactggagaggctgggacagacacacctcaaaaggagttggagggctgggcatagtggttcacgcctgtaatcccagcattttgggagactgagacagaggatcacttgagcccagaagttcgaaaccagcttgggcaacatggtgaaaccctgtctccacaaataattttttttttttaaagttagccaggtgtggtggcccatgcctgtagtcccagctacttggcaggctgagatgggaggatcacctgagcccaggaggtcgaggctgcagtgagatgagattgagccactgcactccagcctgggcaacagagtgagactctgtctcaaaataaaataaaaataaaaataaaaataaaaagcagaaggggttggaggaaggtaagcactgctgtggatatgtgggagctgggttgtcccaaggatgagggtgaactctgcccaagagtgggaaagtgtctgagtgaccaccgtggcatggacaagaaaggcaagagaggtggccacgtcctggatccagaggacactccctggatcctcaaatcattcaccgataggctgggaaagaccccaagaagcttgaggaaaagtccctggccctttggttggccacttggcagacacagacccaaactggaggctactggagccactcctgctggcgcaggctctggacacattgccctccagaggctctgtctctggaatcctgcttggtccctttgctgtctctggggctcagggccctcccacacttatccattcacactcagccctgcattggagtgacagcttcctacaagttcccagactctccgcacctgcactctagcacaagctgcatacaaggcctcaggaagtcatgcaatctcttcctcaagaccccaggtaccccaacactttgaaggcatccaatccctcctctgcctcacttcctggttctccatacctggcttgtctcctctcttgccacactctccacacctgggaccagaccctacttccctcttaggcaatcattaacctcttgttgcaaaatgggcctccagggcctctcctcaagttgctgggagcatcgggtagtgtgtggatgtctggctacaggtcagccaggcaggtgctcagggggtgtggctcccctccctcaggacagcctctccccaagatcgggctcccaaggcctctggatactcaggtcctgcccctctcagaccccaggctctctgtgcagcctttcttggccactcccagctctcattgttctcctctgcctctaaactccctggtgacaagatgggaacgttgttattctataactgctttggacatagatagctcctcttgttaaaatgtacactcaatctcagggctctgtgtcttctctgcccctctcaggccctccctagcctttcgggatccctgtggcgcttgagtcattcctgtgtggttaccggtgagcagggatgctccccacctgtggggcctggatatacagctttttcccccttgggggccaacttcccctctggatggggccaggggtgggcagtgtgggaggggctttcagttctcctgatctcttaaaatgccacccaaagacaggggtggggaggattctgcccactgagatgcctccattggcccccgtggcctggaaatgcagcaggctctgggatgaggggggaggttagggctgccaggaaacagcactgcacaaacagtgctgctaagtcaagccacatccatgggctgaactgtagaactgggtgctgtggactctggcatggtccccagagcccagtttcagatctttgtcttgagaaggggctctgggagtcacctggcagctggctccacgatgcctaagtgcctctccttccacttcaccccaacaggccctaaccgaaaggaggagcaaggagtgctccgtgtgggcaaagcgggtgctcttggaaatcgattccaggaagagagagtggggaggagacagagggcgaacagagctcttgggtgcaggcacagactgcggggcaggtagcgccgagggaacagcatgaacaaggggcctggaagagtgacagaaaccccaaagtctgaactacaacttgagtatagaacacacattcgtgcacatacatgcacacacatacacgtatacaccatgcacgtgcacacgtgcgcgcgcacacacacacacggatccacctgaccatttctccagccagggcctcttccatccagatccggtaagcagagaaggagagaagtgaggtggatactcacgcatatcagcctgccggacatttttcatccggatgaccctcactgtcaacaggtggcatggagacagcccctcctgtggaaggagaggacagaggactcagtcttcaagcattactccaaggccattgccccgggggagactttcccgctatgcctcctcaggccggcccagttgcattacaacaacccctaggctggtttttttttttttttttttttttttttttacagagtttcactcttgttgcccaggctagagtgccatggcgcgatctcggctcactgcaacctctgcctcccaggttctagtgattctcctgcctcagcctcccatgtagctggggttacaggtgtctgccacatacccagctaaatttttgtagttttagttgagacagggtttcaccacgttgtccaggctggtcttgaactccttatgtcaggtgatccacccacctcggcctcccaaagtgctgggattacaggcatgagccaccacgcctggctccccatgctgttttgtcattgtttgctggggtttctgtctgctcttcagcctggaaggtcctggaagctccagagagcctgggaccctgactggtttttcatctttgtacctccagtacctatagcatgctcatatctagaaggtgctaatacatgttcattaagtgagtgaatgaatgttccagccccatgcacagaatgaacgcccatggcaagggagtcctgaggtgttctccctctcctttcttcactgaatagctgcttattggcactctcctcctactgtcccacatgcagatatttgctcttgcccaggcaagatggcagcctgcttgggaggcaggcacagtgtggctgcgggaaggggggtgacagacactgatcacgcacggtgacatctactcactgggagaccatgtgccaggggctcacccccactggtacttacttagctccagcccaggcctttgcatctcccttgccctttgggcctcttccccagggtatctcccccaggtccttctggtcactctattttcccttcccaggaaacagtctgcctctctccactccactgtttctcgcaagaggtccttgtggagtcttggctggtctgcgatgacctctctttcctgatggcaaaagctcaagtagtccttggtttgatgactggctcctgtcagatgcctctgcgggtcatgataaccccaggggaccagagccctgaggtgtcccccttccctagcaccttgtcctaacaactggggtgtgggaacactcccagccctgctcacgcggtgctgatggctcctccttccgtcctgcccctcttctagttctgatcacctcctgggggctctgccatcatctcaagcccaggtcctcaaggaacacccagagccctccctgggctgcagtgtctggggcagtggctgtggttccttaaggccccacgtccctcccgagctgcccctgcactctgagtctcgcagcagccactactctactttatcccttttggacccattacttcattactttctgcctcccagaggccctgaaaccccctcttccagccgcaccagcttctctggaccctacagcaacagagtgtcgccggatcatccttcctgcctaccgagggaccgcagcgctctcccagtgcccctctgcctgttgcccttggccccaggcgttaagcctgtgggagccgctcccgtttcacccctctcctggccagcgtctcttccatgggctgttttcagagctcagggtctgtgtgctcgctggtagggctccctgcctctgttgctctgagagtgccagccctctgattgttcctctgaatgaatgaaccatcttctagagtattatttttgagcacctactgtgtgccaggccctatgctagatgctggggggccaggggtgaatactaggcagagacagaggttaaaggcaacagcggccagtggctttgatggggagagcaggtcaagctggctacaggctgttgctttccaggcttggggcctctggctggctccagaagcttccccgccatcagtcatgctcctggactctggaaacctcttctggtccctaggggcccaaggctgcagaggtgaggcgcgtttctactctgagccggcacacccgggaaggggcagcctcgcacgggttctcttcaggtgtcctggttctgttcttggttcatgcctttcctgttggaactcatgacttgaagccccttcgctgagagttttacccacgcttagaagagtttttgttgtcgtccattcccagcctgagctcacggtaaatgcctaccaaccgaatgtctgtatttatagaagcgtctgaaccggcaccctcgacatgcgaccctgaatgttctactccgtgttgccagaatcactttatacctttttaagaggattcaattcttctctctttaaatactattgggattgggggcaggagaaacaagatacgaagaaaaaaaaagtttctataatcccaccactcagagaccatctttttatctttacttttttttttttttttttttttgagacagggtctcactctgttgccttggctagggaatcttttgatgctggtcctttcagactttcctggggcttaattcttttttctttggagacggagcctcactctgtcatataggctggaatgcagtggcgggatatcttggctcactgcaacctctgcctcccaggttcaagcaattctccctcctcagtctcctgagtagctggactacaggtgctcacgaccacgcccggctaatttttgtatttttagtagagacgcagtttcaccgtgttggccaggctggtctcaaactcctggtctcaggtgattctgcctacctcagcctcccaaagtgctgggtttataggtttgagccactgtgcctggcccctggggcttaattctgatcagcaacagaatgctgattctgggaaggtcacgttatttagccccttttaaggtctcttctcctctcctgaacagctgccttaaaaccaggacaaaagtcaaactcacagccaattataggtctggagatttattttgtgagatcaaccctgaaatattgaacatctcatggtcaataacttgctctaacagcattctgttgggagccggagacttgggccaaaagccatgcacactgcttctcttctgatgctggagacacagctgtggcctctggccagacctccaaggtgcactcctcctttctcactctgcccgagtgcagcatgcaccctgggctggcctggtgaggaggcagggtcaactttcaccaggcaagcagttttggcaaaacctgtacccaccggcccactttctcagagggcaactagagtccaagctgtggaggcttcagcccaggcaggagtccgtcctgagggatattccacagtgtttcagggctctgaacccaggtccggtggtcctctcggcctcacaatccttctcctgcctccaggagggggtgcctgtggcccagcctgcctccttcaatatctactctggcagggaaggcgcagccacactctcccttgggacctcactccaggtgtcctgccttccaggacaagttcactcccatcatctaacctcagtgccttccaatgcaggtgaccatttcttcccgctctaactcagcaacaataacagctagcatctgctgcgtgccagccatgcgcaggtgccatgtacaggttctctgtatattatcttgcttaatccttacaaccgccccacgaagcagttattattagcttcgtctttatagatggagagtcagaggctaagtcctttgacacagggctcacagctagaatcagagacatccaatgctacttcccaagcctgtgtttctcccactgagaatctcagtttacttggcaaacaggaagacaaatgttgcttgccttcatctcctcttccttgcttttcttctctttaaaacagtttttctgacagattcttcttttcactcagcgctcccccaaagccaaaaaataaccaccaaactctgacaattcttctatggcctgcactcttactggctgtttctaccaacacattctaggatatccctctctttttaaacatctagagcacatcagagccataagggtctttggagaagttcccattttccagtagccacagattgctccacttgagccttagatcacaccctccagctctcgaattttcaggagagacccagttttcaggagacaaccacattttgccagcacagaattgggactgggaagggggtttgagagacatcccagccggatcatgctgggaggaaggtggcaggaatatgggacttagctctggggaccagatgcattccaggaaccaggtctatgagaaatggccttcttgggttgcaatgaatgtacctattttgcttctgatataatctgtttgatcagtgttgctagagatgagcaaaaattcatggcctggaggtaattaatctacagtggaaagatgcaatcgagcaaagcaccgtgtctctgatgtgcgtgtgggaaccagaaaccagggaggctgtggaacccaagtttacagggttgcttatggtgtggtgagggccaaagctttaaggactcagataagctcatccctagaacaggatgccctggctgggattgggtatcagggtgaagagtcaaactatttaagaacagacatgatcaggcaccatgccagctgggctgcagccctggagtagggacaggcattcatccttcatgagggcattgggagggccctggggtaaggaccagggagcacttgaagacttggagctcaaggcaggaactgtttggcaaacagtacagaggtatatttagccactttgccaatcagtacagctgggccagggaggacaggctggacagcagttttctgggaagccaggggagagagagggccccactgctcaggctgccgacacaccgtcccagccccctccccagcctggattctggggttgatcttggcaggactccactgccccctggggacctactggggactgggggaccttgccagctcatgtggaaaagaggcagccccttgaatctcaggattggctatgatgcaatccaatgctgccccttcccactcctacttttatagatatgacttttggcaggggtgagggtggggaacaaaatgtatgactctgctctggcaggcccagctgggctgtgctctagctgctgtgcatatgctcttatctaaccttccaaccaccgccaaggaaggcatcattatccctgctttacagaggggaaggccgcgtttagagagattacatctcaaacaggcttacactgcccaggagtggcagagccaggacttgggtgcaggtcttcagggcgcatgcactccatccacctggctctcactatgaatgtacagcaccagctagcagcttgctccaggccatgtgctggactagtcagtagcagagacaggaggaaaagcctcagcctcctcattggagctctccctataccccaagaatctagccgttaccacaaatcagtcaaaagaatacttaattaccaaagggctcccagggtcaggctcctgggtgggagtggggtctggggaagggtctgacaaccacatttcagaggtggtggatccgatgcccatcgctgggccagacataccctcagcaaaccatcccatgaagtctggggagcctggagagaggggaagatggcacctggggagcctgcaggaactccctccccagggcttctcaggtcaggccaggcaggtgatgccacctcctcctccctagagagctgggtgtacccttcagttccatgcaacacctgtgtcagagcttggactagccaggtgctgtcttccagaacatgtgggccctcctttaaggagaccattgggaggggacatgatgggaccctaatacatgtcccagccactctgagcaacatcccagactaagagtcacctgggaggagctaccatggctgttttcctttttatcaccaggctagttgagtggtcagggcaagaaatcccggcaccaacatggaccctccaggcctgacaggggcagatgcagctcatggagaggctcctgaagccacatttggggtcccgggctcttaactgcttcactgccccctttgaggtaaactctgtcacctctgtggaagacctctcctggcccaagctcttggaggctcaaaaagattggcaggaacaataggtggccagacgcccttccagccacccaagtgctgtggggaaaccagggcacaccccaggaggcagtgtctacctggctgggcagcaggggcattggccaccacccaccacggagctccctgacttgggctcctaggagactgaacagggtcttcatctcccccaccaaggggcaaagtactttcagggcatcacccatgtcattcaatgatttaacttgagccggggaggtggccctgggaaaggtaatgaggaagaagtgctgccttcgaggaaccaactaatgattcttcccaaggtgagcctacagcagattgaagcattgaggtcatctccctattgcctagatggggaaactgaggcagagttggtctagagccctggcaacctgatccatgaacccagaggtctccctgtgaggctgtgaggagttggatggacccatgagccttgactgtaaacccaggtgggcagctttgtggctgatggcaacagattgacaatgccaccaattctcaccatacactacaccatactcttgcacagcatagaagcttaggatgtttgcagggttaaatcctgcttgccattagggcaggccaaatgtggatccccctggcatactctctatcttgggtgctagcctggccccaggatggccccacgccacttcatgatgccttgaaaatcttgagggtactctcagcagggccacccaagcaggagccctggccccaactgggataaaccacctcccccaggttttaagatgaggctgcctgagcccaggtccttgggatgtccaatgcctaccagccctccctgaggcccgtctcctgctctcagctccctgcccctgcccctcacttcctggccatgcctccctggccctcagcctctggccccagccactgagcacccctccctcaccttcaaggcacaggtggccgagggcctgctgtcttctgcttggcatgggtctggcagggagtgggagaccctggcgtgcatctgcctcaggagcatcacggcagctctccagctgggtggcaagatcaggaacttatactctgactcagagctccaccttcctggccacagcttggcagtagctgggattgctctgggagtggtttgagtgggtagacagatagggtgcatgggcctagatctcttcatatcaaagaaatcacaggtcttcaggtcatagaaatacagggacccgcagggctctggtctttggggtcagcagtctgtagcccccagccactcagaatgaccaggccttcaagggcacagtgggtggcaagaagaggacactggacccacatgactgtaggactagcccgccataatttgggaaagctctatctcttcagcttatagaggtcatggctcatagatgcccctctaggaggatgcgaccgtcgctcccaactccacttcagtttcatggcttggtaccccaggagctgtggccagggaccttcatggggtccctggccacaactcccaaagagaccagggtcagtgctcccaaagctagagggtgaagaaagaaaataattgcccaatacttcgtgagaaagggtctggggcaaccatcccctgtcctccctcctgggaggccaggtggagagagggcgtgtccagcccctgcctggtctcaggacagcttggaggatgcacccgccccgcccagatgattcctatctctagcctggtggctcactgaggggcctgacaagggcagctttgcctgttctgctgcctgactctgtacactgggagtttcctgcctgagctattgcctggggccccacaaccgg

SEQ ID NO: 69 - DNA, 1560 bp, Homo sapiens
accatttaaagcatgttcatgcatatcttcatttgtggtcttttgttatgtctgttctcaaatcttgtactatattaattggcaacattaatctgtttccacaataattatagttttaaaatttcttttgttcaagatttaaaaatttgtaaaacattgctagtgtttatcagaatttgaatagcgtaaaatttttttaataataatatgaaataaagtaaaataagatactttttactttaaaacaattatgcagaggataattgttgtctagttttcttaatagtaaattagatttatttttaattaagttgtggttgtacattggtgtaaaatgtctgttccttcccccttatatttttctggtttatgcactcagaagataggaaataaccaaatagaaaaagttcagctttattttatttatgtataaaataagaatgtttaatcttccagaaaaatgcattgtttggatttagtttattatctaaacagtaaagcaagatatttaatgtaagcaagtttttctatttaaagaaattagtaattatttcaggcatttgtttttaatgaatattttgaaggtattatggagatactttctccttaagttgcataactgtacattcaatatataccttgcatctctttagcagttatcaaaattttagggctaaaagaccactttgaacaaaatttctagaaactcgttacttacatgctttagcagaaatttaaatcatgaagttaaatctactcagtttctcaaaagcacctgttatctctgacccaaggcctttgtcacagttgattcttttgcttaacacagcagctcttctcccctttcctgctcttttcatttagctaatcactgtttctccttttgagtctctgtgtattaatccagataggttatgttatgatgcattaaaacaaaaagactaaatcttagtgacttggcataacaagctttttattctcattcacacaagcctatcgtggattgacatgtctgtctgtcatgaactgctgtcattaatgtgtcgctttccagttgttccatcttgtgatacttccatcttaacatgtaacccttcaatagctgcacagagaaagacagcatgaaaaatcatgcaacacttttaaagtacttatttctggaagtataatttgcccaagtattcaagaagaagaaggttggtgggcattagtcatgtccactaaaccttgcataaatgaaacattttcttgtctttttttgatctctgttctgccctcagccttctccagatgctctcataaccacgtgttctttctttttcatagtcattattataatgaattgtttgtctaacttttccccttctacattgtaagctccatggctccatgacttctgtgactacatctgctttttctctccactttgtccacattaactggcaaacagtaaccagccaaatatatttattatatattaaatatatatgtgttatatatttaatctatttattaaattaatgaactaatgagtttctatggcttgcaatcttccagtta

SEQ ID NO: 70 - DNA, 26097 bp, Homo sapiens
acactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcag

SEQ ID NO: 71 - DNA, 84733 bp, Homo sapiens
acggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcccaggtaaagttccccgcccccacccggcgcgcccctcccactccgcccaccccagcccgctttggggcggggtggggggggtgggggatggggccctccgaggtccgcaggggtcggaccggggcgctctgttagaaaccctgctccccccagctcaggcctgatggaaaatgtgggagggaggggaggggagaaggagggggagggggagggggcggaagggatgtggtgggctggggagtgatcaaggggaaaggagatagatgggggactgagggggatgtggtggactggggggtgatggaagggaggggagagggagaggatttacaggaaggaagagattatatgcggggagggaagagggatggggaagatgggagaggacttttggggaagggaagaggagggaatgtgggaagacggcgggacgatggggaaacagccaaggaggtatggggaggagggggcacagtgggaggagaaaatgtggtgggaggggacgaacatggaggaggagtgtaagggggtcaggaggagctttcccaccacattccacattccacctagacagaggaaaccccccaaggctcctcctcaccccatcccccaccccaggcgtgctggggacctggagttttccattctgtggtctgggctgggagggctggtctggattatatcgcaccctatagtatcttcagtaactactgggcagggggtacaagggtgtctcagggagtcccctcatcctcacctgctttggggacagatagtgcccgtgaagtatgcaccctctacctggtgcacgttagggcctccggatgtggtggccattgtcatcgctacctggtgcttggggtgccagccccctgtgcccgcggctctgcaatgtaccaccccagggtgctgatgagaactgggggtcaatccagcctcactccacgcccctgcccccaccatccccattcccaccctgggaagcgttgggcaggtagctcaacctctctgagctcacctcattatctggaaacagggagggcagagttgtgcttacctctggggctgttgtgaggaagtgatgagagcttgacactaaaaggaatcacaaactgttgagtgcttggcacactaagttttatgaaaccatgggctgaacctggaggtaagacccaggaggtcttgttctagtcctgtatccacccattcagtgccgggtgagcttaggcacgtttcattccatagtcccagcagagctctggagaagctgttgctcctcctggtctcctggcttccatccttatcagccagggtcctgacaaggcccttcgagaaccagcatgatccgccccttctcacctttacctgcctgaccctatgcccccgactctctccctcacccactctgctccagccacactgatctccccatctttccctagaggtcccactgcagggcctttgcacgtgctgttccctctgttcggagcattcttcgcacagcctgctctttccaccacctccccggtgcctctatctctgctcagctgtcactgcagagaagctgtctttggccacctggtctaaaacagtcatctcctcttactgatttttgtttctttgtttttttgatagtttttttttctggcagtacttcacatgtcctgctatcatactcaagattcattcatttgcctgcttaatgttggctgtcgaggcagctggatgacccccttgtggcctcagcagattcagaacagcaggaggcaaaaggagttttctgatcctcttgtttatttttccagcttatctgccagagaagccaacaatcccaagaaggccatagaacgggtccagaggattttctccaaatttggggagctccaaagggctgtctgctagcagtggggttcacagctgggcttggccgatcctcagctttgtgaccccaagcagactgctccacctccctaagctgaggttcctcattgacagaatggggaaaagagaacctcatggagttgaggtcaggaacaaacgacctggtccatggggcacacctatgtgagtgcctgtcacaccatgagcatcagggaaagttaaccgcaattagcgcttataccagttccgctcctctccattatctgtgatcaggcttggtctcaattttcccatctgaaaaatgggaagaacagttccttcctcatggggctgctttgagaactgaattaaatgaaaagagaatgaaatcacccagcacagggtctggtatacaataggtactcaataaatattagttcttctactccccacccctggcttcagtgcagaccaatatcacctcaatacaaatatctcttccagatactctcttcccttctcgacccatagacaaaatcctcccagggaaggagaggcagctgctcacacaccaaagggagatgaatgtgagcctctggttcttcctggatttgttcaggagtcggcatatgtttaggaaggtggccaggcccccttcccagagaatgacccaccatgggtctgagctggtccaggaaatccacctttgctagtgatttgtcctgaggtgggcaccttccagatatctgttgcgggcttctagaaaaatgtgtttccttcctatttgccttctcttctgctttgggggcaatcgtgtgggaatgtgattagtgggggagctgaggggggctgtagtgttatgagggaaggccaagaaaactgcagagccccaaaccagagctgcggaatcaccatccctggaaccacctgcctatagatttctcatttaatgagctaaccacacgtctgtgctaggacaccatgagtcagatttttctaatacttgcagccaaagacattcccaactgagacgccttctagatatggctgaagggaggaccaaatgaggcaatgatgcatccggagcacctctgcaggactggcccatgcgagaattcaaaagtgttgctttgttttattatttttactttgcttactgtgtaagctttctatgtttatcaggctgacaggacatccaaccctctggctatggcatcttggaggaacaggcaggccttgaaaatagcagaaattccgaattcccctgccccgggaggactcaaaggaccctgctgaggacagagctgatatggcctcagaataaagatgagggaagaccatcccaaggaagacccctctagcccatggcaaaagggctggaatacgcaaggatttgaaaagcaagttttgctttccatataaacctaagcaagtcgcttaatctgtgagcctcaactactttacttgtgcaatgggcatgttgctggtagtggtgatagcagggagccaccgagagagcttccaagtgtgccatctaagccctcctctggggaagggaagctcctctggggaagggaaactggacccccgggaaaatttattctcccagggacgaacatccagacatttccctgtaggagcctcagtgtgttcagatgttcactgtccagtagaaacaagacatctaggcaactctcccatctcaccaagcctctgctctcttctgtggccactgtggggttgtgagagtaatgtcaagacccaacccaattagaacacagggaattttgcctgggaaagggagcccttctaccctacacccctgctttctctcttccaaggatcaggtctgattcatgtctgcatcctaaaggctacaaataaactgtgtccggaaaggaaaatattatgtgtattgccttcttcaaggctaaaaaccagtctcaacagagaggggcagttttaaatatttttttgtaacaatagttctaactttagttagtaactgaagccatctgaaacactttttcataataatttatttattccccacaaagaacctataaaatgggtagtaaaattattccgaattcacagatggtgaaatcaaggtccagaaagagtcacttcacccaaggtcacgtagtacttcctttgataagctagagcatgggaatttgatggcttcttaggacaagctaacttactccctggtgctgcaaacacaccctgggccttcccacctccacacctttgctcatgctgtttacctgcctggaagccctctctttctctaccttttgatttttccaaatcggttaggagcaggttctccaggagagccaagatgagatgagatatactaaaggcttattgagggagtgccagggagtaaaatgaagagggagccagagagggctgggagaaagggacagaaaggaggacaaatggaaggaagggacagaggaaagaagggaccgtgggctgcagtgcattcttagaaaggtcaagtctggccgggcacagtggctcatgtctgtaatcccagcactttgggaggctgaggtgggtggatcagttgaggtcagaagttcaagaccagcctgggcaacaaggtgaaaaccccgtctctattaaaaatacaaaaaattagccaggagtggtggctggcacctataatcccagctacttgggaggctgaggcaggagaattgcttgaacctaggaggcagagattagagtgagccgagaccgcaccactgcactccagcctgggtgacagagcgactctgtcaaaaagaaaaaagaaagaaagaaaaagaaagtaagtaagttagttcaaggctaacaggttgtccttgagcctcctgaggagccctatgtctcccaagaacaagtctgcttcccccagtgattggctaggagcaaaccctgggaagcatggcatatctgtcaatcaggctccaccaagggaggtcccagaggtgtgttttcatggctgctgcagctacgaaaggaagcacagctgccgtctaaaactggaacaatgcaagaataaattcttccacttacagaagctaaacgaggttgagaggtggaggggaaggagagacccaaaccgcaacgtttctggtgtttttgtgctgctaaagagagagtggtaaactcaagtcttcgagcaagtattgcaaatgaatgaagtgagccagtcatatcaggaaggcaacagggagggatgggaacaatggaaaactagagagggctgccccatccaaaaggaagcagcttctggcagtaccagccaactaaagccacgtagaaatacatgcctagtgtggccagatctttagactcaagagaagccagaaataatggctccaattattttaaaacgctgcatagaccaacagcacacacctgcccccagatttttagccctgcagtctagttgtgccaagggccagtggtttaaacatttggggtatgtaaaataggtttggagttgggatgttgaacaaaattgctctgtagaattaaggaaggacaacagagttttagggggcagcctgaaagagggggcaaagaccaggccgacatgagcacagattgggggcctgtcccagtgtgacatcctctgtggaattaggagccaataaatgaccatttctattggtgatgtgtcatactgagtgtttagttgtttgctgtcttgggctgtggaataacaccacacatacactcatatacatacacacgcacacacacacatgcactactctcacatacacactcacatgttgccccagttacccccaaacgttcagaaacaatctgctacacacgtcaagtgaccaacgcatcctggtttgcccagactttcccagttttagcactgagagccctgcatcctgggaaacctctcggtcctgggtaaaccaggaaggttggtcacgctatcaccacacctcagcgtagcgtgtgagtggccagagattgggtcagagctgtggcagccaccttggagcctgaggagaatctttgctaagtcacacaattaattagccacccctggaactgtgctgcagtagattagatcatagtctccaatttttacccactccctgtatcagaattagacattcacgcccttggctgcagggttgcggtgcctcccactatgagcagagaatagtatctccctgactcagtgatggtggactcgggcctgtgactcaatttgatcagtggaggatgaagaaatgaccagttgccagttctgagcagaggtttcacgaggaatcacatatttccacttgaccttggtttctgccttgagccatgacccacagggcaaacctgagctcaacctgcagcctgaagtagagaacccctagctgacctgcagaggtccgaagaagaaaaatgtacgtgttgttacaagtcatggagattttgagatcttcttaagcaacaagaattgactaatgtatactttatctctgaactttttagaatccttttggttgaatgttctttgtaccagttaaattagaataggctgctttctactcttggagccttggtacatctgtacaagaggatgatgacgacaaggcccccctcccatggtggttggacgaattcaagaagatcttgtgtctagtgcatgcagtaggcacttaataaaagagatgatgctaggccggctgcagtggctcacgcctgtaatcccaacactttgggaggctgaggcaggaggatcatgaggtcaggagttcgagaccagcctggttaacatggtgaaaccccgtctctactaaaaaatacaaaaattagctgggtgtagtaggggacacctgtaatcccagctactcaggaggctgaggccggaaaatcatgtgaaaccagaagggcgggggttgatcgcgccactgcacttcagcctgggcaaaagagtgaaactctgtctcaaaaaaaaaaaaaaaagaaaagaaagagagatgaagcaaggctgggctcagtggctcacgcctgtaatcccagcactttgggaggctgagatgggtggatcacttgaggtcaggagttcaagaccagcctggccaacgtggtgaaaccccgtctctactaaaaatacaaaaattagccaggaatgctggcgtgcgcctgtaattccagctactcaggaggctgaggtgggaggattgcttgaacccgggaggtagaggttgcagtgagccgagattgtgccactgcactccagcctgggcgacggagtgagaccctgtcttagcaacaacaacaacacagcagcagcagcaacagcaacaacaacaaaagagatgaagcataattctttcagcacatattaccaagtatttatttgccaacactgtgcaggcctctttatcaagaattttactgaagaaatgaaagacagaaaacctcttcacttggtcttttttatacatgaagagaaagcaggtctgaatcagaggcagagggttggaagaaatgacctgttttctgccatctgggccttgctgctgactgtctctaagaatttgcacaggcctgggcctttggagatttgaaggtctctaaagtgcaaggatgtcagctgcaggggagccatcctccagcatccttccccaggagagccaggattatgtagggaatgtgcttggctaagagcccagaggtggggcagctacccagatgcaaacatggctgggccaggcggcctttcgttcagcgttcccaggctaattccacctagaccttgtcttagcctgtgagaggatgttctggagtggtcttgcccctcttcccaggctatctgccagaggtggtgggtgctacaggagagggactccagcaagcttctcatcctttggttttcccaggacgggggacaggtggcctcacggctcccaaccagctgccttggcactttgtagtggaaaaaatgatgaagtcagacctcagtctcctcaactccctgctgtcctgcctgagagccagcctagcatggaaggcaaggagaaaagagacccatgttgatctgtcacccagacagaccctgagtgatgatgctcctgccaccctgaagcaccccaagaacctcagaacttctggcttctcatcttgaaaatgggacagcagtcatagctgctttgcttattatgtcaaggagttactaaagaggatccagttagatagtgggggtagaaaaatggctgcctaaggccacatttaccctctccttctagaaattataccagagcatcaagaataatggaaaaacaaatatacaaaaccaaaccacaaactccatttttagcaaagccaggagagacatataattcatcggcttcagagtacgtgtgaagcagctaagacagggcagaagccacatgggagtggtgagtgggctcagtgatagcaaatctcagaaagcatcagcaaaactacacttcctagggatgagggcttgccatgagatgaaagttatgttccttctttataaaaatgaatgtagaagcttgggtgaatacgattagcagcagaagctctcctggatctcgtttggttcagagaaacagaggaggtatagtgaagaattacagagagaagacatatttgcaggaagcagtctgtctctatggcagcagaggagagccacagttacagagcccatgaagctaccctaattcttccttacacccataggagcaatcagcaaaatacctgacccaggaaaaccaagcccttccaatgacaagcttttgaaaaagtgtaaaagccttgatacaaagatattatgataaattatgaagagcagaaaaatctaccaatagatgaaagtgttaacacaaaatggatgaaaattatatccaaatcatattggcataaattcaaaaaagaattgaatggaggctgggtgtggtggctcacgcctgtaatcccagcactttgggaggccgaggcaggtggatcacctgaggtcaggagttcaaggccagcctggtcaacatgatactctcgaggctgaggcaggagatcgcttgaatgtgggaggcagaggttgcagtgagctgagatcatgacattgcactccagcctgggcaactagtgaaactccgtctcaaatttaaagaaagaaagaaagaaacatcttaggagaactgaatggagcaactacctctgtgaaggaggacaataaggaaactgaagaactcaaaaagaaggcaggcaaaaggaggtaatgaacatgaagggttagcactcaggaaagaagtagaaagaaaaaaaaatatcagaaatgaagacaaaattggaggggaaggaaataggccctgcagaaaatacagcaaggacacggttaacagaaatggaaaaagaggaaaaaaatgagacagaaataaagaaaacattagaaagactagaaagaaaattggctgggtgctgtggctcatgcctgtaatcccagcactttgggaggccaaggcaggcagatcacttgaagtcaggagttcaagaccaccctggccaacatagcaaaaccccatctctattaaaagtacaaaaattagccgggcatggtggcacacacctgtaatcccagctactcgggaggctgaggcacgagaatcacttgaaccccagagacagaagttgcagtgacctgagattgagccactgcactctagcctgggcgacagagcaaaactctgtctcaaaaaataaataaataaataaaaataaataaaggtgtgagcatccatgcaccagataacacagcaacagatagttacagagcaaggacattttaagtcacttctctcagctcttgaaataccaagggaaaaaaaaaaggaaatagaaagtcaaaataacatagtgaaccacaaacactggctacctagtaagccacaaagaacatggcaataatttttttaaaagcagaataaaagtacaatagtctcagatcgcaatgcaacaagcctgtgtgacctccattcctctccctcccaccccagcacctccccagagggcaataatcccccagccccacttcaccaggcatcagctcctgtgtctgttccatgttagatcatgttagatctcatcttggccagacacggtggctcacgcctgtaatcccagcactttcagaggccgaggcaggtggatcacctgaggtcaggagttcaagaccagcctggcctacatggtgaaaccccatctctactaaaagtacaaaaattagctgagcattgtggcaggcacctgtaatcccagctacttgggaggctgaggcaggagaatcgcttgaactgggaggcggaggttgtgagctaagatcgcgccactgaactccagcctgggcaacagagtgagatgctgtctaaaaaaaaatctcatctcaaacacacaaacatttcactgctttaaaaaaaaaaaaatagaaatctttggtggatgttcagccacgctcatggttcacagctccaaactctgatgcacaggcaatcacatagcccaaatgtctacatgtcctgcatgtccgcagagggctagagtgagagagcctgggctccacggccagactatgtgaactcaaagcctggcacccgcccccccacttaaaaggcctcaggcatattgcttatctgtgcctttgtttccccaggtgtcaaatggagttggttgtgaggatgaaaagagttaatctctggaagtatggaaagccttggataaatgtgggctattagcattattttcacagcctcccaacctccctccactaataccagacacgctggagagagttctctgtctccctaaccatttatttggtgatcagaaggaccttctgcctgtgatttctgacctggcaggatactgggggaccacttttgcctctgcctggagatagcatgtctgagaatgaaaccgacttacagggcagcagaaccaagagatagggaaatacagtttcttgagatatcatttgaacccccggattcagccatgcctgaagccagaatgctcctgaccacatgaaccattaaattatttttgtttgcttgtttcagccaatttgggttgagtttctttcacttgcaatagaagaaagttctccattctgaagctgaataaggtagtatgtgaagtacttgtttcatacctggtgcttaatggatgaaaccttattacattctcatttcgtaaaccttctccagggctttctgggaggcaaccagatatgaattagagtgacacagctttgcactccttgcccagcctggataagatgccccattcgcagcaagctctatgcagtcagggccagcttcatggacatgcaacctgggtgctcacataggcccctgcacccagaatggtctcatgctcggcttagcgctctcctgtcaccagcttgaaattcttaattatttttgaacaagggtccccatgattttactttactctggtacccacaaagtatatagctggtcttaataccagtatcatctccactttccaggtgaggaaactgaagctcaaagaggggaagcaagcagcccaaggtcacacagcaagaaaggggtggagctgggaatcaaattctgattctgaggcccaagttcataactgcgatgtgccagtgcctggacaattcctcatatgtggatggcacttcacagtttatactctagtgcatagcatttgaccctcataccagctttagaagcagaaattgtcatgctggcatcaggcagagtacttgggtttgttcaagcctcagaaaccaaccctggctaatttaagaaaaagaaaaggtggggacgaggtattggaaggaaaagttgaccagctgggacttggaaaggacaggaacaagcagctccgggaacgcggggagcaggagccaggggtgtggggagcaggaaccagtggccaggtcttcggggctccagctgtttccaatctcagcattccttccgcttcagtttctgattctcccacgagaaagtctgattggccatgtttgggtcatgtgcctgcccacagaccttgatggtcaaccaaacaaggtgggaaggatgatcccccaaaggcgggtcagaaagtggggtgggagggctgaaagctgggcagggacggctgtgtgcgcattttacagatgaggaatgggaagcccagacagaaggcaaggccacagaaccgggaatggtggagtctgggctccagtcagaggcccaggctgcctctcttcactcccaggactccaggctggcaggggaacaggagggcattgttctccctgttggagtgaatggccgcctcctgggaaacccaggacccagatggggtctccccagggcgcaggaaactgcctcagactgagctgtattcaggggtcgaagcctcctccccaccctccccctacagtggacagactcccccttcaaatccaacctcactgctcagctctagccctatggtttttaagagaagctagtgggggaaaggcttatttttccaatgtgcattttttccggtatgtaagatactgtgtggaccaaataaaatatgtccagacctggaaacagcccaagcatagctagtttataagtcctggaatgctccttcctgcacacaaaaattaagggtctgtttacatagatatgctagtgtgttggagttgaacttttccttactctgaactcagatatgcaaagaaaaatgagccttttacattttccatggatgtcatctagttcagtgattaggagcaagagacatgctggagccagagaacctgggtttacatcttggctttgccactatgtgacctcaggcaggtcacttaacttctctgagtctcagtttcctttaagggacatatgtacacacgggtgtggcatttaataaaaaccacaaaagtccctgctactgctctgtgtccatggtatgatgttggtcatgagccctcacactggaagaaatacaaaatcttaagccaggctaatcatttaaactgtctatttaggcaagacaggcttcccctggggtatttcagggacaaactccattgatcagtttcccaccttcctctgctcctcttcaagaagcttctgcctgaacaccactttggtaacagggaaactgagctccgaggagagaggtcaaggttaggaaatgtcatttagtgagtgtcccttctgcacaaagccgtataggtacgcaagctccttgaatcctcataaccattctggatggaaagaatcaggactcccttaaccaacattgtggagcttgcaagtaacggaggcagcattagattccaggatgttcaacttcgaggcctgccttttctctgctcctattaactgtgtattcccattcctggtcataaggcaagattcagaggcatctgtgctccaattgaccatggcgcttgatcccaaaaggaaaaactctttctctctctctctacctgattaacaataataataacaataatttaatggctcaagcagggaaagtccagtggtgggaaatcctggcttcagggaactgggaagaaaaacagcttcaggaatggcaggatccaggggctccatggatgttgccaggactcacttctctctctaagcaatgctttcctttgtattggcttctccctcaggcagcctctccctgttttgtatcaagatagccttagcagtccttatgccctggcagcttggtgatgccagcagaaggagactctgggactaactctggttggccttattaaggtcagatgcaaatccctttacttctttctctagctcatatcggtcaggcctgcgtcgccttcccacttctagatctggaggtagagactagggtagttttctcacattgatgccctaattaatgaccttcctgcatccgagccctttgcagtgtgagtttatttccacatgatctgaatctgggcttggccttgagacttgctctgaccactggaatccaagggaagtgatgctgtgcctgcttccaacctaggcttcaagagtcttcttcacttctcccctctctgttggaactctggatagccaccatgagaacaaacctgggctagccagctgcaggaggagaaaccatcttaagaagtgcctggtcccccagcaaagactaacagcgcaacagccagctgacctatcagagtttgttttttaagcaatcttatctaccttcttgcaggactaggattgacagatgacaaaaaaaaaaaaaaaaaaagagttaaggcacatctgtaaagctagaaattggaaggctgctagggtttgaatcctggcatggccattccctagctattaggcttagtttcctgtggctgttataacaaattgccacaaactcgatggctcaaaacaacagaagtttattctcacacagttctggaggccagagggtgagcatcagtttcactcagctgaagtcaaggtgtcagcagggccatgctcccacagaggctctgggggacaaatcactccatacctcttccagctgctggtggctgccagcattcctttgcttgtagccacatcactgccatctctgccttggtcttcacgttgtcttcttttctgtgtgtctgtccaccctcccttggtcttcctcttacgaagcatatgacatgcatgcttttaatacatgtgataacatttagagcccagcaagataatcccagataatatcctcatcacaaaatccttaatttgatcatatttgcaaagactttaccatataaggtaacattcacaggctcctgggattaggagaacctgatttcttagaggtccaccattcagcccactgtactagcatgtggctccaagtgagtgtcaacctcactgtgcctcagtttccttatctgtaaaatgacagcagccacctcactgggtaattatgaagatttaataagtacttagaatggtgaccagcacatgataaaagctttgtaaatgttaaccttcaataatatcaagggtcggtcgggcgcggtggctcacacctgtaattctagcactttgggaggcagaggcgggaagatcgcttgagcccaggaatttgagaccagcctgggcaacatgacaaaacccagtctctacaaaaacaaaaacaaaaacaaaaaacctagccaggcgtggtggcatgtgcctgtagtcccagctacttgagggggctgaggcacaagaatctcttgaaccctggaggttgaggctgcagtgagctgagtttgcaccactgcattccagcctggggggcagagagagactctgtctctaaaaaaataataataataagatttgactgtgactgaaattcgcacaagaacaaatcccttctctgtcctgtttgctcgcgcctgtcttcatagcacccaccatggagacttgcacatagtaggtgctcagtaaatattaaatgcacacatgccactatgtagctgtgtggcttcaagcaagttgtttctcctctctggtcctcagtttccttctcccttcacgaagagcttcttgtagggaaagtccattcctctttctgggagggtgtgtccccatcaggggtagagggttcaggggtcaggagccggccacagctgctatctccctgagtcaccaaatttctcaacttgaggccaagtgtctaaatattgtgactgagccagttagagataagatgtggaaacattgatttggcccaagcaactgcagtcacggtgctggagccagacctccctggatcttctcagcagcatgagtgagtgtttagcacctgccaggaacacaggctgctgacctgcaaacagatggggaggcccagatgcctggcttggcagcaagagcctgcctttgccgtctctgtttacacagccagcatccagtcaaatctctgtggctccagtggagaaactaaggcccaaagggagtgaaggatgtgtcgtccagggttacgctgggagactgctatcccatgaagctaaaacccgcaagtcctaactcccagcccagcacctgtgggaacccaccaggcccagggagaaggaaggctggcagcgtgtcacaggcagggagcgtgcctgagcaaatgctcaggggtgaaagaccagatgcaagctcaaacactagagtgaatgggagaaaaggccacgtgtccaggactttggactcaattcagagaataaaagggaaccatcgatggttttaggaagaagagcagcaggatctgagaggctttttccaagtgcttatagaccaccagcatcagaatcgcctacgacaggagctgggggaggttgtcaaaatgtgggttcctggggtccaccctagatgtggctccccattgtagcaggccccctctgaggggattctgaagcacacccactgttttagtgagtaggagatgcagctaacatcccacttataaggtctaatctcagacaaacctggtttcaaatcccagctctgccacttacttgctctgtgattttaggtcacttacgacacctctctgagcctgttttctctcctccgtaatgaaacaatcttagcatttgcctcaaaggtttgttctaaggattcaataagataatgtaggtaaagtgctctacatagatccagagccctcctagtgctcaaaaacactggtttttagagattcccttgggcagcagtggggagaaagcaatggaggagggcaggcaaggaggcagggaagccagtgaggaggcagcagtgggactccggggagaggtctgtggctagggtgtggacatggtgacgggtggggtggctcctttgcaccgtgccaggtggtgccgatcttgtatgctcgattgcgaaagaagctctctggagttggtctagggcaggagagaagaggatgagcaaaaaaaccaaaagaggttgatcataaaacccatattcgcagtcacggactgggtgcttagcgtgggccaggccccgtgttagctgcttcctgatcttcatcctcacaaccacctgacagtgtgggtagcacttcatcaggggttgttaaccccgacactagtgacacttgtactggataattccttaattaaggggctgtgctgtgcactgtcaaatatttaacaacacccctggactctacccactagatgccattaacactcccaccttccagttatgacaaccaaaactgtctccagacattaccagaggtttcccgggaggcaaaatcacccctagttaagaaccagtgctttattctccttttacaaggagggaattgaaggctcagagagccaaagccctttgcccacagtctcccagctaagaagtggccggatttgaactcaggtctgactcggagccccggatgttaacctttgccgtgaaggaggccacatctatgcagtggcaggcccagatggtctatatgggggtcttggggacagtggtcttttccgaaggggcagctggaaacacctgctaagcagatgggctgcgtgagcgtttgttgggggtggttgtagaagcgatgatggggattatgagagagccaaatccccctccagaggctaccaccatttgccctggacagagggactgagggagatgggacgtggagggcaggcaagaaggaccaaggtggcactgttaggagaagctgggtgaggtcatctatgcctggagccccactgccgggagcctcccaaaaacactctccaagacctttgggctaaatatttatcctgtgaatgctcttttccttcctgcatggggagtggggctttggaggtgggtccaagaaatttggggagacagaatccagagaaagaggaaggggacaggccagaggtcagaggtcaggagaaagtagtcagaggccaggaataaacattcatcctggcatctaaagccttccagagtgagctccactgccaccacagccatctcactcagggaggcgtagaattcaaaatatgtttttgttttcttaagagacatggggaataaaattacaattttttttttggtccagtctttttttttttttcttttttgagacagagtctcactctgttgcctaagatggagtgcagtggcgcgatctcagctcactgcaacctccgcctcctgggttcaagcaattcttgtgcctcggtctcctcagtagctgggattacagccacccaccaccatgcctggctaatttttgtatttttagtagagacaagatttcatcatgttggccaggctggtctttaactcctgacctcgaatgatctgcccacctcggtctcccaaagtgctgggattacaggcatgaaccaccatgcccggctcagtcttgatatttttaagcaagggagttggaggtgaagggaaaattaagtcaaaaaatcttacccagaggacaggtgtggtagctcacacctataatcccagcactttgggaggccaaggcgggcagattgccagaggtcaggtgttcgagaccagcctggccgacatagtgaaaccccatcactactaaaaatataaaaattagccgggtgtggtggcgggtatctgtaatcccagctactcaggaggctgaggcaggagaattgcttgaacccgggaggtggaggctgcagtgagccgagattgagccactgtactccagcctgggtgacagagcgagactctgtttaaaaaaaaaaaaaggctgggcgcagtggctcatgcctgtaatcccagcactttgggagcctgaggagggcggatcaggagtttgagaccagcctggacaacatggtgaaaacttctctctactaaaaatacaaaactaggcggatgtagtggcgcacacctgtagtcccggctactcaggaggctgagacaggagaatcgcttgaacctgggaggcagaggctgcagtgagtcaagattgcaccactgcactccagcctgggcaacaagagcaaaactctgtttcaaaaaaaaaaaatcttatccagagaagaagtcatttttttagacacaagaatactttgtttatacagatggttgctataaaaggcctgactttgtgccgatagagaagatggatttatggtgaaggcagctcctgaatgagctcagtaatcaaagtcaaggtcctgccaggttaagctgcagcaggctccgctccctaccaaaaatgacaggctctgctccatctgatgggttctgctccagatgatggaactcataagggcatcatgctgtcaaacggttttactgccaagactgttgttcatgtgtccaaagcatcacgtctaacctctaggttacgatgaccccagagcttgcaaatcttggtggaagaattgcacggagcctgaagtatgtttttcatcggaaatggtgctcattaaagaaatacgtgcctgttagccatcacttggattgtacatgacatcgttgatgttgcgtgtgtgtgtgtgtgtgtgtgtgggtgcacgcacgcacttgtgtgtttacattttcttttccttctttgttcctccactaaagcagaaaaagtgttagaagatgtttaagagagatgtggaaacagagagaaatgcagttttatccactcttctctcttgtaagataaaaaatgtgtctctgggcagggcgcggtggctcacgcctgtaatcccagcactttgggaggctgaggtgggcgaatcatgaggtcaggagatcgagaccatcctggctaacacggtgaaattaaaccccatctctactaaaaatacaaaggattagccaggcgtggtggcgggcgcctgtagtcccagctactcgggaggctgaggcaggagaaaggctgaacccaggaggcagagcttgcagtgagccgagatccgcactctagcccgggcgacagagcaagactccatctcaaaaaaaaaaaaaaaaaaagtgtctctgggtgtttttaagccaaaagccattcttcaccaggagggcttgtgggaaagcagattctgactcagtaggtctggggtgaagcctgggatgctacttctccaatgcactcccaggcaacgcagcagccgccagtctgggagccatgcctgggagtggtggggccttagcacacagtgtgtgtccctgcctctggacacctcctgccatccctgctcttccctcccgctgctaagtctcgccctggtctccctgccttcttagagatggcgcttcctttagcaagtgtttgctccacttaaggattcagggaacatccgggctggagagatgctggagaccatcccgtccaactctcttcagttcccagttgcttttgtggcaagagctaaaaacccaactcaacccacacacgtttatatagacttgtggaaaatacaaagggctttttttttttggtgcgttttaaaatataaatggtatcatattgtgtgcgtcattctgtgcctgtttttctctcttagtaaccaatcttggaggttttttaggtcagcagagaaaaacctccccattaacagcagtacaacattccaggatctaaacaacagccttgacattactgacatttacggctggacaattctttgctaaggggctgtcctatgcattatagaatggttagcaacatcccaccggcatgattccagtagcacccctcgcccccatcagttgtgacaaccaaaatgtcatcagacattgctaaatgtgtcctgagaggcaaagctgccctggttgagaaccatggggataagatgtagaagagcaaattccaaagaggtaagatgagttacttcctggggcacaaggaaggactggaatggggatagagagttctcattctttatgacttcattcattcatccatttcatacatatttattaagcacctgccatgttccagacaccatgccaggtgctagggaggcagcagggaagaaaacaagccaataccttcctattgtggctctgccattctccctggggagacagacatgaaacaaacaaggaagacatcagtacggaagatgtgctaaaaactatgggagaaagtaggacaaggggagctgggagtgctggggcccaggtggggacttcagagcctcacatatgatgttttaatgtattaaaaggagaatatctccatgagttatttggatgatttaaaatttttttattacttgagcctaggagttcaagaccagcctgggcaacacagcaagacctttctctgcaaaaatttttttttaattagccagatgtggtggtgcacatctgtagttccaggtacatgggaggctgaggtgggaggatcacttgagcctgggaggtggaggctgcagtgagccatgatggtgccactgcactccagcctgggcgacagagagagaccttatctcaaaaaatattttttttttaagatggatgggctaagccagtcccagcctggctccctgaagcaaggagatctttcaaggggctgaacccgggtgcctgggcagcagctggcctcagccccccattccttccttcaaatccccttgcttaggacaataaactcctcaacaggtaccctcagctgcacttgcatggagctgcaccgccatcccaagagctcgtggtgggcctttgaggcaccctttctccatctgtgtgggttcctccagcccattgttaaaagatagtagtaatgtctaacatccctgtaaaaaaataatccccatgtttctcgaggccctaggtttctggtccctgctccctctctgactttttctcctcccactctcccccaactcactcagctccagccacactgactttctttctgctcctcaaacgttcaggctgggtcctgccactgggcctttgcacttgctgttcctaatgccaagtctttccccatggtctccccacagccagcttcttatcaaccaagtcccagctgacatgtcgcctccgcagagaggacatccccgaccaccccagccaaaggaggccttttctccaaatctccttacacgtctctctcacatgtgtgtttctgttacagtttgaatctgtgtccctgcccgaatctcctgttcaaccgtaatccccaatgttggagatggggcctggtgggaggtgattggatcatgagggcggtttctcatggtttcacaccatcccccttggagctgtcatcccaatagtgaattctcatgcgatctgcttgtttgaaagtgtgcggcacttcccctctctctttcttcctcctgcaccagccatgtgaagatgcctgtttccccttcaacttccgccatgagtaaaagctccccgaggcctcccaggaagcagatgccaccatgcttcctgtagagccagcagagctatgagccaattatacctcttctctttataaatgacccagcctcaggtatttctttatagcagtgtgagaacagactcatagtttccttcattgtacttgtgacttgatgaaatgattctgtttgattctttgccgggttgttgtcagctccataagaagaggactttatcttgttctctgtgtacaaacacatagtaggtgctctgtaagtacttgttgaacaaacatgtaaatgaatgaatgaatgagagccagtgtgatttggatgactgcgtgcatgtgctaagtaaactgttttccatgatctctggggttgtgtgtgtgtgtgtgtgtgtgtgtgtgtgttcagtttggtttttgccacatctttataccctctgttctattacaacttagcatttttctttttatataaagaaactcatttaaaggaatcttgacaatatcactagaaacagaaagccagtatcagcacatacttgctataaatagcaaaaaaaaaaaaaaaaaaaaaaaaagaaaagaaagaaagagagagagagaaagaaaggaaaaccctatgcatataaattccatgaagatgtgaaaaagttatcaaattctcacagggtatgattgctactgtagtttctaagcctgaggctttagaaaatcgatactctcttgaaaaaaaaaatttaagcctgaggctgttgtgtctttcttaaaaaggagattggcaggtgtcagagaggtgttcaagacaagttaactccaacccgaggctttctcaatgatctttctccaattcatcccaacacccacttgccgcagaccctgtggaaggccccagatccaaactcccttcctgctaacagcagctgtctggggagatttccttccagttgagccatccaaggactcctccccagcccttatctgtggaatggaaaaaatactagcccacacctcatagattaagagaatcaaatgagctcatttatagaaagcacatggaacaatgacaagcatgaaataatagtcactgatgtttactgagactaacagcatgtcacacccagtgcaaaatgcctcacgtcctcccacagagtcttcataacaacctttagctcatggaagtactatttttaccctatttggccaatgaaaaagcagaggcccaggaaggtgaagtaacttgtccaaggtcacacagcaaggaggcaatagagctgggatttgaaccccggctgcctgactccagagctgtacaaagccagataccacagaggctgggttattgttcgtccagacccatgttcccacaggtcctctcatcccttacctgctccctttctaccttgtatttctatcctcctgctctgaggagattcctctccctgaagatgcttgggcttgagggaaccaggaggagaggaggtgaagttggcctggatgactctgtggtcaggatcctaatgacccagtaattttcctccaagtccagtattctcaggattaagtcctaatcatccatctacccactcacccactcattcatccatctgtccatccatctatccatccatccattcatccactcacccatccattcatttacttattcatctattctcccattcacccatccatccacccacccacccacacatccacttatttacccacccatttcatccattcttccatccacccatctatccatctatctatccactcacctgtctatcaatccatccatccatttatccagccatccattcacccacccacccattcatctgtcctcaatccactcacccatccactcatttactcactcattcatctattctcccatccaccctttcatccactcacccaccatccatccatccatccatctacccatgcatccatccatccacccatccatccatccatccacccatctactcattgacccactcatttcacctattcttccatccacctatgtattcatccacccactcacccatctactcattcactcacccattcatctattctcccatctacccccattcatccaccagtccatccatccatccatgtaacatttactgaaggctcactacctgcctgcaaggttcaggtgagggacagagcaggactgtacaggtgtctctcagcctctaccctccctcattcctgcttccatcttcttctgatctgggataattcctctcctgggagatccaaggatgatggggagcaaaaggcggtggggtgaggggttggggcttcggcactgcctctctactgaggccccagtcccttctctgtatggacaaaatggaaacttgtggtttttcttcctgcattgaaccagcaggctgagctggggctgaactcctgggacattaaaagggggtgagaggtgaagatgcatccaggtggggggtgtgtgtgtgtgtgtgtgtgtgtgtgtgtgtgtgtgtgagagagagagagagagagagagagagagagagagaggaggtggagggcgaaaggcctgtgcatctctgtctctgtcaggcacacagagaatggcagtggtgagcctgcaatgtattgggaagacattattgtttgctcagaaatggccaagaaccccagctcctccctgccaggagacacaggattctgcgcctccaggcacaaccgtcttccctcccttccactttcctccctcctcctcaaacccttgcccaggtgccccccggctggctgggttcaccagaggatagatgaccacatactaatcccagcctcctgtggaggttagtcccaccctccaccgaggtggaaaattcctgcaggtagagtcagcagtggttcaagtcccaccgttgtccatgagatcggactacacagcacacacggccgcttttttttacctaccacgtgtcccacgtctcctacagtcctttaatccctgaccagtccttcagaggatggacacgctctgatctttgtagcctctctttctctcctcagggatcacacctcactgtagaccacagcccaatgtcccaggtgactcacttactagaatttgtaattcacttcatcctgccaccacgcccctgtgagctagacacccaaattgactccattttacagatttggagactgaggtgcagagagattaagtccctgtctgaggtcgcatggtggatgagcagcagacaccctggcgggcagcctggctcctgagccacgcgtcaccaccgtcttagtggaaaatcggccacaaggagggattccccttccagtctcctggcccttgccaaaggatccatactagacatgagaggaggaagggagtccacaccgagtctggcctcaaaccctcattccttaggaaactgcgctaatgtcgccccctccctccctgtgaccaccccaggttgtatctgcaccttcccagctagcccaggtgtcattacatatttatctgttgatcactcggctccagggactgccatatcggcccaggaagtcacgatcttgtctgtctggttaggggctgtggtctggcactgggcacatagtcagtattcaatgaattttggctaaagcccttttggatcgatcatctattgccagtgtggctcagatgcagcccccgccactgactgtgtgactctggcaggtcacaacccctctctgagcctcccttccatcatctgtaaaacagacttatctctgagtcctacacatgttaaacactcaaaggatttctgttgcatgaattagtgaaatccgagctggaagggcctctagagcccagggttgcaaactcatagactccaaaagccaggcaggagccagaaaccaccgagggagctgggtggggacggaggcagctgctactcagctctagtcacaagcactgccatatctggtttctcaagaaaaaccagaaatctagagatttacaagaagtttcccaatttctaagtattggcaactaatttaaaacatttaaacacatctgtggacgggatgtggctgcaggccgtttctttgcaactcatgattcatctaactgctcgtggcacagatgagatcaaagcccagagaaggtgagccaccagccccaggtcacagagcacaggaagtgaagaggaaacagtgacctttctccttcggctgcagccctgttgcccaagctcagggcaacccctgagccctgatcccaagggaggcagtgccgccttctcctctaggcctggcagttccagggtgacaggaaggtcacgatatctctgtttgggtgcactgcagcctccgcttcctgccaggaccaggctgtatcaggcactgggatgaagaaaacattccaagcaatgggctggcctagaaggtaagagctggtggcagagagggggtaagcacaccccttccttacttcagggacgtgcaaaccccttcagcaggcctgggcagagctgggaacagggcggatcaagccctgcttctggagaaacatgctctgccattggaggctgggagctctgtccccgcatggctcgtaggaccttggaatgcatttgtccagcagcttctaatacaccaggccctcatctgacccgcacccccacaacctccatgggctctcctccctctgtcccctcttgatctctctacgcaggcacaatggtgcctgctcagccctgaacacagcagccctgctcccacctcagggcctttgcacacgctattccctctgcctggttcacttcacccattatgcagatggcttactgtagacctctacttgaatgtcgccttctctgtgagaccctccctacctgttcactctgtttaaaaatgcaaacatcccccacagtccttagcctccatctggcttcctttgaccctgctgtgcttaggatggtgggacacatatgttacacgtgtttatttgtgtttccctttcctgttgctgctgtaacaaatcgccgtgaacttgggagctggaaataacatgaatgtgtgagcttacagttctggagggctgaagcccacagtgggtctcagcaggctaaaatcaaggtgtgggcaggaccacgttccttctagaggctcacagggagaatccgttcctccagcttctcaaggccacctgtattcctgggctcacggctccaacctccatcttcaaagccagcaacggcgaggccatctttcccatgctgcatccctccgcctgcaacacctctgcttccctcctgcactaagccccttgtgatgacactgggtcacgatgtcatcatctgggtaatccagggtcgtctcccccagctcaaggagactgctcagcagcctccattccccttggccgtgtaaccttgtacattcacgggttccagggatgaggacgtcttggggaagggcgcatgagtctgctgaccacacacaccaaacacaccaggcgttggctccaggaaggcacgtggtttgctgctttatgtatgtccaatgcctggtgcatagcaggtgctcagtagacccttggagactgcgtgggtgctggagtagaatgttgtggccgccaaagggaggcaggaaaggtgactcagctaccccagtggtcctccccgtcttactgatgaggagactcggggagagctgagatgctgagggctgaagagctgtgacttagcccctacccttccacacccatcctgtgcccacaaagaggggtgggccctgggctgtgtcggggagccccaaagagaaggcctgaagtccggcagctttaaaggggacagtcctggccatgagccctctctctgagcgcccctcacaacccctacaagctcccctcccaaggctaggccagcagtgcctgcagggggctgcccaggcgtggtcctgccatgtgggaactgcctgtgtggcccagcaggacccagatgagtcacaggaaagctggggtgccctccctccagccccacgtgtctccctggcttcaaaggaaaccgactgagggtccaagtttcctcatgactgaaaaatgttccaccccaaaaatgttccacatgagcaacagctcacccagaaagaaagagaaatgaagtaagtggcttttcagcatggggagagacacttggccatgcacagctacaggcagagatctgggaaacagaacgccggggaaagcaagtgaggaacaggagaactctgcaaatcagaacactcatcataaaataattctgcttgtttcacaaggacacatatacatccagggacatatatcatgggcctcggtatggaggctcaaggagaaaacaaaacaaaataatttattttgttttaaattattattattatttgagacggagtctcgctcttgttgcccaggctggagtgcaatggcctgatctcagctcactgcaacctcaacctcccgggttcaagcgattctcctgcctcagcctccccagtagctgggattacaggctcgcgccaccacgcctggctgatttttgtatttttagtagagatggagtttcaccatgttggccaggctggtcttgaactcccgacctcaggcgatccacccgcctcaacctcccaaagtgctgggattacaggcgtgagccactgcgcctggcctaaattattattatatgtttattttgttttaaattatttttatattttacaatggagcttcctgacatgtgacaatgatgctacggttttttgttgctgtttttttgtttgtttttgagatagagtctcactctgtcacccaggctggagtgcagtggcacaatctcggctcactgcagcctctacctcccacgttcaagagattctcctgcctcagactcccgagtagctgggagaacaggtgcccaccaccacgcctggctaattttttgtatttttagtagagacagggttttgccatgttggccaggctggtctcaaactcccgacctcaggtgatccgccacctcggcctcccaaagtgctgggattacaggcgtgagtcactgcgcctggccaatgacactatgcttcactgaacaagcaaaaggtactctgcttcactcttcatttaaaaatagaaactgaaaccatactgagacacctgcttccatctattagagtgacaaaaacatcagaaagttcacaatacatggtgctgatgaagttgtggggaaacaggcaccctcacacattgttggtgggagaataaattggtacaacctctacaaagtgcagtttggtcatatggatcaaaatgtaaaatgcacaaatctgttataaaatctgacttccagagatttctcccacagatacattcacacacacacacacacacacacacacacacacacacacacaccacactatgtacaaagacagtcaccacagtattgtttgtagttgttgttgttttgagacagggccttgctctgtcaggctggagtgcagtggcgcaatcacagctcacagcagccttaacctcctgggctcagtgaccctcccaccttagcctcctgagtagctggaaccacaggcacgcaccaccacaaccagcttgttatttcatttgtaaacatgaagtctctctatgttgctgtggctggtctcaagctcctgggctcaagcaatcctccagcctcagcctcccaaagtgctgggattataggcgtgagcttctgtgcctggtccacagtattgctttataacagaaaaggctggaaacaacctaaagggccatcagtaagaaaataactattaatgaatatggtccggccatgcagtggaatactatgcagctgtgaaaaaggacaacacaggtatgtgtgatgaattagaaagaatgataggtatgttaggttaaaaaaagcaagctgcaagacactgggtgtaacatgcatctatatatgtaaataaagagtgcatacaatcatgtgtgttttcgtacgtacagactttcagtggcagagcccgtgggaaactggaagcagcattgcttagggaaagtgaaacctgggggttaagggtggggagagacactcgttttcattggatacttttttctgtcattgaattttttcccatttaaatgtcttacctatgttttaaacataatttttaaaatataaaagcaatgctcacttgtcacaaaatctaagcaatgaaatgcaaatgatatgaaaccagttgtccctaaccactcccctgaaatcactactattaacatctttccagagttaacaaaaggtcttaagtttagatatgcttctttttttttttttttttttttttttgagacagagtctcactctgtcacccaggctggagtgcagtgaaacaatcttggctcactgcaacctctgcctcctgggttcaagcaattctctgcctcagcctcccgagtagctgggattacaggcgcccaccacaatgcccagctaatttttgtatttttagtagagacagggtttcaccatcttggccaggcaggtcttgaactcctgacctcgtgatccacccgccttggcctcccaaagtgctgggattacaggtgtaagccaccgcacccggcctagatatgcttctatattattcgaacttgtgcaacaggctgtgtgatttgaaattaaacacaagggccaggcacagtggctcatgcttggaatcccagcactttgggaggccaaggcaggtggatcgcttgagtctaggagttcaagaccagcccgggtgacatggcgaaaccccatctctaaaaataataaataaataaacaaatagatagatagataaataaaggaaattgaacacaaaacctcccttttgagtcaacgattatcaaggaggctgttatagttgcagaggtggcctggacagagtggtggccatagagacagagaagtggccagttgtaggagcaaatgtcacaggttcaactgacagggtcagacgcacaggcagggagaaacaggagggaggacatgccatgagctcccttgtctaggcccacactgaggtgacacggcccaagtgccccagcccgacagggtagactgcgatcagggtcaggaattcagtgaggcaggtcctggagcactgggagggggtacgagggtctcagatatctggggctgggactcttgaggtcatagcaagataagtggatgacatactcagtttcaagagttaaaccccagatttacatggctgcctggagtctggattcactggtgtgaaatttggagggagatgacgataataagaatactaatactaacagtaacaataactatcataagaacagaggccaacactctgtagcacttactacaggccaagtgctatatacgtgttaactcataatcccacaatcaccctctagatataggtgggtatagagaagcatgcccccatttcacagatgagaaaactgaggcccagagaggtgaagtaatttgcccacggtcacacagcttgtatgggatagagaagggcagggcgtatcactgaacaaaatggaggtcccttcaccccagagttgcaaacccagcctccctcactcccactacccctctgggcctcactgcatggatggacagtggcaacaacccctcctgggcctccctgactctaccctcgtcccccattccccacaacagtcccttctctatccagcggccagagcgatcttcctaaagttctagtctcatcttcccttggtctgctctcaggcagggccaggcattaggtgaggccagcaggtgccggcacaatgtcaggagacccccctcccaggtgagcccctgctctggcctgattcacagcgaggcctccttaggttttgaacactcagtgtccctcttgcacagatgggaacagacagtctctggaatccccccaaagccgcatttgaagtttctttccaggcagacaggccctttccaggcggatggctgcttcaatccagatgaggatggaggcctggggatctggcagctctgggctgatggcaccacgtccaggggagaggtttctgttttcctgcagtggttctctggcctatgcttgctggatgggggtgttggtaaatcctccagcttcctggggcctggggaggagcaaccctgaggtggactctgcacccactcccagaggccccagcaggacggagccccagctgcccaactgataacctgctcatctagacacccagcagtaccagctgccccctcccctctgctctcagagcttcctgcgatcagctccccgctaagttccctgcccttggactctctaagtgtctgcttctggaagaggcccaagccaagacctgggagacaggtcagtggctcagggctctgtggctcatgatatctgcagtattctctctgtggcctgggtcttcctgtcttctgggtgatccctcggcctttgggaggccgaggtggttggatcacctgaagtcaggagtttgagaccagccagcctgtccaacatggtgaaaccccgtctctactaaaaatacaaaattagccaggcatcatggggcacacctgtaatcccagctactcgggaggctgaggcaggagaatcgcttgaaccccggagggggaggttgcaatgagccaagatcacgccattacactccagcccgggcaacaagagtgaaactctgtctcaaaaaaaggaaaagaagagaaaagaaaagagagaagaaaagaaaagaaggcaaggaagttccatagcccatacagtgggtatcttaggcagggctctatcagatgaaaaatatagcagaaccctgactcaaattggctgatgtcatgagaatttacgtcaactgtctctggtaaaagcaggagtagagataggcttcaggcatggttggatccagatgctaaatcaatgtctacaaagatgcactacctctggctctcatctcttttactccacacagactctccaggtcatgatgtgaccaaggttgccccttgccactcccagctttattctcaccagctcagcaaccccagggaaaagggagcaccaatttccaattgtttcagaacaaggtcagtggcaatgttactcaaactcgaacgtgcccatgttcacactggggccctggggactatgataaaatgcagattctggctcataggtttggggtggggactcagatgctgcattcactgcattttttttaagatagagtcttgctctgttgcccaggctggagtacagtggcatgatcacagctcactgcaacctccactcctggcctcaagtaatcctcctgcctcagcctcccaagtaactgggacttcaggtgcatgccattatacccagttaatttttgtattttttgtagagacctggtcttactgtgtcacccaggctcgtcttgaactcctgaacccaagtgatccacccacctcggcctcccaaagtgctaagattacaggtgcgagccaccccgaccagcccagatgctgcatttctaacaagctcccaggtgctccttgtgctgctgatctggaaccatacgttgagtaggaaggtctttgcatgatgccattcctctcagctaaaagcacattgtaggccaggcatggtggttcacgcctataatcccagcactttgggaggccgaggcaggtggatcacctgaggtcaggagatcgagaccagcctggccaacatggcgaaactctgtctctactaaaaatacaaaaattagctgggcgtggtggcgggcgcctgtaattctagctactctggaggctgaggcagtagaatcacttgaacccgggaggcggaggttgcagtgggctgagattgcagcattgcactccagcctgggtgatgagagcaaacctccatctcaaaaaaaaaaaaaaaagcacattgtatacatatgcagaatattcatctaaagaaaaatcgtaatcaaaattaaaaagtaaaagcacattgtgcacacacaggaaactattgctgcatcccaagagtcccgcatgcagtagctcatcaactggtcacaaggacgttagaggtgggtgctctcattacctcatttctccacaaggcccagacacattcccaagcctgcacagctgggaagcagcgaagctgctttgaccccaagtaatgaattctccagatggaataaacaagggccctgctgatggcccttaatgctctttgcaatcctcctctattacaaaaccaccgtgctgagcaaccccacaggtgcgtgtgtttgtaagcatgcactagtaggtttggggaaagagattcctacaggcgaaattgctgtatcaaaagatgatgtatggttctattattgctaggggctgccaaaagggaaagagactgcccatttccccacatccatgccagaactgcatgttcttgtttttgccactctggggagaggcgcccttcctcatggccctaggaaggtagtgaagttatgtcccagccccaggtaggcagcctccttcctgcaaggggtcatccagggagcaccctgtgccagcccacctctgggcatcctgttgtcatggaaatatttcaaggcctgctttcatcctgaatagcaacttcagtggaaagagaaggcctctgttatgggctaaattgtggtccctcaaaattcatatgttgaagtcccaacccccaagacctgaaaatatgactgcatttagagatggggtctttaaagaggtggttacgtttaaatggttgttagggtgggccctaatccagtctgcccggtgtccttataagaagaacagacctcaggagcgcacatgcacagagggatgaccgtgtgcagaggcagcaagagggtcgccatctgcaggccaaagagagaggccttgacggaaatcaaccctgacagccggcatctcgagcttggacttccagcctccagcactgtgagataataactgtgttgcttaagccacccggtctgtggtcttttgctatggcagttctagcgaacaaatatagtctctttccctgcacacctagaagagttcctgggaagatgcccatatgcctggcttggttcacttcccgtctgttaccaattgctgtggccaccagatgctgaactctaatcggtcaggccttggccaagtgctcatccctggagctagggatgggctcagcctgccaacctgggttcacttttccttgtttgattaaaaattttaatttaaagcaagtgacggctggatgcaatggctcacttctataattccaaccttttgggaggccaaggtggaaggatcacttcagccccagagttcgagaccagcctgggcaacacagcgaaacctcaactctacaaaaaatatttaaaacttagccaggtgtggtggcacccacctgtggtcccagccacttgggaagctgaggtgggaagatcactcgagcctgggggatcaaagctgcagtgagctgtgattgcaccactgcactacagcctgggtaacagagcgagaccctgtctaaaaaaaaaaaagaagaaagtgaggtcgaacctgtggctaacaaggggataatttacatgtctgagctcaagttcagatgtacaagttggattctcttttcttttttggggggtggggacagagtctcactctgtcgcccaggctggagtgcagtggcgtgatctcggcttactgcaacctccgcctcccgggttcaagcgattctcctgcctcagcctcccgagtagctgggattataggcacccgccaccatgcccagctaatttttgtatttttggtagagatggggtttcaccatgttggccaggctggtcttgaactcctgacctcaagtggtccacccgcctcggcctcccaaagtgctggtattacagacgtgagccactgcacctggccatcaaaattagaagtctttttaaaagtccctttgatcccacccatggtaggcaaaccctacctcaggcatcgggtcaggctgcaatttccaactcatatctgcttttagcccctggagatttcacttaaatcctgtgagctcagccatctatccccaagatgcagttcctccaagatacctggcaggcaccctggcaggagggtgtcacggttctctaacctggctgactactgagcctctgggctccatgaggacaggatgtctctctcactcgctgctagcccagtccctggcacagccctggggcttggcaaatatttgttgaatgaataaacaggctgtggcttataagctggttcagattccagctccccactcactccgcatggaagaatcacttcaatcctccaagccccccgttcttcatctgcatgggggatattttgttgttattgttgttttttaaacttgggatttttttttttttgaaaaatagaacagatacagatacaaaaaccacacagcataagcatgtgacttaatgatttattataaggcaactgaacaccctcgtgaccacctctaggtcaagaaatgtaactttgcctgccacccctggaaacccctgcagaaccctgtcctctcaaagccctgcccctcccaaaagtcactgctaccctaagtgttatggatatcacttgtgtttctttcttgttttaccaaccatgtgagcagccccagacactatacttaatcttgcccactttttaaaaacttgatgtctcttttagtttctattcctcctccatccctttcttttccttacaatttacctgcgcagtacctgggccatttaacctgcagagatccctgggtctgggttaggctgatgacagcaccgtgtcatggttcaacacgttctgtccttgggattttctgtaaaacggcagctggatcctgaggctacaccagggatgtttccaagcttctgccctcacgggtcgtggtgagaattgaagggggatgggtgagtgtttgatatcagcgagcagcccccagaagcagccgccaaggctgttcggagatgctcacgaggcctgaacatggacagcccgagggacatcccatctcaacagtccatcctggcttctctccccacccagacccacccaccccactttgggaaagttctagggccatggctggctcatcccagcgagagctggcagcagaatggcctgtaattttagctgtttctcttccctaaaattatttcccatctggaaatggtttcccaaccctgcccaggaaagagttggtggtgcaaggaacatttttctattaaaaaaaaaaaataggggccgggcactgaggcaggagaatcgcttgaacccggcaggcggaggttgtggcgagccaagatcgtgccactgcactccagcctgggcaacagagcaaaactccgtctcaaataaatatataaaaccagccaccaaacactgaatctttgcagcccaggctctggaggcctggctgagtgccagctgtataccctgccttgagggaactctgtcagcgaggagcagagggtgagagggcatagtcagggctctgctgccaggatacccccacccacccagtacattcggacaaggactttgttgcagggcctgggacagccccaggcgagctgagaaggatccgacctggggttgagtggcctgcccagctgctgccacactcgaggtctgtgggttattctaggtcccacagggcatgaaatcacagagcagaagttcttcctatggggattctcttgcagctgctctgagcatttcaagaaaaaaaaaaaatccctgccgctaacatctccccatcacctcgctaattctcttctttctttcctttttttttttttttttttgagacggagtctcgctctgtggccaggctggagtgcaatggtgccatctcagctcactgtaacctctgactccctggttcaagcgattctcctgcctcagcctcctgagtagctgggattacaggtgcccgccaccacacccagctaatttttgtatttttagtagagacggggtttcaccatgttggccaggatggtcttgatctcctgacctcgtgatccgcccacctcggcctcccaaagtgctgggattacaggcttgagccgccgaactctcttctttctaacaaagttctcacaggcccctgactcctgactgtgcaagcaagagcatctggcaagaatatcatgatattttttagcacttcttgtacttattttcataattttttttttgagacagagtctcactctgtcaccctggcttgagtgcagtggcaccatctcagctcaacctgcaacctccgcctcctgggttcaagtgattctcctgcctcagcctccttagtagctgagattacaggtgtgcaccaccatgcctggctaatttttgtatttttagtagggacaaggtttcaccatattggccaggcagtcttgaacttctgacctcaggtgatctgcctgccttgacctcccaaagcgctgagattacaggcgtgagccgccatgtccagccttattttcttatttccttttttttttttttagacggaagctcactctgttgcccaggctggagtgcagtggcatgatctcggctcaccacaacctccgccttctgggttcaagcgattcttctgcctcagcctcccaagtagctgggactacaggcatgcgccaccatagctggctaatttttatatttttagtagagttggggtttcactatgttggccaggctggtctcgaactactgaccttgttatctgcccacctcagcctcccaaagtgctgggattacaggtgtgagccatcgtgcctggcacccagccttattttcataactgttttcatgataaatgatataggttttccatgtttgctaatgatataaagtttcctctgcagaaacaggtttaaagaaaaatgtgggcagaaagtccgtttaaaatatatattaaggaaaataaaacacagatagcacaaaatccaaagctacctggagttttggtgcctggagccatggtgaagagggcatactccagatctgagggcccaggcttgcattctggctgtgactctgtgggccctgtgattttaggcaagtcacttgccttctctgagtcatggtgctttacctgtaaaagaaaggaaaataataacacctccttcctatgatgatctctgagaattcaataaaacaatgctgagaagacactcagcccagtaccaggcacatgggttgcatttaattctgtcagaacacaaggtgggtgctatttttattcctgttgggaagctgaggcccagagaggtcatctagcccatccaaggttgcacagcttgtaggtggtggaggtggaactagaacccacaaagttctaatgtgagactgggatttgtgctcttaaaccactgtgctgctattggcagatccatctatccacccatccatctgtccgtccatccatccatccatccatccatccacccacccatccatccatccacccacccacccatacattcattcatttggtcagaattcatggaattgttctgagttcatggtgttttctcaaaaagcagcaaagtgcagaagttcccagagtaggttcaaatcccaacctgccatgtacaggacacctgggcaagttgtcccacctctccgagcctcagcttgcccatctggaagaggggaacattgatagccctttgaaattcccgcaggaggtagaagactgttttctgggacttcacagtgtcctacgtgccctgcatctgaccccatggtctgcgttcacctctaagtctcagtgaatcaagctccgccatatgtctgcctcatcctgcctccctcctccctttcactccaatttagccagactcagccattggggttccctgaacagcccctgggcctttgtacactttgttcctccagcccgaaatgtcctcttgcttccatctggtaaccatgattcctccctgaaaaatcaggtgggcttccccctctgccccaggagcatcccctgaggctgagccaagctctgcctttctgggctcccccagctccccgcttctctgacatggaaaggtcatggatgtaataacttagacaaactcttgtgctctgccactgtccaccttcttggtcacaaatgtctgcttcccttctttcatgcaggtacatgcacccctctgcaaacgagtccacacacatgtttttacacaatcatggcatgtgatccgaaggcatgagatctgccttcgtacatgcaacatgcaatggtggaacggcattacctctggctagtgacctctcctggactcagctatcacctctgcagaaagggggcagtaacaggacctgccgcacatctgctgtcatgaagaccacatgagctaatatatgtgggaagcccttagcacagcgcctgggagagcataagcgctcgatgcaaggcagaagaaaggcgtgtcctggtgtgacagggcccttccgaccagggctggtactaaggtgagaaaagcgaggtgcctaccgtgcaaaatgtaaggcagcgttcactctcagagcagtgcacctgccgctgggtcctcggagccacagagcagtcccgctcgccccctgctggtcactctgcagaatgacgtcccttccctctgctctcaggggtccctgagcctcggtttcttcacctgtaaggtggggtaggagaatctgcctctcagtttgcagggcaaacaggaggcactcctccaacatcagtgtcctcctctcaatgccagcacttaatgagcacctactatgtgcaaagaaagatgactgagacatgatccctacccttcaggggtttagcgagtggagaggggaggaggtaggctgggaacagtgactaaagtaagacacttgtccctatgcagcacctactgcttaccccagagcagtcagaaccactgccctggcatctgtccatctgcatatgtttactaagcacctactgtgtgcctgagcccaggctcagctgtggatttacatggattaaggggtttaatgctgtcagaacacaaggtgggtgttctttttattcctgttgggaagctgagggccagagaggtcatctagcccatccaagcttgcacagcttgtaggtggtggaggtggaaccagaacccccaaagttctaatgtgaggctgggatttgtgctcttaaaccgctatgctgctattggcagatccatccatccacccatccatccacctacccatccatctatccaaccatccatccatctatccatccatccccatccgtccatccacccacccatccattcattcaacaaatattcgttgagcacctactgagtgccagacacagtgctgagtgctggagagatgccagtgaccagaaagacacagcccatccctgcccccagcagctgttcacaaagagaggatgggcaataagcaagacaaataagtaaaatatatggcacttggtgattcttgctgtatataaaaatagagtaaaagctgtgcacggtggctcacacctgtaatcccagcactttgggaggctgaggcgggaggatcacctgatcccaggagtttggaaccagcctgggcaacatagcatagtacagaccctgtctctactaaaaacacaaaaaattagctgggcatggtggctcatgcctgtagtcccacctacttgggagactgaggtgggaggattgcctgagcctagtcgagatcgaggctgcagtgagccgtgattgtgtcactgaactccagtccaggtgacacagcgagaccctttctcaaaaaggctgggcgcggtggctcacgcctgtaatcccagcactttgggaggccgaggctggtgaatcacttgaggtcaggagtttgagaccagcctggccagcatggtgaaaccctgcctttactaaaaatacaaaaattagctgggcgtggtggcgtgcctctcaggtactcgggaggttgaggcacgagaatcgcttgaacctgggaggtggaggttgcagtgagccgagatcgcaccactgcactccagcctgggtgacagagcgagaccctgtcttaaaaaaaaaaaaaaaaaaaaaaaaaaggcagcacagaagactgagagggtggggctggagtgtgtttcaattttaaattaggccttgagggccattgagggaccttggctctcattgtgagtgagctgggagtcatggagggttctgagcaggggaggagcctggcctgacttaggcccttgcagaatcactccaccaggaggccagagtgttaggacccagggtggaggctgcgagctcggggaggaggtgaccgcacacaggatggcggctgggcttggcggggcagtggagtggggagacagagtctggatgtatcctgaaggtggaacagacaggattagctggtggatgggacatgtcggtggcagacagagaggagtcggggatgaatgactccctgagcctctggggagggtggagctggctgcccttaaggctaagaaggctgtgggcagagcaggtttctgcgggagatgaggagtgggttgcggatgcattcaccctgagttgcctggcagtgtggacgtggagtttgggtttaccctcgtgttgacaggtacacgctcgcggtgcggttatcacgctgctgctggtgtcaccacgcgggcgctgcagggacggacctttcccatcgccaggctcttcggggactgctgcaatgccccgtgcagccgccagggagcgcccgagccgcacccaggacgcgcggggaccgggtcatcccgcgggctacctgtgcggggcaggacgcttagccgcacccttggcctccgactactcggagtctgttgcattcctccttccccccgcgcgccgtgtgacagccaaaactgtccccagacattgccaggcgccccctggaggggaaagtcgcccccacggcagtcagagccatggcctgcgcagccacattcatttactgagcgcctactgtgtgcctgcgtctgggctccgcaggggctcacgggggtttctccttttcatccaggtttctgttcagatgtcaccacctcagaaagaccctgtcctagacacgctccattcaatgacccgaaaggatcttgttgaaatgttaacttattacatttttgggtttttgttgttgttgtttttggttttgctttgagacaaggtcttgctctgtcacccaagctggagtgcagtggcacaatctaggctcactgcagcctcaacctcctgggttcaagtgatccttccacctcagcctccaagtagctgggaccacaggtgtgcaccaccacacccggctatttttttttttttttttttttttagtagagacagggtctcactatgttgcccaggctagtctcaaacttctgggttcaagtgatcctcctgcctctgcctcccaaagtgctgggattatgccactctgcctagccttctttattgtctgtctcccctacccagcagacaaacccctgccctcttagagtgcaacttccagtgagccagatggtcacctctttgaagtggtggcatttgagttgtgccttgaaggatagaagctgccgatcatggcagaatttgaagaaaggtctttcctggcagagggaaaagtcagggcgaaggcctaggggctgctcaagtccctgccttaaggcatttagagcgtcctgcccagtgggtgatgggtccccaggccacacacagctgctggccgagcgccccaagtcatcaggaagccatgtggtgtggacaagggccaggcagcctggacacacaaaggcccattgacagctgcatgggaaaagtccagggcacccaagccggaagcccaaggctggtccctcttgtcaactcccaaggagctttgggtggggacaatagaaaagccagaccttctcaggagactcaagtttccctggggtggggcaaaaatgcaggtggcctggtcactgggacatgcagggcagctgtgtgaggcttttgcagtcccccagccctggttctaagtctagccctgccccctgctagcagagtgaccttggtcatgtcatgctccctctcagaccctaagttccctcatctctaacacagggtgaaagctgggtgcagtggctcacacctgtaatcccagcattttgggaggccaaagtgggtagatcgcttgagtccaggagtttgagaccagctgagcaacatggtgaaacctcgtctctacaaaaaatacaaaaattagctgggcatggtggcacacgcctgtagtcccagctactcgggaggctgaggtgggacaatcacttgagctagcaaggttgaggctgcagtgagcgaagatcacgcaactgcactccagcctgggcaacagagcaacactcagtctaaataaataaataaataaatacaatggggtgaaaaatagaagcaaccttccagcaatggtgtgagactgcctgggtagagtagtgggaaccaggcctgattcagcaggtgtttaagagcaggtggtcagttccagcagtcagctatagtggctggctggagtggccatctgtggcggtcagtagtggtggtcggtcatagtagtcaactttcatggtcggctatcacgacactaagcatgaggaccgtcaggtgagcatggctggggtgtttggtcagacagacctgggttccacaggtctcctgctttccagtgtggggcagatatgatctcctttttccaagcctctgttcctccatctgtaagatggggataatgagagccctacacagggcaatgactgtgaagcgcccagcactgggattatagaatgttccagggctttggagggcagcctcagaagagcaggccaaggaaagcgcaggcctcccgactgaaggaggtctgcagagccagcaggtaaagagtggctataaacgaacaggagctgggcctccctccgcgggcagtggggacgcatgagggcatgttcccagcctgatagcaggaagcatttctggaaaagcccagctgaatagtgaagatagcagagcaggaatgtgaagaacgcagacctgggatcagcttgctgggctcaagtcccctgtactagctgtgtgtccttgggcaagttacttgacctctctgtgccttggtttcctcatctgtgaaacagggataagatcaacctaactaggctatggggttgatgtgaggtcctgatgagagaatatttctacaaagaatgacagataggctgagggccttaaacgatgacgcaggccaggcatggtggtgtgtgcctatagtcccagctactaaggaggctgaggtaggaggatcgcttgagcctgtgaggttgaggctacagtgagccgagattgcaccactgcactccagcctgggtgacagagccagaccctgtctcaaaataaataaatgatgttggactgagaaagcatcaacactcacccaggctctggggggaaggtggatgtgagcaaggccaggaagagccaggaggaataggaggcaacccctgtatgtttgtgtgagcgcagccaggtgccagggtcgggggcggcaggagcagaaaccctgagaatgtaaaacaattcagcagcggccgggcacggtggctcacgcctgtaatcccagcactttgggaggccgagacgggcagatcacgagatcagaagatcgagaccatcctggctaacacggtgaaaccccgtgtctactaaaaatacaataaaaattagccaggcgtggtggcgggcgcctgtagtcccagctactcgggaggctgaggcaggagaatggtgtgaacctgggaggcagagcttgcagtgagccgagattgcgccactgtactccagcctgggtgactgagcgagattccatctcaaaacaaacaaacaaacaaacaaacaaacaaacaaaaaattcggcagcagtggcaatggcctcagggactctgagagctactaacacagccacctggacccacataggaaaagcaagcattctgagatcggaagtatgaactttggcctgggacaatagggagccactgaaggtttggtagtcaagggtcagcccctcttaccctgagagttgatataactaggatactccacagcttcatccccagcacctacctcggggcctgcaacatagtaggtgctcagggaaatgattttaaatgaagaaatgcattaatgggtgaatgagaaactggctactaaaagctggccttattttgcccttcacccacatagcactgggtacctccagggacttagatacagagggaccagcaaaggtaaatgtccggagtgggaacaagctcagggagacagaggagcagtgaggaggccagagaggctggagtagagaaaacaaagggagaacggggaggggaggccccgcggaggtgagccggctggacctctcaaggccttgcgagtagggaatagcgctttcttccaagtgcagtgggagcctccagagggtttggtggttgtgtgtgtgtgtgtgtgtgtgggggggggggggtttgtttgattggtttgttgttgttgttgttattgttgttgttgtcgtcattgtttttcagacgaggtgttgctctgtcacccaggctggagagcagtggtgcaatctcagctcactgcagcctcgacctcacaggctcaagcgatcctcctacctcagcctccagagtagctgggactacaggcacgcaccaccatgcctggctattttttttattttttgtggagacagggtctcgccatgttgccagggctggtctcaaactcctggactcaagcgatcctcccgccttggcctcccaaagtgcttggattacaggcatgagacaccatgcccagacagttgcattttaaatcctcctatcaaagagcataggcattattatccccatttcacggatgaggaaactgatgctcagagattgaatgatttacctaaggtcacacagctacgtagagacagtgccaggattcagcctcagcccattgggctgtgggatctgcagggctggaggggatagaacaatgccagctggagccagcactgctccccatctgctaagctctgccctacgacctctaggtgacactgggtgttggcaggcatgaaggacctacaccgtgggactgtggggaacacgaccaggccctgatcagtaggtctgctgagtcaccaggcctggcccagagctaacctccggcagccaggagccgccccagggtccgtccttggtgccctgcccagcagctgccaagcacagccactgccacatgagctggatgtcctgcagaagccagagtgacaaactacccccaaatctgccctcctccctgtgctgtgtggcctctggcaagtcccctgccctccctggcctgcggtgcacctgctgtctcgtgcaagccccaggccgcagtgcccctccctttgtgctgggtagaatcctggccaattgctgataccgagtttagaccggagggcagaaaggcgggacaggtaagtgcagacagtggggaaggctgtgggccccacaggactagactcttgtgggtgtggcggaggacaaggctgcccatcagagccccaggggcccaggctccacccaggtaacaggacac

SEQ ID NO: 72 - DNA, 18527786 bp, Homo sapiens (residues 1-2,058,643 of 18,527,786)
  misc_feature (4041202)..(4061201): n is a, c, g, or t
actttcttgaagaccaccatagagcagttaaaaatttttcctaatgagtatagatatccttttactttcttatattttcatgagcatttccccatatcattggatgctattgaaaaatatcatttccctccctcccttccttccttccttccttccttccttccttccttccttcctctctctctctctctttctttctttcttttttttttctttctttctttctttctttctagacagagtcttactctgttgccaggctggagtgcagtggtgcgatctcggctcactgcaacctctgcctcccgggtttaagtgattctcctgcctcagcctcccaagtagctgggactacaggtgtgcaccaccatgcccagctaatttttatatttttagtagagatgggtttttaccatgttggtcggcatgctctcgatcttctgaccttgtgatccacccgccttggcctcccgaagtgctgggattacaggcgtgagacatcgcgcccggctgaaaaatattattttcaatggcagcatgatatttctccttactgacatctcttattctctccattcctctaatatcagacataatatttccctgttgcaagtgaagctgaggtgaacaagcttgtgcctaatctttgcgagtatatctcattattttctcaaaattgattcctagaaatggaatgggctgactcaaatgctttttagtcatcatgattattttatttatttatttatttttgagacggagtcttgctctgtcgcccaggctggagttcagtgacgcaatcttggctcactgcaagctccgcctcccgggttcaagccattctcccgcctcagcctcccgagtagctagggcaacaggcgcctgccaccatgcccggctaatttttttgtatttttagtagagacggggtttcaccgtgttagccaagatggtcttgatctcctgacctcgtgatctgcccgcctcggcctcccaaagtgctgggattacaggcgtgagccactgcacccggccatgatttattttcttacaatttgtggcaatttctcaataccatcagcaatgggatgaaagtgctccttgccaacattgtgtatgatgctttttctctctctctctctttttttaagccaaggtctcactctgtcacccaggctggagtgcagtggcacaatcatggctcactcagccttgacctcctgggctccagcaatcatcctgccttagcctccccagtagctgagactacaggcatgtgccaccacacctggctaatttttaaattttgttgtagagattggggactcactatgttatccaggctgctctcaatctcctgggctcaagcaatcctcctgtcttggccttccaaagtgctgggattataggtgtgaacaactgagcccagccaagtatgatgctttaaaaaaaaatctgctaatttgagaagtaaatgatgataatatattttttttgtttgtttttgagacagggtctcactccattacccaggctaaagtgcaggggcatgatcttggctcactgcagcctcaaactcctaggctcaaaggatcctcttgcctcagcctcccaaatagctgggactataggcatgcaccaccagctaatttttttttttttttttttgaaacagagtcttgctctgttgcccaggctggagtgcaacagcgtgatctcggcgcactgcaacctccgccttccgggttcaagcaattctcctgcctcagcctcccgagtagctgggattataggcacccaccaccacacctggctaatttttttgtatttttagtagagacagggtttcaccgtgttagccaggacggtcttgatctcctgacctcataatccacctgccttggcctcccaaagtgctgggattataggcgtgaaccaccacgcctgactgctaattttttaattttaatttttagggatgaagtctctctacattgcccaggctggtctcaaactcctggtgtcaggggatcctcccaccttgggcccccaggatgctgggattacaagcatgaattacctcgcctgtcaaatacatgtttttaaataagtgtactgcgtgcagtgcaccagccactgtgctaagcacagaggatacaaataagtaacataaaacccggtcctgggacctaggtggtagttttggtctgtcaagggattttatgacctcctcctggctctaagactttaatatcactgttttcttggccaggcacagtggctcacgcctgcaatcccagcattttgggaggccgaggcaggtggatcatttgaggtcaaggagttcgagaccaggctgaccaccatggtgaaaccccatctctactaaaaatacaaaaaaaaaaaaaaaattagctggccatggtggcacatgcctgtaatctcagctactagggaggctggggcaggagaatcgcttgaactcgggagacggaggttgcagtgagccgagaccatgccactgcactccagcctaggcgaaagagcaagactgtgtctcaaaaaaataaaaaaaaaaagagtattgttttctttatttcagtattactatgtatgggccttacaaatgggaaagcatttcacacccattccctgggtaaaccctcacagcagccctgagggaagcaggcagggaaacgaggtcctgagggtgaactcacttgcccaagatcacacagccagttaagtgcctgaggaggaagcaattagcagccaactcctgtctggctttcttcagaaaacatcaaagatgtgaatttagaagccattagcttgatcctcagcccttagagcctccctgaggtcccagagttccatccattctgaacctgggcactccgccaagtgagaagcatcaagcacagctcaggtgcttggcttcagtccaagccctacatcttgtttcttcctgaaaggggcgctgggatgtcacctccttgcattctaataaatagttccctttgcagtctttttatacaacccctcttcagccctcctccccaaatggtattaaatttccaggaatactgaactctctcaccagcatgacttctcacatttacagtgattgctttgctggagggcaccatgactccactgataaagaaaggaaagacagccaccattcatggagaacgtactaagtgcatcttttttttttttttttttttttttttttttttttttttttttgagacagaatcttgctctgttgcccaggctggagtgcagtggtgtgatctcagctgattgcagcctcaacttcctgggctcaagcaatcctcccatatcaaccttctgagtagctggggctacaggtgtgcaccaccatgaccggctaatttttgtattttttgtagacacagggttttgccatgttgcccaggctgatcttaaacatctaagcttaagcagtccaccggccttggcctccctaattacaggcgtgagccactgtgcccagccccagaccatattttagttaatcctcacaacaaacctaagcagttgcatttctagctccactttgcatatgagaaatgtgagtcccagagaggtcaagtgatgtgcactgggtcactcagctaacacataaggaatggagctgggattcaaacctttgactgtctggaccccgcagtccatgcttgtcattttcatagctcagagatgcactgtccaatgtgataaccactagctgcatgtggctgcttaggcataaattaattaaaattaaataaatacaattcagtttttcagtagcactagactcatttcaagtgctcaatagccacatgtggctgttggctgccttattggacagcacagatatagaacatgtccaccacggtggaaagatctgttggacagcgctgctctcaaatgtgagagaagaaagaaaacatcgtgattttacccttgcatggggagccaggccatctgccacttgtcagctttgtagagagttcatcggaagttatttttcctggatgagatcataataaaaccatccatgggtgtctgggctatgttttacctttctcctggtttggcctccattcatccccatccatgatagatgcaagcatgccctttcccacactcccctgctgccacccagtcgccaggtatctagtgcctttctctgtcatacaggatttgggttatcttagtcactaaagtggggcatcctcacaggacaactcagatggagactgagcaaaattttataacacagtgggcttaattccagctgggtggtccctgggcgacatgcctgccactggggaggagggtcctcactgactgacgttgaggaggagggctaacggagtttcttggcaaaggggatgtctggttataaagggattcttccccccgcttagcaacagaaccccctccctatgtctggggactccttactttgtgaacggaaggcagtcttcttcctaccatagaagccaaaaggtcagatgtttgtctttacagcttccactgcaggtaggagatgggcatgtgatcaaggatcaaccaattaaggcttgggttatagaggtcgagactgtggggaatccttatggagagggaaggtgagaatggtcttgagacagtgcccatggccaggtagccatggtgaaagcagggcaactagtgttctcaccatacaagtccagtagtacatggtcccacgtggcctcgcctttcttattagtggccacttctagaaacttcctggtgattttgtggccttcctactaccctgctaataaattccttttctgctaccatcagaattggtttctattatttatgatatctattattatgataaactgacacaatggtgctcgctggaattagatcatttctaggctagagtttgctcttggggaggtaggaaggaggatctctgctctggtccatgtgatctctccaggaccctttttttccagccccactggcctccttcctctttttgcatcctcaccatctctccccttcattgaactgagcaaatctccagaattgagaggtttggaagccctactctgacttttcaaaacttctttcattccctgagtctcctccccaagattctggggctcagaaagtcctttctctatttttctactgaaataactcttttctgagcaataaatacctcacagtccaggttagatggaaaagaggacacagtatggaaaggaaatgccaggagtggaaacatacttggtaatatagaagttaccccatcatactagggtgaccactcatcctagtttgcctggactaaggagtttcttgggacatggaacttttggtgctaaaacagggacagacctgtgcaaactagaacaagttagtcaccctacaactgtacagctactactactaatcccacttcaatacacagctttattcagcttgctaaggacagaatcaagaccagaccgtcatcaacaatgccttaccaaagttcttttttcggccaggtgcagtgagtgggtcatgcctgcaatcccagcactttgggaggctgaggcaggtggatcacttgaggtcaggaattcgagaccagcctggtcaacatggcgaaaccctgcctctactgaaaaatacaaaaatgagccaggcatggtggcacatgtctgtaatcccagctactcaggaggctgaggcatgagaatcacttaaacccgggaggtagaggttgcagtgagctgagattgcgccacagcactccagcctgggcaacagagcaatattctgtctcaaaaaaaaaaaaagttgttttaattttcatttctttaatatgagtaagcataagtatctttccttttcctatgtttaaaagcaatattttctattccttttctctgaactatctgttcataccttttacctacctgtttaaaaaaatttttaaatagtttttgtacatatttatggggtacatgtgcaattttgttacatgcatagaatgtgtaatgataaagtcagggtatttaggttatctatcacccaagtatttatcatttctatgtgttgggtacatttcaggtcttctagctgttttgaagaacacaatacatttttgttaaatagcagtaaacacatccagttaaacatagtggattgatgatgcgtatttatttttttctccctcgaaccccatctatatggcaataaggaataaaaaatgtattaacccagaacatgaataggaatgaaaaggagacattagtggcccagggatttcagcaagtttttagaaaacagggacagaaggggaagtagtaactgacttaacagggggaggaagttatgacccaaatgtctgcagggaatattgatttgatgactaaaaggtgagcccagattcttccatagaagagatagacactaaaaataaagatatggatggaaatctcccacagagtagaacaaaagagccaaaaagagggacaataagagaaaaacagagaaaattagaaactcagtttggaaagtataacttctgactaagagaaattccagaaagagaaaaaaatggaggggagagccaagtctggtgtctcattcctgtagtcccaacagtttgggaggccgaggcagggggattgcttgagcccaggagtttgagaccagctgggcaacacagtgagaccccatttctacaaaaaatagaaaaattactcaggcatggtggtatgcacctgtagtcctagctactcgggaggctgaggtggcaggatcacttgaagctgcagtgagccatgatcatgccactgcattccagcctgtgcaacatagcacaacactgtttcaggggaaaaaaaaataggaggggagaaaattatcgaaaaaataatacaagaaaatttcctagattagagggatataagtctccagattgaaaaggcccagctaacacaagtgaggaaaagcctcactgaggggagtcatcatcaaatacaacattatggataaagatgatagcctaaaagttttcaaagattaaaaataaaaaaagaacaagacacatataaagcaacaggattaagaatggcattagatgtcttaaatctggatactagaaacaataatgcaatgttttaaaaattctgagagaaataattttcagcctagatttcttttttttttttttttttgaaatggaggctccctctgtcgctcaggctggagtgcagtggtgcaatcttggcttactgcaacctctgcctcctgggttcaagtgattatcctgcctcagcctccccgagtagctgggactacaggcatgtgccaccatgcccagctaatgttttttttgtatttttagtagagacaaggtttcagcatgttggccaggctggtctcaaacacttgacctcaggtgatctgcctgcctcgacctcccaaagtgctgggattacaggcataagacatggcgcctggccttcagcctagatttctataccctgctaaactattaatcaagtgtgaaaacagtataaatgcatatttagacatacaaggactaaatatatttgcttctttgcaacctttctcaggaatctacagaaagatgtgctgcacagagatgacagagtaaatccacaatctagaagtttgagacacaaggtccagggcacagggaatcccaaccaggtgtaggatataggaaagttcagtatgacagctgtgcagtaggcctggagagcactggtccagatcagagctgaagccttcaggagaaaaaaacaaaagagaactcatgaactttttttttttttttaagttgttgttgtttttgtgagatggagttttgctcttgtcacccaagctagagtgcaatagggttatttcgggtcactgcaacctccacctcctaggttcaagcaattctcctgcctcagcctccaaagtagtggggattacaggtgcctgccaccactcctggctgatttttgtatttttagtagagacgtggtttctccatgttggccaggctggtcttgaactcctgacctcagggtgatctgcctgcctcagcctcccaaggtgctgggattatgggcatgagccaccatgcctagccgaattgttatgttacacatctggaaaaatcactgctgattattttgtctaatttattaaccacataggaaaaaattaacaatatctgcaaagaaagctaatgaaaggggggaaaaaatgaggcaattattagcttcaggaaataccaaaagaggctgggtgcagtctcttttggtatttcctttattattttatttaaaaataaacttcttcactgtagagaaagtgtaaatcaaattatgtgggagttttaatgggccaggcctgagaatagcacacatcacatttaattggccagaacttggtctgaactgtaaggaaggctgggaaatactgtctagttgtgtgtccaggagcaggaagaaataacgtttttgagaggaagtagcaatatctgccacaacaggcaaaaagtagttgtaggcagatgaagaagaccatctcaggtattcatttattcaaggagcaaaacatatttgttcagcaactactattgactaagcttggttccaggcatggtggatacaagagtgaacaaataaaagactgctcttatgcagtttctatttagtggggaacagcaggtgtaagttccatgggggttggaacctgcccttctaggccagtgtggttggaatagagttttaacgaattttgcaggaagtaataaggacttcatatttgattctaagagcaatgagactccattaaatcgagtattaatcagaaagtggcatgatctgttttatttatttatttatttatttatttattttaatctttatatctgagacggagtttcgctgttgtcgcccaggctggagtgcagtggtgccatctctctcactgcaacccctgcctcccgggttcaagcgattctcctgcctcagcctcccgagtagctgggactacaggcatgcgccaccacgcccggctaattttttgtatttttattagagacggggtttcgccatgttggccaagctggtctcgaactcctgacctcaggtgattcacctgcctcagcctcccaaagtgctgggattacagcgggagccaccgcacctggccgcatgatctgttttaaataattactctggccaccttatggaaaatggattgttcggacagagctggacaaaagaatggaaacagaccagatatttcaggcaggctagagatgagcgtggcctggccttgcctggggcggttgtgactgactggattgggtgaaggacaggaaagctacaacaagggtgcctataggtgttcgtattgagtcactgggggcaccctaaatgggagttacctcagtagcagtttgagacaccagtcagataatggatgtgaaagcttttagaaaggttgaacggcggctgaaatcgcgtgtgttccatttacagatgggaaactgaggcacgagataccagaggatggagtcaggccacgttgtgcgccactctccccgcttaggtgggtgaggagaccgaggtgtgttgggcccccgctaaacaccagcaccgacctgagccccgcccagacccctccagccggctttccctgtcctctgctcgtgtgccaataaagttattgaaattgacaccggttgctaaggaagtgggtcgccgagccaggttgctaaggaagtgagcggccactgtctctccccatccggggcagcggggaatggctgagccaggggttcgccgcccccgccgccgccgccgccgccgccgccgccgccgccgcccgctttcggctcgggcctcaggtgagtcggaggggccgggcgcccaccgagcagggctaatcctgtggccgcctggggttttccctgcgacctgcgcccgcgcctctgcctggctttgctgtcccgcgagccggagcatcctctgccctgcctcctaggcatcctttggtagtccggacggccttgcccctccttcccctggcagggtcgcggcccgacccccagacacggccaccttgggtcgcagcccacctgggggccctgaggcggtggtcagggccccagtttgggaggagggcggggaagcgagagcctggggtccgaacctcggcgctgtgctgggcttgctgtgtgaccttgggcaagtcttttcacctccctggccttagctgacctgtttattcaatggggtcctaacattgctgctcagagtggtaaagataatgagaagtgtatgtgaaagtgccctaaatggggagagggagaattcttagggcaccctagatgggagaccaagagggcagtttgaagtctgagcgagttagagacgtggcatttccacttagtaactgtgtggccctgggcaagttaatttctctgagtcttcttttccttatctgtgaaatgaggtaatagactactgtggaaatcagtgagactgggtatgtcaagtagcttggcacatagtaagtgctcaaccagctattatgaggcgtccagggtaggagggcaagacttccaggaggagatgactttgggacaggtaaggtgtaggtgtgtagagtgccagctcatatgggtagtcctactgcaatgccaacccccaaccccggttttacttctccattctgctcagagcaagggaggtacttctacaagtagtcctgggaaactctttgaggtcaaccccttgtagatagctggggtcatggtctcattttctacctgggcttcgttgacccttccagaagaaaaaaggcatctttgtgtcctttgggaagtgcttaaagcagtaataactatttacaagcatatgattaagaagcactttaccaggcatattatttcatttaatctttatgtagactttgccaggtgcctggtgatgtcatcctcattttgccgatgaggaaactgaggttcagaaaagtaaagggaaggacctgcttaagaatccttttttttttttttttttttgagacagagtcttagtctgttgcccaggctggagtgcagtggcgcgatctcagctcactgcaacctccgcctcgtgtgttcaagcgattctcctgcctcagcctcccgagtagctgggactacagatgttcaccacctcgtccactaatttttgtagttttagtagagacaaggtttcaccatgttggcctggctggtctcgaactcctggcctcaagtgatatacctgcctcggcctcccaaagtgctaggattacatgcgtgagccaccacacccagtcattgcctaagaatcttgtatctattaagtgatggaagtggacgtgtttctaggtaaatcctgtattttatcccccattcactgttgcctctgattttgcaacagttgctattataaggccacaggggtattcttttgttacttttaactggctagaagttaaaaggcaaggaaacaagatctcaggtaaagctttatttaaatagataccacccaaagtgaggatctcagaaaatagttggaatctttttttttttttttgagacggagttttgctgttgttgcccaggctggagtgcaatggtgccatctcagctcactgcaacctccgcctccctggttcaagcagttctcctgcctcagcctcccaagtagctgggattacaggcatgtgccaccatgcccggctaattttgtatttttagtagagatggggtttctccatgttggtcaggctggtctcaaactcccgacctcaggtgatcgcctgccttggcctcccaaaggactgggattacaggcatgagccactgtgcccagcctgagagctggaatctttaaaagagggcttctctgtccctcattccctcctcattaaaatgaggggactaggctagattatactgaaggccctttcagtgctgttatgcagttgtggttaaaagcttgcaatcagactacctggactaaaatcttggctctgccacttccaagctgtgtgctactgagcaaagaggtgctactttacctctgaaatgatgctcagtacctctgaaatgatgagaggactttttggtaaggggctctgtgaggaagaattattcatagttcattttgaaccccttggtggtatagtttcctcatctgtaaaatggggatagtaataggccttattacctgtggccttattatcatgtatggctgttctgaggatttatttgaacttaatatatgtgaagtgcccagcatatttggtaaacattagctatcgttatttgggtttaacgtggtgcttgtgctgtattttccgtgtatggttggtgaaagaataaattaaagtatgtgataataccaggtccgtcaaccataatgtcattgcaagcatgaaacagtagccatcatggcattatataaatgttgatatttttatacagttggccccaggaacctgtaatcatgtgccacaatgggttgcaaagaaaggtaaagctgtccaggcatggtggctcacggctgtaatcccagcactttgggaggccaagacgggtggatcacgaggtcaggagatcgagaccatcctggctagcacagtgaaaccccatctctactaaaagaaaaaaaaaattagctgggcatggtggcgggcgcctgtagtcccagctactcgggaggctgaggcaggagaatggcgtgaaccggggaggtggaacttgcagtgagccaagattgcgccactgcactccagcctgggcgacagagcaagactccgtctcaaaaaaaaaaaaaaaaaaaaaaaaaagaaagaaagatgaaagctgatggtaggacgttaggtttagtagctcaacatccaattcagtaaatatttgctaaatccccttatgctaggcacatggaggatgtggaggtcaatcccatctccatatccttcgaggaactcagagcttaatttgcaaattactgcatttgacatctttaaatgaattcatatcttatgtttgccttggctgcagagtgaagccactgattctaatctgttttgttgtgtccctagacttctgttaggtgcctggattagaaacctcagattgcttcctaagccttttcatccattaattcgcaagtccctgagaaagaccccgtcttatgtaacagagagtagcaatacttgacaataacaataaggtgcctaatggcttacaaaaatgcctacacttgcttacacatgcttttactcatttaatcttatctgtgtcccttcaaggaaggtaaggtgcagattaggatctctgttttatagtcgaggaatctgaatggaagccaagaagccatgatgctattgagtggcccatttcacgttgaaatccagtcttctgtcttcaaattcagtgtacttaccactatcctgcccggattgtatttattcagtatttcctgagcacctagaatgtgtcagttctgttttagcctggagatatcatggtagaaaggtacagagtcccttgctctcatgcagcttatattctactggcagcaaacagaaaaatacagcagtaaatgaacaagggaatttggatgaggaataagtgctggggtgaaatcccatctctattaaaaatacaaaacttagctgggtgtggtggcacgtgcctgtagtcccagctattcaggaggctgaggcacaagaattgcttgaacctgggaagcagaggctgcagtaagccgaggttgcgccattgcactccagcctgggcaacagagcgagactccatctcaaaaagaaaaaaaacccaacaaacaaaaagaaaaagaaaaggccttgctaggatggtgacgtttttgctgagatttgctcccagggacgggccagccatttgaagacatgtcagaaggaagagcaagggtaaaggctgtgaggtggcaacaagcttggtaagttccagaaactgcaagaaggcttacaatggcagggacaggtgagtcaaaggcagagtggggaggtgggtggatgtaggggatggaagtggtagggagcgctcagatcatacaggaccttgtctgctagagtaatgagttgggattttgttctaaaagctgtggaaatcattggaggttctggagaagggacgtggcatgatctatttttgttttttaaaaaaatcactctggcctctttgtggcagtgaattttagagggcataggagtggcagccaggaggctagttaagaggttaggtgagagaagatagtggctttctaggttggtggcagtggagatggtaagaggacggattggggatgtgtttcggaggtagaaccagcaggatggcgggatgagggtgagagaataaggatgactcctgggtttttggcctgagcaattaagtagatgttagagatgccatctgcctctgaaatgatgaaaggactttttggtaaggggccctatgaggaagaattattcatagtttattttgaaccctgtagaggagaggcacaaggtataagcatcatactttatagtctgtggggaggaaatcccagattatgctggcagaagctagccaggtgcaactgattgaagcttgacgttcttactgtgaaccaaaaaaaaaagtcctgcttttctacagtctggctttttgccagcctgtggagcggcaggtgtgggctttgccagggcagtacccatctgtctttctgtcttgtgctgttggcattgcagtgctgactcgggatcttggctgagggagcctggccagctctggaagagggagcggaatcactagtgaagttcacttggtgtgccaaatggccacattctccctgccaaagtggttctttcctggtcaccaaatgacagttctgaagtttcagagcttttgacttcagaatccctggaaaacctattgtactctaccagaattcctagaggattcttgaatctcttctgagcaagggaattcgagcttcattgttatgtattccagtaactgtacttgtaaatctgggcattacagggttgtacattcaacattgtgaatagtaaaactaatagtcttatcactgccacttgtttatttaattaaatttaataaatttattcattttggagacagggactccctctgtcacccaggttggaatgcagtggtgtgatcatggctcccccacagccttgaactcctgggctcaagtgatccttctacctcagtctcttgagtggctgggaccgcaggcatgtactgtcgtgcctggctaatttaaaaaaaaatgttttggggacgggtgtggtggcttatgcctgtaatcccagcactttgggaggctgaggtgtgcagatcacgaggtcaggagtttgagaccagcctgaccaacatggtgaaaccccttctttactaagaatacaaaaattagctgggcgtggtggtgcgcacctgtaatcccagctactcaggaggctgaggcaggagaatcgcttgaacccgggaggtggtggttgcagtgagctgagatcgcaccactgcactccagcctgggcgacagagtgagactccgtctcaaaaaaaaaaaaaattctgtagatggctaggcatggtgactcacacctgtaatctcagcactttgggaggctgaggcacgtggatcacctgagatcaggagtttaagaccagcctggccaacatggggaaaccccatctctactgaaaatacaaaaattagtcgggtgtggtggtgcatgcttgtagtcccagctacttcggaggctgaggcgggagaatcgcttgaacctaggaagcggaggttgcagtgagctgagattgtaccacttcactccagcctgggtgacagagtgagactccatctcaaaaaaaagaaatttgtagagacgggtcttactgtattgtccaggcgtcttggccacaagtgatccactcaccttggcctctcaaagtgctgggattacaggcatgagccgctaatttttttagaaaacttggtctcactctgttgcccaggctggagtgcagtggtgcagtcatagctcattgtaacctccaactcctgggctcaagcgatcctcccacgtcagccatccaagtagctgagactacaggtgcatgccactacacccagctaattaaaaaaaaaaaatttttgtttttaatttttattttttgtagagatggggtcttgctatgttacaggctagtctcaaactcctggcttcaagcaatcttcctgcctcagcctcccaaagtgctgggattacaggcatgagccacagcacctggccaccactgctatttgtataactttgcagtttagaacgctctttcctgtgcattctcatttactaattgtcaatcagttgagatcatctggactacatattatccctggtttacaaatgaagacattgtggtgtggagaggtcacttgtttttgtcagtaatattgagcattttctaggtgctgagttagggagatccttgctgctcaaagtgtgttctctgtgacagatgtaccatgtccccaggaccttgtcagaaatgcagaatctaggctgggtgtagtggctcacgcttgtaatcccagcactttgggaggtcaaggcaggaggatcactggaggccaggagtccgagaccaacctgggcaaaacagtgagacctcctctgtatttttaaaaacagaagaagaagaagaaaacaacaacaataacaaggcccagatctaataaatcagagcctgccttttaccaagatcccggatgtttcctgtgcacattaaaagtttgagatgctctcacctaggtaatcagtagcaaaactaagacttaccaatgataatgacaatgaaggtaatagtcgtagctaagatacattagccaagcactgttgtaagcactttacacatgttgtttcatttagatttagacctcacaccaatcctgtaacacagatttccagaagaggaaagtagaggctcagaaaagttcagtaacttcctgacatctgctgactccaagtctattgctctttctaccattcattcgcgtgttcatctgtttttcaggtgggcagtgaccacatcttagctgtcttgtcaaaggcctttctcttccatacctgcataactaattttaaatgatgaccaaaaaaaaaaaaaaaaacagtgacttgaaagaatgtttgagaaaatcaagggaaaaacttctgagctagatgggtgtcagttacttgactgatgaggccgcaaacagatatctcatttggtcagataagctacctctcacacttcttagtgatctaacttcagggtccgaacagctgaagcaggtaggaactgtgagcttgtattctgagtcatttagctctaagctgtttcttgattctggtgataaatatctacactgggtgagaagatagtggataaagtcccatataacacctgccaactaattgttaaaacattccatctcactgtgcctcagttttctctctctgccctgtgggctcattattttcctttcaacacctcctgtctttctagactctcagaaagatatattggtcgaggactatgccattataggaaattttgacctgaaaggatggtgggaactgggtaaaggcaggattctatcaattctgctacttgctgtgtgacttggagcaagtgactcaacctctctaggcctctgtcttgcgcatacatatatatatgtaaaataaagatataggacagttcttcccaaagcccttccagccctgcccacaagactgaaccttgagttgggtgatattttgttctttcttggtgacttcatactgagctttctcccagacctttcgggtgtggcttttagagcgtatttcttggcagtcagagagcattacaatcagctcatcttatcagcatcacacatctgcacagcagcttgggatgttcatgtttaaggttcagttaatcatggtgacacattgtgtcttctcactttgtcacactgattgcggacattgagctcttcacacaggaagatctatctttagcatgctgatttatttaactcataatttgcattagagagggaaccagtgataatcatggtgggtgtggcttttatttttaaagtttttggcaagacatttgcagcacttgcattttgtcatgcttgaatatagtctataaatggaaatgggttcaagtgaaatagaaattgccatagattattgggagcttgggacttaaccactctggagtccttcatatcaccttcagcagtgctttcaggaagggcttgcttggccttttgtgtgtgacataaattaaacagaaactaaaagctcatagcacaatctctagcagcttagcagactacagtaatcattactttgtaacacatttcagaacataagcaaaaaatctagctggcaaatcataaaagattccatctaggtaagataaaatatcagttcaagttacctaaagataaccacaagaagatagtccttggtggaagtagttactggttttgcaagatctgcaataataagttagactctggcctaagaaatatatgtaatgtttttccttattcttcaattgtcagccttttaaaaatatataattttttccgattataaaaataataaacttccattgagtaaaaaaatgaggaaaatactgaacagattaaataaggctgactttaagatccaccactgagaaataactactgttaacattttactgtccatatacaaatgtattcctaaatacattttatctcataggcttgcagttctcacctgtttcctccattgttgttatttaggccattttcaacatttaaacattatgagtaatgcttcagagaacatcttaatgatgattattttgtgtaaacctttgtctgcactgctgatgatttctttaaactaggtcctttaatgttaaaaattttaaattacaaaggcaaccccccttaaataatgtttttaacatggcagtgttaacctaaagctgaaaagacagacagaattacaatttggttggggaatttacccatggtgatggtatcctaactcaggttttagcttacttgactacttgcaagtatatttttagaaagttgtattcaaagcatatttcccattttctatttggaaatgtttgcttaacattatttcataaccatttttccatatttttgtacttatttatttcaatttttgtttcattttatttttgtagaaacagggtctcactatgttgctcaggctggtctcaaactcctaggctcaagcgatcctcctgccttggcctcccaaagtgctcagattacaagtgtgagccaccaggcccaatctattttttttatttgtttatttttgagatagggtgtcgctccgttgcccaggctggaatactgtggcatgatcatagctcaccgtaacctccagctcctgggctcaagtggtccttccacctcagcttcctaagcagccagggccacaggtgcgtgccaccacttgtggctaatttttaaatttttcatggaggcaggatctcactatgttgctcaggctggtctcaactcctggcctcaagcaatgctcctgactcagcctcccaaagtgctgagactacaagtgtgagccactacgccttgctgtgtttttgtgtttagtagttattactacatgttagtagtttagtagtaactactacactttccctggcattgagcattgaagttgtttccacctttttataatcacatataatgtgttatacagaatatctccttctctctcagcctcttaagagaacaattctaaataagtggtttgtgaaaagtttgaactttaaaaaattctaacagagaactgtccatttcccttcttaggatcctctaaaagtatcttttttttttttttttttttttttttttcagatggagtctcactctgtcgcctaggctggagtgcagtggtgcagtctcagctcactgcaacctccgcctcctgggttcaagtgattctcctgcctcagcctcctgagtacctgggattacaggtgcacaccaccacgcccagctgattttggtatttttagtagagatagggtttcaccatgttggtcaggctggtcttgaacccctgaccttgagatctgcccatctcggcctcccaaagtgctgggattacaggcgtgagccaccgtgcctggcctaaaagtatctttaaaaaacagatttagctggatgtggtggctcattcctgtaatcccagcactttgggaggcctaagtgggaagattgcttgaggccagaagtttgagaccagcctgggcagcatagtgagaccccatctatacaaaacatatgaaaatttacccgggtgcagtggcttgcacctgtactcccaactactcgggaagctgaggcaagttcaagcccaggagttcaaggctacagtgagccatgattgcgctactgcattccagcctgggtgacacagtgaatgagatcctgtctccaaacaaacaaaaaatgaactttatttagatatattttacatatgatgaagtatttttttgatgtagtagtttttctcaccttctttttagtcttctctttatccatttttctttctgatgaagaattccctgtgagtaggacccagaacataggcctttgtcatttcaacccttcgttctctgaataggctgtttattggcaacattaactggaaacattttatgtacagcattggagtctcactctgtcgcctcagctcactgcaacctccgcctcctgggttcaagtgatgtgcactgtatgaactgtgagagcaagcatatcattataacattggacaatgagccaagacagttctgatggacttttgaagagggatttttcaaaaagcatttaactcatcatattaataaaataaatcctatgatttatgggaaattctgttggatcaactttggaaactgtttactataaaggtagcatgcgtaggcatgaatcttgataagacaagattctgatccggggttctgagtgggtccttatattctgcagagctgaaccaggtggaataggaggagagtttgggtaacagtcaaacacaacatccaaaattatgttgaatgtagtggtgagagctattccctttaaaactctctcttggttcttctgactgtgtcaagaatactgtatttgtttggtactggtctggtttttttttttttttttttgaaatggagtctcagtcacccaggctggagtgcagtggcacgatctcagctcactgcaacctctgcctcctgggttcaagcagttctctgcctcagcctcctgagtagctgggattacaggtgcctgccaccatgcccggctaatttttgtatttttagtaaagacggggtttcaccatcttagccatgctggtcttgaacacctgaccttgtgatccacctgccttggcctcccaaagggctgggactacaggcgggagccaccatgctcggccactagtctatttcttaacacttattaagctccctttcaaaccaatggtgatcaagcttaaggcctcagataagctacagtatttagctagaatttagtaacattgttgtctgttcttatatttattttcacagttactttctatttataacaagtgatactgattttccattcatggtggttatataaagtttctttttaaaataaactttgtgttaagcaaagtagatttaaagaaaaaacgttaagtaaataatagtacaggtgatgatagacatggcgaaaattgtccagaaacaatcggattattgacatttaggacatgctggtgtggaagaaaggccatggactttggagccagatggacctggtttcagcttgctttgccacttattaactcagtgtgccatgttacttccctgtctaagtctctgttttttttctcctgcaaattgggtcagggcagagttaccacttgtgggccagacgcttgctgcctgtcttcttctagtcctcacacggccccaagcagcaggtgttagtgatattcccattttacagatgaggaaatcagctccgaggggtaagaaactttcacagagcctcagaactacgaatgataggctgggcacagtggctcccagcactttaggaggccgaggcaggtagaacacctgaggtcaggaattcgagaccagcctggccaacatagtgaaacccacgctctactaaaaatacaaaagttagccgtgcgtggtggcaggcgcctgtaatcccagctgcttgggaagctgaggcaggagaatcccttgaacctgggaggtggaagttgcagtgagccgagatcacgccactacactgcagcctgggtgacagcaagactccatctcaaaaacaaacaaacaaaactaggaatgatagagctgggtttcagtcccaggtgtgtctgaatctctttttggctattcaggctacctctgcctgttaaatacaggttttgctatggccctctgcccatagcattattcacaatagccaagaggtagaagcagcccaaatgtccgttaacagataaatggataaagaatatgtggtacaggccaggcgcgatggctcacgcctgtaatcccagcactttgggaggccaaggcggaaggattgcttgaacccaggagttccagaccagcctgggcaatatagtgagaccttgtttctataacaaataataataataataaattagctcagtatggtggcatgtacctgtagtctcagctactcaaaaggctgaggtgggaggattgcttgagcctaggagttcaaggatgcagtgagctgtgattgcaccactgcactccagcctgggtgtcagcaagactgtgtctcaaaaaaaaaaaaaagaaaatatatatagtgcatacatggaatggaatattattcagccttaaaaaagaaggaagttctgacacatgctttagtattgatgaaccttgagggcattgtgctgagtgaaataagccagtcacaaaaggacaaatactgttatgattccacttatccgaggtagctagagtagacaaaatcatggaaacatggttaccaggggctaaggagagggggaaatggggaattgttcagtggttataaagtttcagctttgcaagatgaaaaagttctagaaatgtgttatacaacaatgtgaatatagttaacactactgaactatacacttaaaatgattaagagggtaaattttatattatgtggggttttttactgtaattttaaaaaaattttaaatgataagccattggttagagggtgatttttttttcatttggaaaatcccaattatgcataaaactagaataatgtaatgaatcatgaacccattacccacctccagcagttctcagcacttggcaatcctattttacctataaccttccatgcaccccacccctgaaaaagatcccagatggcatataactttatctgaaaatattcttgtttacctctagaggataagaactttctttttaaaataataacatttttttacacgtaaaaataatttcttacattgtctcatatccagtgttccaatttccttgattgtcttatacattttttttttttttttgagacagagtctcgctctgtcacccgggctggagtgcagtggtgcgatctaggcccactgcaatctctgcctcccgggttcaagcaattctcctgcctcagcctcccaagtagctgggattacagacatgcatgcaccacacccaactaatttttatatttttagtagagacagggtttcaccatgttagctaggctggtcttgaactcctgacctcgagtgatgcaccctcctcggcctcccaaagtgctgggattacaggtgtgagccaccgcgcctcgcctcattttttttttcttgagacagggtctcactgtatcacccaggcttgagtgcagtggtgtagtcagagctcactgctgcctcaaactcttaggcggctcaagcaaactcctgggctcaagtgatcctcccaacttagcctcctgagtagctggggccacaggcatataccaccgcacctggctaatttttaaaaatttttttgtagagacaggatcttgccatcttgtccaagctggtcttgaactcctaggctcaagtgatcctcccacctcagcctcccaaagtgctgggattatgggtggtgaaccacctagcttggtccttgtacatttcttaacagttggtttgtttgaatcaagatcaaaaaaggagctggacgtagtggctcaccatggtggctggtattacatgatggacctgtaataccagcagtttgggaggcctaagtgggagaatcacatgaagccaagagtttgagaccagcctgtgcaacaaagcaagaccccccccaacttctacaaacaattttaaaaattagtccaggcatggtggctcatgcctgtaatcctagcactttgggaggctgaggtgggtggatcacttgaggtcaggtgtttgagaccagcctggccaacacggtgaaacctcgtctctactaaaaatagaaaaaaaaaaaaaaaaaaaaaaagaaaagtcgggtccagtggcgcacgcctgtagtcccagctactctggaggctgaggtgggacgattgcttgagcgaggagttcgaggctgcagtaagctgagattctgccactgcactccagcctgggcaacagagcaagaccttggctcttgaaaaacaacagaatgtgaagaccttgactcttaaaaaacaatagaatgtgtacaacagtcctacctctgggagtggatcctaccaactactcccacttaccctaaaggtatatatgttcagtatagccactgcagtactgtttgcagtagcaaatgaccagagaccatcagaaggtccctcaataagggactgactgatcaaagacattttttggctgggcgcagtggctcatgactgtaatcccagcactttgggaggccaaggcaggcggaacacctgaggtcaggagttcaagaccagcctggccaacatggcaaaaccccgtctctacaaaaaataaaaaattagttggatgtggtggggtgtgcttatagtcccaggtacttgggagtctgaggtgggaagattgcttgaccccaggaggttgacgttgcagtgagctgtgattgtgccactgcactccagcctgggcaactgagactctgtctcaaaataaatgagtgaatgaatgaatgaatgaaaggaagtaagacagaaaagaaaggaaaaagaagcagctaagcatggtgtctgatgcctgtaatcccatactttgggaggctgagagacggaaggatcacttgagccaggagtttgagaccagcctggggaccagcctgggcaacatagtgagacatttgtctctacaaaaaataaaaacaaaattaggtttggtggcatgtacctgtagtcccagctactgaggaggttgaggtgggaagactacctgagcccaggaggttgaggctatggcgagccaacatcatgccactgcactccagcctggagtgcagagcaagagtctgtctcaaaaaaacaaacaaagaaaacaacacaaaatgagttggggggcggggagaaggagttctccaagatttatataggaagaagtacagtggtatatagtatactgctacttgagttaaaaaggtttaaaagcaaaagatgaagatgaaggagcaatgcagatatgttaggaagatttacatgttcactgtacactctgtacagcttgaattgcgttaatctttgcatagacatacacatgtatatatgcgtatatatcaggtgttttaaaaatatatgggtttatatatgggttttaaaataagacaaatctggttttgaatcctgactcttccacttaattgtcgtgtaaccttgggcaaattaatttccctgagtctctgatccttattctttaaatgaggctaatgcctgccttcctcccaaggtgattttgaggattaaaagaggactcacattaagctcttggtatactgtgagttgtgactattgaatacaataaaacccaagaactgcattgattctgaatagtaggtgttgtccaacagacttgaatatatttttgaatgtattttatgttttacaattgaatgccaaaaagagtttcttttcttctttccctgcctaaataaatgctttgtttgcctctttgtgtcatcaaatgacagagagtacatggcgccagtttgaattcagggcaggcatttattgtccttgttacttgactgtgacgtttttaggtttctttccggagaactagcgtgtcttcttcagacatttaagctgaaatcaaagttctggacttttctccaaagaaaacattgctttattgcttcccccaccttaattataaaaatcaaaatacatgcacccatcaaaaaatacaaagaaagcaaaaaaatagcctgcaggcgcaccaccctagaggtcaatattacctgcatttcatgagtatttattagtacttttcaatgttaaaagctaagcatttaacattcattagtttatttaatcctcagaacagttctttaagggagatattgctattaaccatacttggtggaagaagaaactgtgacttagtttcttgagattttatagctagtaaatggcagagcagaaattcaaagccagacctgctgaacacctcagctcatgcttttaacaatgtctttactctgtgttccccaaatctgcatctgcacatgtgcctgtacacataaacattaactgtatcatagtaattctgtttagtagcctttttcttcactcagcaatatgtcttgaatattgcccatatctaaatacctagaggtttgttgccatttttaatgacttcatagtttcccattgtagagatgtgccataatctaaccactcccttattgatgagcatttaagtgcttagaggtggtgatgtgacaaacacaaattgtgtattacattgttgcacatgtatttagttactcaattatgtccttaaaataattccaagaaatggaattgctgtttcaagggagtattcacatttagagttttggtactgattgcctgactgccctcaagtatgttgtgccaatttgagatgctgtggctcttatatgttctttctgtaagggacattttgaaactttttagacagttcacgcaactgtttggcttacaaaaaaggtgacgccccccgcccccttttttttttcttttgtgacagaatctcgctctgtcgcccaggctggagtgcagtggtgcgatctcagctcactgcaagctccgcctcccgggttcacaccattctcctgcctcagcctcctgaatagctgggactacaggtgcccgccatcatgcccagctaatttttttgtatttttagtagagacggggtttcaccgtgttagccaggatggtctcgatctcctgagatcgtgatccacccgcctcagcctcccgaagtgctgggattacaggtgtgagccaccacgcctggctgaccttatgtttacaaataatgcctgtaataacaacagaatatatttcattactttcttatttgacgtctatgctctaaatgctttttagagccgtcactgcatgacttgctacatttaccttagaaagttaaaaattctagtgctgtggacctaatagaaactgttttacgaagcttcatcataaatttaggataagtaggtcccgaatttaggtctcctagtaggtcccctcatttatcaattaaaacatttttattatctttttttttttttttttttttttaaattgagacagaatcttgcactgtcgcctgggctggagtgcagtggcatgatctcagctcactgcaacctctgcctcccgggtttgagtgattcttctgtctcagcctcccaagtagctgagactacaactgcctgccaccacgcccggctaagttttgtacttgtagtagagacggggtttcaccgtgttggccaggatggtctcgatctcttgaccttgtgatccacccgcctcggcctcccaaagtgctgagattacaggtgtgagccaccacacccggcccatttttattatcttatattcatggtggtcagcacaaatggatagataaaatgggaaaaatgagtaacccctgtatatttgtttaatttcacaaagcctttccatctctctttccccttgattttattttattttttgactaagtaatatatttacatgattcaaaactcaagagatattaaagggtaaacacactttgggaggctgaggtgggcagatcacctgaggccgggagttcaagaacagcctggccatggcgaaaccctttctctactaaaaatacaaaaattagctcggtgtgatggtgggtgcctgccatcccagctactcgggaggctgaggcacaagaatcgcttgaatgggaggcagaggttgcagtgagccaagattgcaccacagcactccagcctgggtgacagagtgaaactcggtctgaagaaaaaaaaaagggtatataatgaaaagtttctcttctacttttggccctcatccacctagctcttttagggaaagccagtgttgttatctggcaattgttacatggttcttgtgaattctttcagatatattttatgcacatataagcaaatgtagaaccattttctcaatatgtataaaacgtctttttaaaagttctgcaggacagtggtgttatttttcaacccaagatggataatcttgttttaaaaagtgtgtaactccctttgtgaaactggccatcataggaaccagagacctagaattggacttgctttcatggtgtggttcagggattgcaaacacggagtcctgatacttcaaaaacaattagaaataattgtaaaaaggagtagtgttgatggtgatgaggtggatacagagtaaaaacagctgcttcccccgagagaagcctgtccagggaattggtttaggctgcttagcagggagtcgcttttacttcttgctcgagtgttgcagtgcttttctgatggctcatgtgatctttggcttgggctgcatttcagatactctgagtatttgaaccctgggccaggcagttggcaggtggttgcgtgatctgatcttagaggacattgctttggaatgcattgatttgaggtgcgttagtatgcactctgtgtgcccacaggttgcacctccttgcagggttgttcctggggaattgccagacctctattttttcccatttggagataccacatactcattaaagagaatttggaaaatacagaaatgttgaaagagcaggggaaatcacctatactattacccaaggttgaccactattgatgtttttacgtgtgtctttatttttatataattgtgattgcatgcagtgattcaattttgtaaactgctttttcatttatgataagcattttccatgtcattacagagcctcggcaaatggcatttaaaaagatgggctagtatgtcgggcctttcttaatcaaatcatacatatatgaatttggtcatagacagagatgtctacaagagccagccaggaagtataaatgagcaaagcatgctagatatgaaacaggagatagtggggttggggaagattcctattgctgccacttggggttcaggtcaagggctgtcagatattcccatgtttccagagaagtggatttttttttttaatatgaaattgttaggccgggtgctgtggctcacgcctataatcccagcactttgggaggctgaggcgggcagatcacctgaggtcaagagtttgagaccagcctgaccaacatggagaaaccccatctctacttaaaaaaatacaaaattagctgggcaaggtggcgcatccctgcaatcccagctacttgggaggctaagcggggagaatcgcttgaacctgggaggcggaggttgcagtgagccaagatcatgtcgttgcactccagcctggacaagagtaaaactccgtctcaaaaaaaaaaaaaaattgttgtttttttgaattaaaaaaaaaaattcaggcctggtgcaatgtcacaccagtaatcccagcactttggaagtccagggtgggtgggtcacttgaggctgggagttcgagaccagcctggccaacatggcaaaaacccagccctacaaacagatacaacaattaattgtgcatggcggcctgagcctgtaatcccagctactcaggaggctgaggcggaaaatcgccagggaggcggaggttgcagtgagctgtgattgcgccactgcactccagcctgggtgacagagtgagactctatctcaaaaaacaaacaaaacaaaaattcagagaataatataagaaatagaatcagcaaagtaagggaaatgttataaagcttgaaaccttcctgtttttgttttttaagagaaaggataaagtattacagataaagttgaaatatccttcccatctctactcccattatccatacttcccattgcccagtttgggcagccactgtcataaattgttatatatccttctatctcccctcccctcccctcccctctcttccccttcccttcttcagagacagggtctcactctggagtgcagtggtacaatcgtgactgactgtaacctccacctcctgggctcaagtgatccttccacctttttggagtagctgtaggtagtaggccaccacactgggctaattttcatttcttgtagaaatagggtcttgctctgttgccctggatggtctcaaacttctgaactcaagtgatcatcctcctacctcagcctaccaaagtgctgcagttacagaggtgtgagccactgcacccatcctatcccactttttagtacttatacatacataaatgcaaatccatgagcaccgtatttttttgtaaattcctaatcgtaactgtcactctgcagctttgtttctcactcagcctatttatttatccatgttaaatctgtaagcctaattcagagattggcaaacactttctgtaaaaggccagatagtaaatattttagtattgtagtccatattgtctctattgcaactactcaactctattcacctctatagttaatgcagcagtagataatatgtaaactaaggaatattgctgttctaatataactttgtttacaaaaccaggctctgggccagatttgtatcctggactgtaatttgctgacctctgctctaatttattccttataacttgtaactactgaatggtgtgtgtgtatatatatatatatatatatatatttttttttttttttttttttttttgagacagagtcttgctttatcacccaggctggggcacagtgtcgcaatctcagctcgcttgcaacctccgactcttgggttcaagtgattctcgtgcctcagcttcctaagtagctgggattacagcgcatcgcagcatgccctgctaatttttgtattttttagtagagagagggtttcgccatgttggccagggtggtttcaaactcctgacctcagatgatcctccggcgtcagcctcccaaagtgctgggattataggcgtgagccaccacacccagccatattgtctataatatgaatatatcatattttattattcaattcccctataaatggatgtctaggttgtttctagattttttttgtttgttttttgggacagggtcttcctctgtgactcaggctggagtgcagtggtgtgatcctgacttgctgcagtcttaacctcctgggcttaagcaatcctcctgcctcagcctcccaagtactgggactataggcatgtgtcatcacgcctggctaatttttaaagatggggtctccttctgttcccaggctggtctccaactcctggactaaggcaatcctcctgccttgtcctcccaaagtactggggttataggtgagagccgccacactggcctgttttgttttgttttgttttgttttgttttgttttgttttgtttacagatagtgtctccctctgtcacccaggttggagtgcagtagggctattatggctcactacaacctccaactcctggactcaaggtatcctactgcctcagcctcccaagaagctgggactacaggtatattctaccacacccagctatattttttaaatgtaaattttttttttgagacagagtctctctctgtcgcccgggctggagtgcagtggtgcgatctccactcactgcaagctccgcctcccaggttcacaccattctcctgcctcagcctcccgagtagctgggactgcagtcgtccaccaccacgcccccaattttttctgtatttttttagtagagacaggatttcaccgcgttagccacaatagtctccatctcctgtccttgtgatctgcccacctcggcctcccaaagtgctgggattacaggcgtgagccgccgcacccgctgatttttaaaaatttttttgtagagatggtctcactatgttccccaggctggtcttgaactcctggccacaaagaatcctcccacctcggcctcgcagagtgctaggattacaggtgtgagccactgcatccagcctgtttctagtttttctactgtgataaccatgctgcaggaagcaatcttgtccatgttttcttgtgcacatatgcaaagctttttactaggatatacatagatagagaagtggaattgctgaggattttgttgttgttgttgttgttgttgttgttgtttatttttacttttggaaacagggcaagacctagcaccaggctggagtgcagtggtgcaatcatggctcactgtagccttgacttgggcttacgtgatcctctcgcctcaatctctcgactagctaggaccacaggcaagcggcaccatgccctgctaatttttaaatttttggtggagatggaggtcttcctatgttgcccacgcttcatggtcttttttttttttttttttttttgagacagagtctcactgtcacccaggctggagtgcagtggcgcaatctcggctcactgcagcctccacctcctggattcaagcaattctcccgcctcagcctcccaagtacctgggactacaggcacatgccaccacacccagctaattttggtatttttagtagagacgaggtctcaaactcctgacctcaggtgatacgcccgcctcggcctcccaaagtgctgggattacaggtgtgagtcactgtgcccagcccatgttttatttatttatttatttatttttgagacgtagttctgctcttgtcaactaggctggagtgtaatggcgcgatctcagctcactgcaaaccctgcctctgggttcaagcaattctcctgcctcagcctcccgagtagctgggattacaggcgcccaccactatgcccagctaatttttgtatttttagtaaagacggggtctcaccgtgttggacaggctagtcttgaattcctgacctcaggtgatccacctgcctcagcctcccaaagtgctgagattacagatgtgagccaccatgccaggcccatgttgttttaaataccaggtgggccaaatgaaatgttttagatagaatgtaaccagtttgtgacctctctcttacgctttccataggaagccaatagttactgagaatccaattcatacctagttctggactttgaggtgagactctatgacagctagcaaggtgaggatgcgtgaatctaaacacaaaagagttggagaacggtctggaagagtgtgactgccgtgacaaatgtgcatctgatttcctcagcagataaaagagttgaggttggggaattactcaatttttcatgttcaataaccattcaaacagtgggtgttaacattgaatgacaagttctagcagaaaaggtcttcaggatgaaggcgatgagctgctgatctgtgcttccttctttcctggcaattctgtgagtttctttaaagatttatcactctaattagacccactggaagaataacaaaggtaataaagaaagagtatcagggcatccttccaagaaaactctctcctttgaggaagacccagaataagattttaagccttggtggcaggaaattaacttagtccattttcctgaaagaatatgtcaataatacatgactagttcagtctagctgggtgagttcagaaaagaaatggtgttctgtgttcagagttgaggagatttaattaaggggactcatgctttgggaattccttcctttttaaagatttttaagattaatgtaggtcattatcattcctttgtttctatcattttggagagctcaaaaaatatatggagctattacaaagcagctgaacctcaaggtcagcttgctgcaggctttctttcttctttcataggcttggagccccattgttttgacaggtaaaagtcggacagctccgccttctcagaagtctgtaatgcagaagaatcagtcctctgcactgacctgtctccctgtcctgccctgccattctgtttctcttactctatcaggtctaggatcttgtctggcaggctcgtgcactgaaacagaggtcttcccagaggatatcaggggctgggattttccctttgcacctagatcagctttggcaggcgtctgttgaaatggagggagagacaggccgtagctcatgagccattcccctgaaatgaaaagacgcaggaaactggccattctaacatctgtctctttcttcccatctggcaaaattctaatagcatgtagaagaagtttgtccaacccgcggcccaggatggctttgaatgtggcccaacacaaatttgtaaactttctttaaacattatgagattttttttgcaattttttgtttaactcattaaccatcgtagtgttagtgtattttatgtgtggtgtggctcaagacaattcttcttccagtgtggcccaaggaagccaaagattggacacccttgatctagaagataatgactacattcctgaagggcttccttttgcatagttttctttacacggcttgagatttagttcttattgaacatcaattaggtatttagatctcaatttaatctgaattttttttaggatgattgttacaaactgaacaatagaaatgttattttagagtgggcgctgtggctcatgcctgtaatcccagcactttgggaggctgagtggggtggatcgcctgaggccaggagttccagaccagcttggccatcatggtgaaaccccatctctactaaaaatgcaaaaattagctggacctggtggcgggtgcttgtgatcccagctacttgggaggctgaggcaggagaattgcttgaacccgggagacacaggttgcagtgggccgagatcatgccactgtactccagcctgggtgacagagcgagactccgttaaaaaaaaaaaaatgttaatttaggctgggtgcagtggctcaaacctgtaatcccagcactttgggaggccaaggcaggtggatcacctgagatgaggagtttgagaccagcctggccaacatctctactaaaaatacaaaaattaaccatgtgtgttggtgggcacctgtaatcccagctattcgggaggctgaggcaggataattgcttgaaccttggaggcagaggttgcagtgagccaagattgtgccattgcactccagcctgggtcacaagagcaaaactcagtctcacaaaaaaaaaaaaaaaaagaaagaaaaagaaatgttattctagtgatgtttaatgcataaaattaggcctcatccttaatctctggaatgaccctctgacaagggttttggatgaatctgtattgttattttaatctagctttgtattagtttacaaagtacttccacccttataagcacctcttagtctcataatcatccataagaaagaagaattatacctattttttcagatttacagaaaacgggttcagagagggtaagacgtcttctggatttcttcattctagacaataatattttattacatgtaacaactagaagaaatatgaaaagcaactttttgtgtttccacttgcttagcagcagaacagtctgtgaagggcagtgggggaatatgttgatgctgtctatttattaagccacagcatatatgcccaagtggcccatcactgcttcaccttctcccaccatgggagaatggcaggaaataagtcattctcacaactaaaaagaatactgctgtcattgttctgcatattttttaaaaattgcaattgcatatatcctttgattcagcaattccacttctaggaattgatgcttacagatacactttcccacacatgaatgattgtacgtcctaggtttttcacagcagaatatcagaaacagctgaagtgcatctgcagcagtgacataaattatggtgcatgcatgcagtagagtatgatgctgctgttgcagagaataaagcagctctgtatttaccgaaggaatgaactccaaggacactgtttattattgtatataatatgtttgtgtaaaaagggagaggataaatgtgtattaatacatatttgcttatgtatcaatgatttaaaatctaataacacttgtctgtgagcagcagaacagggtggctagagagcaggtcacagagagagagagagagagagagagagagacctgtcactgaagagccttttgataaaaaaaaacagccaggcatggtggctcacgcctgtaatcccaccactttgggaggctgaggtgggtggatcacctgaggtcaggagttagagaccagcctggccaacatggcaaaaccctgtctctactaaaaaaaaaaaatacagaaattagccgggcatggtggtgggtgcctgtagtcccagctacttaggaggctgaggcaggagaattgcttgaacccaggaggtggaggttgcagtgagccgagatcgcaccactgcactccagcctgggggacagaggggagactctgtttaaaaaacaaacaaacaaaaaaaacccaaaaaaacatgaattacatgtttttaaaaatccctgcacttagtcaggtgtggtggtgtgcacctatagtcccagctacttgggaggccgaggtgggaggagatcacttgagcctgggaggtcaaggctgcagtgagctgtcatcacgccactgcacttcagcctgggtgacaaagcgagactgtcttttaaaaagaaaatttaaaaatccctgcactgagatttataggagtttggggtcctcatatataccggtaaagtactctgacctgcttactacctacccccacccaaaggacccatttaatcctttcttctgctccctgagttttccagcaccaaatgaaactctgtctctttttgtttttactttataaaattttaacactcccccacctttttttttttttttttttttttgtgtgtgtagatggagtcttgctctgtcacccagactggagtgcaatggcacaatcttggctcactgcagcctccgcctcccaggttcaaacaattctgctgcctcaagtagctgggattacaggcacatgccaccatgcccggctaaatttttgtatttttttttttttagtacagatggtgtttcaccatgttggccaggctggtctcgaactgctgctcaggtgatctgccctccttggcttcccaaagtgctgggattacaggtgtgagccaccacacctggctccattttcttatttgcattccaattctattaaatttattgattgattttgtatttttagtagaccatggtggcaggtgcctgtaatcctaactattcgggaggctgaggcaggataattgcttgaacccaggaggcagaggttgcagtgagccgagatcacgccattgcactccagcctggtcaataagagcaagactccatctgaaaaaaaaaaaaaaaaagaaagttattgccgggtgcggtggctcatgcctgtaatcccagcactttgggaggccgaggcaggccagtcatgaggtcaggagatcgagaccatcctggccaacatggtgaaaccccatctctactaaatatacgaaaaagattagctgggcatggtggcatgtgcctgtaatcccagctactagggaggctgaggcaggtgaatcgcttgaaccagggagtcggaggttgcagtgagccaagatcacaccactgcactccagcctggcaacagagcaagattccgtctcaaagaaaaaaaaaattattgattgaatgagtgctttttatgtaatgcattataccacatccttatttatttgcacacattttgcacaagccagtttttattaatgattgtgggattgaaaagtattattagcacaagctaggaaattctaacactacaaatgagtatactgtgaaaagtttttcctctttttttttttttttttttttttttttgagacggagtctcgctgtgtcaccaggctggagtgcagtggtgcaatctcggctcactgcaatgcaaccgccacctcccgggttcaagcaattctcctgtctcagcctcccaagtagctgggactacaagcttgcgccaccatgcccagctaatttttgtatgtttagtaaagacggggtttcaccatgttggcccagatggtcttgatctcttgaccttgtgatccacctacctcagcctcccaaagtgctgggattacaggcgtgagccaccacgctcagcctttcctctctctttaggcttctgagtctcctgggcccatagttcccgtgctaaagctgctactgttactacctttagaagtatacttctaacaatattgtattcatatcaagcatataacatgcatatatccccccttttcttatgtaatgtttgttttttaaatagagtttatttttagagcagtttcaggttcccagcaaaaataagcggaaggtacacagatttctcacatacctctgcctccacacatacaaagcctcccccattatggacatctcctaccagagtggtacgtttgttataagcaacagacctgcattgacacattatcacccaaagtgcataatttacattaaggttcattcttggtgttatagcttccatttttcacactatgtaaactatactgtacacactgtcacctacttttttcacttaacaacatatcttggtataggattacatttagattaccaccttctttttaataactgcataggattccacatatatggaatatatttaatttaatcagtctcctcttgatgggaacccgggttgctcacaatctgttgctcccacaataaatatccttatgtatatgtcattgtttaaaatctgtatctctaggataaattcttagcagtacaattgctagttcaaaaagtatatgcattttaaatgttgatgggtaggtccaaattgctctacccagaggttgtagtatttcaacaggttatagtagttcaagagaatataagactttttttcatttgtttaagaaaaggtttttttgggaggccgaggtgggtggatcacgaggtcagaagatcgagaccacagtgaaaccctatctctcctaaaaacacaaaaaattagctgggcatggtggcgggcacctatagtcccagttactcgggaggctgagacaggagaatggcatgaacccaggaggcggagcttgcagtgagccgagatcgtgccactgtgctccagcctgggtgacaaagcaggactctgtctcaaaaaaaaaaaaaaaaaaggaaaataaaaatagtgaccagcctgggtggctcacgcctataatcctagcactttgagagaatgaggtggagggatcccttgtggccaggagtttgagaccagcctggccaacatggcaaaaccctgtctctactaaaaatacaaaaaattagccgggcatggtggcaggtgcctgtagtcccagctacttgggaggctgaggcaggagaatggcatgaattcgggaggcagagcttgcagtgagccaagctcacaccactgcactccagcctgggtgacagagcgagactccgtctcaaattaaaaaaagggtttcattctgttgtgtaggctggagtgcagtgacacgatcatagctcactgcagccttgaactcctgggctcaagcaatccttcttcctcagcctcctgagtagctgggaccacaggcacacatcaccacccctggctaatttttatttttgtatttttattttactgtatttattttgaaacagagtcttgctctgtcctccaggccagagtgcagtggcgcagtcttggctctctgcaacttctgcctcctaggctcaagtgattctcgtgccacggccccctgagtagctgggattacaggtgcccaccaccacgcccagccaatttttgtattttttgtagagacagggttttgccatgttggccaggctggtctcgaactcctggccacaagggatccatccacctcgttctcccaaagtgctgggattacaggcgtgagccactgagcctggtcattatttttattttactttttttttttttttttgagacggagtctcgctttgtcacccaggctggagcgcagtgccaggatctcggcctctgcctcccaggttcacgccattctcctgcctcagcctcccaagtagctgggactataggcgcctgccaccacacccggctgattttttgtatatttagtagagatggggtttcaccgtgttagccaggatagtctcgatctcctgacctcgtgatccacccgcctcggcctcccaaagtgctgggattacaggcatgagccaccgcgcccagccgcttattttactttatttttaagatagagtctcactctgtcatccaggctgaagggcagtggcgtgattgcggcttactgtaccctcaacctcctgggctcaagcagtcctcccatctcagcttcccgagtagctaagactacaggcatgagccaccgtgtgcagctaattgttgttggtattttttttttttttttttggagagatgggggctccctatgttgcccaggctgatctcaaacacctgtactcaagtgatcctctggcttcagcctcctaaaatgctgggattacagatgtgagctactgtgtacagcctaattcacaaattttttggagacaggatcttgctgtgttgcccaagctggtctcaaactcctggtctcaaggaatttccctgcctcggcctcccagagtgagacccagacttaaaagatttccagctgcctcagcctatagcataagatcagatattgattgagaggaggatgggctagccaacaacactggtggactgcagttttttatttttaccactgaagctggttaagatcctgtgaggaaatatacagtgtagtaaagttatcagatatggctgtcaggttagcaagatgaagactatttaggtgtgtcagcttctgtcaggcaggctgcaatgacaacggtactgtgcttatttacttttgctttttctctaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggtaccatacccgtacccttccttaggcccttgccctgtcactgcttttgctttcatcaaacaacaacaaaaaacataaccatatgagggatgatgtctctcatcagttttggatttccaacagctcatgatatccagtactcagtaaacctctgtttaattgacatgaatatgattttttcacatttacaaaaatgaaaattgaattcataatgagaataattattatgtatgcacatagtataaagaacagcaacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaagaacagcaataaaagtaacacccacgtacccccccacccagtgtaagaaatagaacaacatccatttttctttttttttttttttttgagatggagtttcactctcgtcacccaggctggagtgcagtggcgcgatctcggctcactgcaacgtctgccatccgggttcaagtgattctcttgtctcagcctccagagtacctgggattacaggtgcctgccaccacgcccggctaagttttgtatttttagtagagatggggtttcactatgttggcctggctggtctcgaactcctgacctcaggtaatctgcctgtctcagcctccccaagtgctgggattacagacgtgagccaccgtgtccggcttttttttttctttctttcttttttttttttgagacaggatcttgctctgtcaaccctggagtgcagtggcccaatcactgcagccttgacctcctaggctcaaaggatcctcccacctcagcctcccaagtagctaggactacaggcacgcaactttgcctggctaaattttttaaattttttgtagagacatggtctcactatgttgttcaggctggtctcaaactcctgggctcgaatgattctcccacctccccctcccaaagtgctgggattacaggcgtgagccactgcacccagctgatacctatatctttagtagctccttgcgtttccctccccaacagataaccatcatcctgaattcggtgtttattgtttccttgcttttccttatagttttactttctacatgtatatttctaaagaaaacatggtttcgttttcatataattttttgcttttatgtaaatggaatcccactcatgccatttgcttttatttttgcaacattacgttcatgagatttatccatgttgatgcctgaagctgtggttcactcattattactgttccaagtattccatggtattccattctcctggtgtatgggttgtttccagtttctgctgtgaatgctcttgtgcttggcttcaggagaacatggacgtgcaagattgtcttgtttggcactgttaggtcttagggtatttgcagcttcaacttctctagacaaggacaagttgttttctaaagtggttgtgcagattgaaacacctcgcagcagggtatcagttctggatgccccgcatccttaccagcacttgtgatgatcagactaacatttgcatatagtatagcctctcagtgcagtttcagtatgcagtaccctgattacacaagataaggaacacttccatcacccccaaaatgtcctcatgctactttcttatagtcagcctcctctcccaacccctgtgtgctaatatatttctttacatccattccattttccacccaatggctagttagcattctggagtgctgaggctcccattgttttgagccttctttctggtggcaatgcactatgcctgcagttgcctggactctgagcttccactgggctttaatggcagaggagagtgcaaaggtagacttggaaggctgaggatggccactggctaaccacaaggcagaattccttggaaatgttcagttctgttttattgaattcatgcaaactttgatttctatcctaaaatgtctccatgtttataaattttaaaattacaagttatctttgcctccctcctacccctactgtatgaagctgtactgtttttttgtttgtttgttttaatcagtggcttcatagtagccctttcacagagctgggtgctattttacttcagaggcagggttttaaaaccttgaaagtcccttctagcacttttaagacctgatgtgaaaatggagtcgtatacaacacaattaggaggtaactttgttccagggaggggttctgagatgccattatgtcaaagcacttcatgccttctcactgctgcacagtaagcgcgactggctgtgcccatattttgttttgttttgttttgttttgagaaagggtctcactctgtcacccaggttggagtgcagtggcgtgatcttggctcactgcagccttgacctcccaggctcaagcaatcttcccacctcagccttcgagtatctgggactacaggtgtgcactgccatgcccagctaattttgttgattttctgtaaagacaaggtctcactatgttgcctaggctggtcttgaactcctagactcaagcaatccttccaccttagtctcccaaagtgtcaggattacaggcgtgagccaccgcacccttatgtccggcctgggtatgcccatatttgacttgcatactgtcttttaggatcagatctgttattcaaggccaggagcacctagattctctaaacaacccctcagagaaagttgaactctcagaggctgagtctgcaagattcagcatcatcttaaggtcactgcatctcttagacattttgactatggagaatgacattatttctgtctttctcaatccctggatgctgtgaaatcataaaagaatgttagaggctgggcgcggtggctcacgcctgtaatcccaacactttgggaggcccaggcaggtggatcccttgaggtcaggagttcaaggccagcctggccaacatggtgaaaccctgtctctactaagaatacaaaaattagctgggtgtggtggcatgcacctgtagttccagctacttgggaggctgaggcacgagaattgcttgaacctgggaggcagaggttgcagtgagccaagatcatgccactgcactccagcctgggcgacaaagcgagactccatctaaaaaaaaaaaaaagaatgttagagtggttaggtattgttaggtatgtatgtggagtttagcaatctagtccagccccttcattcgagaggtgaggaaacaggctcagaggactcactgaaagatggcagcagagctccagtgaggtttataagtttcttaaaagttgtgcagttttggggtcccatactttttaggtcaaaatcattctcatggcttcagcccctatcaaaatgctgaaggctcccaatctgtatatctagcctagcactgtctcctgccatccaggcccattgtatgtctagcctagcactgtctcctgccatccaggcccaataaccttctgcccactgggatgctcacagccactcagagcctgctcttgccttccttatctcagggaagccagacccctgggagttatccttgccagcagccactccctctcacttacagccaggccgtcccaaagcctttggatcctgcctcatcagggtctcttggactcatctactctgccctccccaactagggaggaggcctagcccaggcctagacccctgcagtggcttcctgtcatgtctccctccatcctgccagtcctttgccatgcttcccattgcaggggagtaatgtttctaaaacacacatctgattgtgtagcctcatgctcaaaagaatatgtcagtggttccccgaacttctcaggatcaagaagtttagtctccttgacagggatttaggtcaacttcatcacttcccaccttcccctcacaaaacaatctttttttcttacctaattcctattttttaacttcagctgtctgtgtatctggccctgcagacagaaagctttctctgactccctctaaaagtctgaattctctgactgggcgctgtgctcatgcctataatcccagcagtttgagaggccaaggcagaggatctcttgaggccaggaattcaagaccagcccagacaacatagcaagatttcacctctacaatcaatcagtcaatcaaccaatcagccaagtgtggtggtgtacacctgtagtcccagctgcttgggaggctgaggtgggaggattgcttgaactaaggaggtcaaggctgcagtgagctgtgatcgtgccaccgcattccagcttgggtgacagaactagaccctgtctttaaaaaattttaaaaaatccccacagagtctgaattctatcccatcagtgtgcctctcccatgaattactgtgtcctttcctcatgatggcatctggcgccatatggttaaagcctgcttgcttgtctgttttcctcagtggactcggagctttgtgattcacactcacattgcatccccaggacctaacataaagggtctgcttaatatgttctaagtggggttaatactttgtagaaacaagcaaaaaaaaaaaatttgttaaagctgaaattcatgtatctgaagaaactgtatcttcagtgttaccaagaagcctctagtgaagctgccccagtccctcaccagtgatggatgggcacagctgagcacagtgtattttttcccagagtttgtcccttttggctcagtcctgagctctttatctttcacaggctcccctgtgaggaattatgttctgagagaaaccgttcatgagatggattctactttgtttctcactcaggccatggagagtaagttgcttgttggaggaaaaaatatagtagatcatacgaatgaacagcagaaaatcctggagcagaaacgacaggaaattgcagagcaggtaacttttcattctttttcagggagaatgggtgaggtaaggtgtgtttatgctgcagagcaaacgtctcatattagactctcttcaaagagaatgagagcaaggtgtgtctgcctcatcctagctggagactctgatcctagcttggggaacccagcatagacacagtctctagggcaagctgatgaattttgtcatgttgctcagaaacgtcgagaaagagaaatccagcaacagatggaaagtcgagatgaggagaccttggaacttaaagagacatacagctcattgcagcaagaggtggacatcaagaccaaaaaactcaaaaaggtatgaaaggaatgaggccagatggagttgccttgagacttggggaaagggagaactctaccctttggacagacaccctcctcacctgcctctcccctcattccagctcttctccaagcttcaggcagtgaaggctgagatccatgacctccaagaagaacacatcaaggagcgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacgcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgttcattcctgaaaaagtcactttccatctctggatcccatctgttaactgaatgacttcatcaggtgatctccaagttcccttctaaccctaccttctcgaagcttttaaagattctggtcttacatctgtctgatgataagagggaatattttattaacttgactttttattgtgacaattttctgaatggtataataaatacccaagtacccatcacccagattcaaggattaacaagcttttgccatctatctttcacaaaaatattttaaagcaaatcttaacctcatgttatctcactcctacatacttatatatatatatatatgatcacagtggttttttttttttttgagacagagttttgctctatcacccaggctggagtgcagtggcacaatcacagttcacagcagcctgtaacttgtgggctcaaacagtcctcccaccttagcctcccgggtagctggaactacaggtgtgtgccactatgcccagctaatttttaaaaaaaattttatagagatagagtctctctatgttacctaagctgatctcaaactcctaggctcaagcaatcctcctgtttcagcctcccaaagtgctgggattataggtgtgagccaccacacccagcccacaatactgtttttaaaaaagcttaattgagacatacttcacataccatacaattcacatatttaaagtgtacaaatcagtccgggcatggtggctcatgcctgtaatcccagcatttgggaggccgaggcaggtggatcacctgaggccaggagttcaagaccagcctggccaacatggtgaaaccccgtctctactaaaaatccaaaaattagctgggtgtgatggcgtgtacctgtaatcccagttactcaggaggctgaggcaggagaatctcttgaacctgggaggcggaggttgcagtgagctgagatcacaccactttactcaagcctgggtgacacagcgagattcttgtctcaaaaaaaaaaaaattaaaaaatgataaagtatacaaatcagtgtttttttaaaagcatatatatgcatagggctataaaaccaccactacaatctaattttagaacatttttattactctcctctaaaagaaactctaccagttagtagtcactcctcattaccccctttcccaacccgaagtaatcactaatctgcttcctgtctctatggctttgcctattctggccatctcatataaatggaatcacacactgtgtggcctttttggcctggtgtcttttgcttagcatgacgctttcaaggatcgtccatgccgtagcatggatcaacagatatctggtagtcccaacatcaattgttctttattatgactgaataatattgcactgtatgaataggacacatatttatttatttttcagtttatatacattccgattatttctagtctttggctattatggataatacttctataagcattcatgtataaggttttgtatggatgtgtgttttcatttctctgggatacattcataggagtggaattgctgggtcatatggtaactcagtgtttaactttttgagagaatgccaaactgtttgccacagtggctgcactattttacatttctaccaccaatttctccacatcttcttttttttttttttctttgagacagtctcgttctgccacccaggctggtgtgcagaggtgcagtctcagcacactgcaacctccacctcctgggctcaagcgatcctcccacctcaacctctggaatagctgggactatagcggcatgccaccctacttggctaatttttgtgttttttgtagagatggggtttcaccatgttgcctaggctggtctcaaactcctgggctcaagcagtctgcccgacttagcctcccaaagtgctaggattacaagtgtgagccaccatgcccggcctctccacatccttgtcgacacttgttatttcctgtctcttttatcatagacatcctaacgagtgtgaaatggtacttcattatagttttgatttgcatatttctctgatgactaatgatgttgagcatcctttcacgggcttattggccatttgtatgtctttggagaaatatctatacaaatcctttaccccattttaaaatggggttgtttcatatatatatatatgtatatatttcgtatatatatgaaatatatatatttcatacacacacacacacacatatgtgtatatatatagtttttttttgttttgtttttgttttttttttttttttttttggagttggagtctcgctctgtcatccaggctggaatgcaatggcgtgaacttgactcattgcaacctctgcctcctgggttcaagcgattctcatgcctcagcctcccgaatagctgggaatacaggcacccgccaccatgcccggctgatttttgtatttttagtagagatggggtgtcaccatgttgcccaggctggtcttgaactcctaacctcaggtgatccacctgccttggcatcccaaagtgcttggattacaggcatgagccaccatgtccagccaataattaagttttaagagttttttttgagacagagtctgggtctgtcacccaggctggagtgcaatggcatgatcttagctcactgcagcctctgcctcctgggttcaagtgattgtcctgcttcagcctcccgagtagctgggactataggcatgtgccaccatgcccagctaatttttgtatttttagtagagacggggttttaccatcttggccaggctggtctggaactcctgacctcaggtgatccacccgcctcagcctcccaaaatgctaggattacaggcgtgagccactgtgcccggctgagttttaagagttctttatattaatatattatgaataccactttctcatgagattcatgatttgaagatgctttctgttattctgagttgtttttaaactttcttgatggtattacttatagcacaaaagatttccgttgtgatatagcccaatttaattgtattttcttttgtttattttacttttggtattgtatctagatttgccttttctggacctttcatataagtttataaatgaaataatgttggaataatgtggccttttgtgactgctttcttcatatgtgtgtgtgtgtgtgtgtgcatgtgtgtgttttgttagtttttttttttttttagagataaggccttcttctgtcaatcagactggagtgcagtggtgccatcatagctcacagccttgacctcttgggttcaagtaatcttcctgcttgagcctcctgagttgctaggacttcagttgcatgctagcacacctggctaattttttaaaattttttcataaggatgggtcttgctgtgttgccaaagctagtatagtgttttcaacagtcttccatgttgtagcatgtatcaatactttattcattttttatgaccaaataatattctgttgtataaatataccacattttatttatccattcattatttgatggacatttgggttatttctacttttgggtgttatgaataatgctgctgtgaacattcatattcaagtttcttttgtggacgcatgtttcattctcttagatcctctaagaggcttatagtgttaggtcttacatttaggtctatgatccatttgagttaatttctgtgtatggtatgaggtagggtttcaagtacagtgttttggatgcagatatctagttgttccagcaccatttgttgaaagggcttttctctcccatttcattgtcttggcatacttattgaaagtcagggccgggcgctgtggctcatgcctgtaatcccagcatttgggaggccgaggtgggtggatcacctgaggtcaggagttcgagatcaccctggccaatatggtgaaaccctgtctctactagaaatacaaaaattagccaggtgtggtggtgcacacctgtagtcccagctactcaggaggctgaggcagaggaatcccttgaacctgggaggtgtaggttgcagtgagctgagatcatgccactgtactccagcctgggcaacagagcaagactctgtctcaaaaaaaaaaaaaagaaagtcagttgaccgtaattaagcatttatttatttatttctggactttcaatactgttccattgttctatatatctatcctcatgctagtaccattctgtcttaattactatagctttgttagttttgaaatcaggaagtgtgagtcctccagccttgttctttttcaggagtgttttgactgttcagggtcccttgcatttccatattcaaacatactttgttttactgcactctgctttgttataattcacagatattacattttctacaaattgaaggtttgtggaaaccctgcataaagcaagtctgttggcaccattttttcaacagcatatgctctcttcatgtctctgtgtaagcatttattagcaataaagtattcttaaagtctatactttttgtagacaaaatggtattatacatttaatagactacagtatagtgtaagcataacttttatatgcactgggaaaccaaaaaattgtgttacttgctttattgtgatacttactttattggagtagtctggaaccaaacccacagtatctctgaggtatgcctctacattttaaggtcagcttgtcaatttctgcaaacaaagccagctgggattttgatattgatcacattgaatctgtagatcaatttgggcaatattgtaatcttaacagtattaagtattcagatccatgaacatgagatgtctttccatttatttattatttctttaatttttctcgagaatgttttgtagttttcagtgtataattcttacacttttgttaaatttatacctaagggttttttgggtgctatggtatatgacattgttttcttaattttatttttggaatattaattactagtatataaaaatactggctgggcatggtggctcacacgtgtaatcccagcactttgagaggcccaggtggacggatcacctgaagtcaggagtttgagaccagcccggccaacatggtgaaaccctgtctctacaaaaatacagaaattagccaggcgtggtggcgggtgtctataatcccagctacttgggaggctgaggcaagagaatcgcttgaaccctggaggcggaggttgcagtgagccgagattgcgccattgcactccagcctgggcgacagagcgagaatccgtctcaaaaaaaaaattttatatatttatatatatttatatatatatttttatatatttatatatatatttatatatttatatatatttatatatatttatatatttatatatatttatatttatttatttatatatatttatttatatatatatttatatatatttatatatatatttatatatatttatatatatatttatatatatttatatatatttatatgtatatttttatatatttatatatatttatatatacatattcatatatatttttatatatttatatacatattcatatatatttttatatatttatatatacatatttatatatatacatatttatatatatacatatttatatatatacacatatttatatatacatatatttatatttatatatatttatatttatatatttatatatttatatttatatatatttatatttatatatatttatatatttatatatatttatatttatatatttatatatatttatatatttatatttatatatttacatatatttatatatttatatttatatatttatatttatatatttatatatatttatatttatatataattgatttttgtctacacaatgatatttttatacctaaaaaaattaagtttcttagtattttctagtacccaatccacattcagattttcttggtttgctcgttttaagatctacatattaggactacatgttacatttggttattaagtctcttagacttattttaatctgaggcaattctttttattttttattttatttatttgtttatttgagacagagtctcactttgtcgccagactggagtgcagtggcgcggtctcggctcactgcaaactctgcctcccaggttcaagtgattctcctgcctcggcctcccaggtagctgggactactcgagtagtgagccaccacgcccagccaattctttttatttttaaaaatatttttcagccgagcatggtggctcgtacctgtaatcccagcactttgggaggctgaggcaggtggatcatgaggtcaggagttcaagaccagcctggccaagatggtgaaacccccatctctactaaaaatacaagaattagctgggtgtggtggcgggcgcctgtaatctcaactactcgggaggctgaggcaggaaaattgcttgaacctggaaggcggaggttgcagtgagccaagattgtgccactgcactccagctggggcaacaagagcgaaactccatctcaaaaagtatatatatacatatttttcatagttgacttgttgaaaagactgaatcagatagcctgtagaaatatcccacattgtaggcgggagtggtggcatgtgcctgtagttccagctacttgggaagctgaggcaggaggattgcttgagcccaggagttcaaggctgcagtgagccaagattatgccactgcattccagtctgggtgaccgagtgagacaccaactcaaaagaaaaaaaaaaaagaagaaatatactacattctggatttgttggtctctttcttcatggtgtcaattaacttgtatctctatcccctttatttagctctaactgaaagctatctctgaagcacgggttcccaaccttggctacaaactgagaagttttaaaaattaatgatgtctgagccccacctcagagattctgatttaattggtctagggcagtagtccttaaactttagcaggcatcagaattacctgaagggattgttaaacacagattgctgggtatcacacccggagtctgattcagaaaggctggggcagggcctgagaatgttcatttctagtaggttccaggtattgcttctgctggtttggtgaatgcactttgagaactcttggtctctcatgaggtctgggcaagatatttttcaaaactctgtaggtaacgttaatgtgcagcctggcctgagaaatgtggagctaatagtttcagccaacagatgatctttgtctggatccattatttcattagtggggttacaaaatgaccatgcctggccaaagaagaagttttcaaagggattcttttaatgatcaaattttaaatttggaaaagagcccttaaaattaaatgtaggcaaggtgcggtggctcatgcctataatcccagcacttttggaggctgaggtgggcaaattgcctgagctcaggagctcaagaccagcctgggcaacatggtgaaaccctgtctctactaaaaatacaaaaaaattagctgggcatggagacatgtgtctatagtctcagctactccgggggctgaggcacgagaatcgcttgaacctgggagacgaaggttgcagtgggctgagattgcgccactttactccagcctgggcgacaaagtgagactctgtctccagaaaaactaattaattaattaaatgtgtgtgtcggtcagtcctctttgcaggtatgtacatctagaaaaagatcaggacaaaatataccaacataataataatagttatctctggatagtgaaattgtgggtgattatgttttttacattttctttttgttgttgttgttgtttgagacagagtattgctctgtcacccggattggagtgcggtggcacgatcttggctcactgcaacctctgcctcccaggttcaagtgaatttcatgcctcagcctcccaagtagctgggattacaggtgcaggtcaaccacgcacggctaatttttatatttttagtagagacagggttttgccatgtttatcaggctggtctcgaactcctgacctcaggtgatccacccacctcggcctcccgaagcactgagattacaggtgtgagccactgggcctggcctgttttttacattttctaatgaataaatagaatcattgtaaccagaagaaagccaaatatgtgttataaaaaatagtttctgaaatgtcaaagagaaaattttagctccccaaaatatttttttttctaaggagtctattttcattattatctctctctctctctcttttttttttttttttttttttttttttttgagacagagttttgctctttggcccaggccagagtgcagtggtgtgatctcggctcactgcaacctctgccctctgggttcaagtgattctcctgtctcagcctcctgagtagctgggattataggtgcctactaccacacacagctaatttttgtatttttagtagagacagagtttcgccatgttggccaggctgttctcgaactcctgacctcaggcaatccactggctcggcctcccaaagtgttaggattacagacatgagccaccgtgcctggcctatatctctttttatatcttttgagtaaacagtgagtcagcctctttctcacagtaccctatacctctgtgctgtttgctttgtgtcccttccatgttcatttccttttggcattgttttgtcctgaggctttagaagagtaaaggcagagatataatgggagacagtcatcaccatagagagacaccaccagtgggttccagtttccttgtttgatgtgtttcctgggcacttgtcagacagagactgttagtaggaatggtcttcattctcaggggctgaaatccacttagtcctgctttttatcctggtcagttagaatgggaaattttccagcttggacaacgagccatgggattggagtaaggcagtttaatttcttctgtttttggcattttggaagttaatgaccttggttatcagcaccagtggccctctgaaagatacttcaggtagcaaatgttcactccaatatagcccaggggtcacctccctcttgagcctgttcacatcctgccccttcccaggcagaagtgacctctccatatttctaagacagaccactgtcagtacctattatacctaacagggctgcaccattaccctttgtttcaggcaggagccagatgtcatttgtgtctgtatctcagctctttgtatgatgttaggcccatcgtacttgctgagtaaatgtttgctatgtgccttgactcttacctgattactcaccatgcatgagaccagatagctgacacttcatatgtattctgtatctgttttcacctgttatgtgtgctcttacaggcatcttattatagaaaactttatccctctggaagaaaaaagtaaaattatgaatagagccttctttgatgaagaggaagatcattggaaactacatcctataaccagactggagtaagtcactattaacttcaagtatattttcaagtatgagggaggaaaagaatgttgataacaagagccctctggtcaacaaaggggtttgataagaacacagtttggcttatttaaactcaaaacccactgcattactgattttctagctgccatagatccaccaggtaaaagtttgatcatgagtgtggttttaggaattgggagactttgtcactagtgagtgagcaagtgacctttccaaagttcctgcatttctgtttctccagctgtgaagtgaagtatgctaggtcacgtaaggggcaattcagagctgttatctttgtgtgtcattctgacccacagtgttgagaaggattctcatgctaagtctgggtgctgctggaaagatgggagacacctggcagggatgcagaggtggggggtgttgacagctatgctttgtgaatgctgtctaagaactgggtgatgattaaaaatctcttctggcttaaaagatgcatgatgctctgaatcagaaagcaactcaagcagaaaacagaagcatttcccgtcccacttacgtcagcctgcagtccagggagttacttgcttcaggttctgtcagtgtcttccgagtgctggttccacaggactccagccagggctttaacactgcagttcatttccaggaaccagcagatgatgaagcggccagtctcagccgtgggatataagagaccattgagccagcacgcaagaatgtccatgatgattcgtccagaggcccgatatagggtgagaagatccttcttgggtttttctcctgtctcttttggagtctagatttgtgtaagcccttagatactattccactcagagttcataccttctttccagaggtacttgaagacatttataccaataacaattataacaaataataaataaataagccgagcacagtagctcacacttgtaatcccagcagtttgagagtccaaggtgggcagattggttgattcccaggagtttgagaccagcctgggcaatgtggcgaaaccctaactctactaaaaatacaaaaattagccaggtgtggtggtgtgtgcctgtagtcccagctacttgggaggctgaggtgggaggattacctgagcccaggaggcagaggctgcattgagccaagatcatgccacagcactctagcctgggtgacagagtgagaccctgtctcaaaaaataaataagtaaatataataaaaataataactaataggccgggcgcagtggctgatgcctgtaatcccagcactttgggaggctgaggttggtggatcacctgaggtcaggagttcgagaccagcctggccaacgtggtgaaaccccatctctactaaaaacacaaaaattagctgggtatggtggcaggcacctgtaatcccagctacttgggaggctgaggcaggagaatggcgtgaacccagcgggtggagcttgcagtgagccaagatcgcgccactgcattccagcctgggcaacagggcaagactccgtctcaaaaacaaaaaacaaaaactaaaaacacaaaaattagccgggtatggtggcaggcacctgtaatcccagctactcgggaggctgaggcaggagaatcgcttgaacccaggaggcaggaggcggaggttgcagtgagccaagatcgtgccactgcactccagcctgggtggcagagcgacactctgtctcaaaaaaaaaaaaaagtcagtactagagaaggagagtacaaacatcctgtctgtcatggccagtaaatattaacaatgaacttcaaaatggctctgtgggaaggctggagagaacacagatgtgtagtgacaggagatggacctgtcgtaaagaacttcaggtactttcatctcacaaaatgtgtgtcagtcatgtagtcatttaaagggacatcattgaggactatttaatgaccccaaaatagaaaaatagaaactctgccatgagagcctctactttttaattaaattaaattaattaattaatttgttttgagatggagtctcgctctgtcgcccaggctggagtgcagtggcgcgagctctgcttactgcaacccctgtctcctgggttcaagcaattctggtgcttcagccttcctagtagctgagactacaggcacatgccacgacacccagctagtttttgtatttttagtggagacagggtttcaccatgttggccaagttggtcttgaatgcctgacctcaggtgatccacccacctcggcctcccagagtgctgggattacaggcatgtgccaacacgctcagctaatttttgtatatttagtagagacggggtttcaccatgttggccaggctgctctcgaactcctgacctcaggtgatccacccgccttagcctcccaaagtgctgggattacaggcgtgagccaccgcactggccttttttttctttttttttttttttttgaggcaggatctcactgtgtcacccaagctggagtgctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttatagagtaatttacaccagaagtatatatatgatataaaatttgatgtaaaatatattgaaatgtaaactgtttttctctggttggtggaagcacactcaatgttttttttctttttgctcatctgtattttataactatcaatagggaacttgtattatttttatagtgaaagattttcacttgaaatatttttagatgtttctgagtctctcttggcagccagagccaaacagaagattacggttagttagctctttgggtgccattcttcctggctttgagttatttaaaagaaagaaagcaaaagcaaaaaattaggtggagttaggtgttgtaaaacggcatcacttctttcaggcaggctctttcttgataggccctgaataacaagcaatttgcacttctattcttggaggggccctcgattgcttgtactgcctgtgtccagttggaggctaacctagctggtgatggctgtgcttctgcaggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggtgagtggctttgatgacgtgtgtttaaacagaacatgtttgaacaaggacaaaccaaagcaagaatgcttgtttatcatggaatactttgcagaacacactagaaaatattgccatattactcctatgtttacttatttattctacaaatatttatggttgagacactatgctgggtataccgaataccagaatacctaatgtccccagtcccttactataaggtgaatgtgttctagtgaaatagcagtcagttcttctgttctcatgaggtgtccggtagttctaagtgctttacaaacattctcttaatgatttcctgtaaaaacttagaaggcaaatattataatcagtcccattttatagacaagaaaactgaaacttagagaatttgagaaagtagccatctctaaggaaacccagcaagtaagggccaaagcaagaattcaaaaataggtcaatccagatccacaacccagtctctgggcctccatgctaagtttacctcacccatgtggtgcaaaactagtaattctgtcttattacatcctggattaaaagttgtaggaaaacaattgggtggaaaaccaaaatggaagaaattctacctgcaaacttaatatttttttatcaatcagggaaggacagtacagtcaagctttggttttaaagaagaacaattgctaagcatcagagtctccttctctcaggttccacacctctgttctgaggccattttcaccatccccaaaggttcaggctgtgccagtgtagtggttttacagttgaacttgtcgttttcaggccattgaagaatggcctgaaatgaaatgttaatgacatctgatgtgtcagggacagagatggggacatgtaatataaacatgtgtttgacttttgcaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaaggtgtcctcataaatgactaaggcttttgaaaatgacatgcctgtggctgacacactgccattttcaataaacattttaactgggtgggagtgggaaaatgaagattgagttgggatgctggcattatttaatatagcaacaaggggcagggtgcagtggctcatgcctgtaatcccagcactttgggaggctgagccgggtggatcacttcaggtcaggagttggagacgagcctggccaacatggtgaaaccctgtctgtactaaaaatacaaaattgagtcgggcgtggtggtgcgcacctgtcatcccagctactcgggagactgaggcaggagaatcgcttgaggccgagattgcagtaggccaagattgcacaactgcacttcagcctgggcaacggagcgagactccgcctcaaaaataaataagtaaataaaaataaataaataatgtagcaacaaggaaaaggacacaaaatgaagaatgatagagtgacaaataagtgtttttcatgtttttccgtggaggttcctgagactggcctgggcaacggcatgaaatttcttttaacttttgtgttttgttttaaaaattcttttaaatttactattatacatcatactttaaaatatatgtgcctttttttttttttgagacagggcatcattctgttgcccaggctggaatgcagtggcgtgatcacggttctctgcagcctcagcctcacaggctagtgatcttcccacctcagccaagactacaggtgtgcaccactatacctggctaattttttattttttgtagaaatggggtctctctatgttgcccaggctgatctgtgccttttttaacactaaagtattttatgttgtttaccatcaggaaaagaagatacaaaaaatgggccacacattgtcttttggatttccatgctcgtaggcctgctggagtgaccctggggggttgtgccccttagttgagaagtgggactgggtggaaggagcacagaccctggattccaagctgggtttgaattctagtattgccaccacttactagccatatgactaggaggaatttaattgacctctctgaactttggggcctttgtctgtaaagtggagtgattatccccactttgaagggccattttgaggatcagcgatacatttaaagcagcaagtacagtatgggatagagcaaacgtgaaaaaaatgtggttattgctgtgataaggcactgtgtttagaagacaccatgaacactttgtgtcccgagaaactagaagtcagtattggacataccatctttagaaaatcctaaagaaaagctgttaactgtttagtaatgtgtattgagtacctactatgtgtcaagctgttctaggcactagatatatagacgtaacaccaggaacctgcctacatggaacttgcactttaatggggatggaggatgggtaaatgttaaattaaccaaatgcacacaaatatatgattatgaattgtgtcaaatgtcatgaagttataataggtttttgtttttatttttgttttgagacgagctctcgctctgtcacccaggctgaagtacagtgagtggcgtgatcatagctcactgtagcctcgacctcctgggctcaaacgatcctcctgcctcagtcccccaagtaacggaccaaggtgcgaaccaccatggctgactaattttttaaaattttttatagagataggattttgtcattttgcccaggatggtcttgaacttatgggctcaagtgatgctcctgcctcagcttcccaaagtgctggaattatatgtgtgagccaccctgtgtggccaatataatagaatattataaaaggagagtggagacctaatttagatggggtgggtaaagtaggaaagggctctttgaagaaatgacagttacagtgagatctagaggacaggagttagctgggcaaggaggagggaagggcatttgtgaagggatgggggaacagtgtttgcgagggttttgcagaacaaactcaaatttcacaagaaggtatctgcagtccctttttaccctcactagagggtagcatggagaactgtagaaaagattacagtctaggactttaaagatagcaacaaaaaatgtaaagagcacaaaggggacagtggcctgtgcgactcgggcaaacgtttcataattgtgtttcttcataagacgctttcaaactatgtgtaatgtctgtttactccccacccttccaaaaagagttaagaaacagcttggcttagcctcagtaattactagtttagaatagttcagaatccattacccagaaagcaagaattcaaagtaggatttgaagaactgtgagtgtgttcttgaaaatgacagaatttgctgggcacggtggctcacgcctgtaatcccagcactttgggaggctgaggtgggcagatcacctgaggtcaggagtttgagaccagcctgaccaacatggagaatccccgtctctactgaaaatacaaaattagccaggcgtggtggaacatccctgtaatcccagctactcaggaggctgagggaggagaatcgcttgaactcaggaggcagaggttgtggtgagccgagatcgctccattgcactccagcctgggcaacaagagtgaaactccatccatccatcttaaaaaaaaaaaaagaaaagaaaatgacagaattcttggttgggccagaggctaattcatcaggggaaatacaggacagacggggcacctggcaacttggaaattcctaccaactcagctttgtttttatcttttggatttttaaaattttaatcaacaaactactgaattttggaaactgtattttgaacttcagactgataatttaagtcttgggggctgtgattttggcaggccctcttatattagagttaccatctgattgaagcttaccctgagattctggtctccaaggaccatgtggtggtcacatctgccaactgggtcgttggtggcatttgtcaaggacgtaactagctcttgcagctgctcctgtttcaacctccatttctttcactagtcttgtggttaaccggtccctgggtgcttcagttaggcgtgccaactggggacttgctgttgggctggaggaatgggcagagggagcgatggctcaccgcatctctggggacggtgtagcccacaggcacttgttgagtgccctctatgcaccaggccttgccctgcactggagatagggaggggagtagatgtaccatggcccttctgaggagaggggagacagaaacacaaggatggcaattcagagcacttgctgcataggaggcctggctcctctcctcacacagccctcctagtcctctgaggccggagctacacaggcctccatttggttcctgggttatgccatgtgctttcctgcctggcaccttcacaccttcacacatgccatatgccttctgcctgaaacattttctcctcattctttgctcggctaactccttctcatccatcaggaaccagttgaatgtcacctcctcagagaagccttccccagcccttcgttgtggttttccccatctccgcctcccaggttcaagcaattgtcctgcctcagcctcccgagtagctgggactataggctggtgccaccatgcccagctaattttttatatttttagtagagatggggtttcacccgtgttaaccaggatggtctcgatctcctgacctcatgatctgcctgcctcagcctcccaaattacaggtgtgagccaccgcgtccagccacaaaaaaaattctttaattcgtcaggcatagtgacatgaacctgtagtcccagctactcagaaggttgaggttggaggctcacttgagcctaggaggtcaagggtgcagtgagttacgattgcatcactgcactccagcctgggtgacagaggaaggaaggacaagcatgccagacaaaggggacaacatgaataaatgcaaggagagttcctggtgactgcggaatctgatgggcctggagtgatggaatggggatggagaacggggctgggagggtctcgactccatggctcaagttagagggagagcccttggaggcttttgtgtgttttggagaccaggggagtgaagcgcagcctatttacactcgagtattttccccttaagccagcctggcatgctattatttctttttgagataacagaaagcaatttcactaagtgcctgctttaagtttgcctgctgttcacacagctttctgggcttagttggcaaattgcattctgccaggagctttccctggcacagctcactacccaaggaattctaaggagcacttgagcttgactccaaggtcttagttccctaggaatggggcctagtcttttttcagggcagtgggctggaaggtggcccctattctgcatttggcagcagagaaattaaacttctgccattggtttggggatttgtttttctgttcagtcaacaaaagattaaataacctatgctgttcaagactctatgtcatgggctacagcagccatgaaccctgcccttccagaactctcagtctggaggaaattctggccattcacaaataagtaaatttaaggtgagcagtggcacagatacagcacaaaggaggcgtcacagatttccataaggggctttgttaatgcagtgatcaccctctgctagattattccagggacagtgaggagccaggactttggcatcagattcatttattcattctttgagcatctactaagtactgggcattcttctagatcctagggatacagaaggcagctcctgtcctagggaatgtcacatcctaatagtggaggcagatggttgtcaaaggacaaacaggctgtgtctaatggtggtcagagtgctctgaagtaaaaccaggcaggtcagaaagtaaagagctggggtgtggctgagctggattgggagggcagggaaagcatctctggagtgatgagatgtacatttgagcagagccctgagtgaaattagggagcaagctgtgtgtctggtacctggaggcagaatattctaggaaataagagtcagagtgtggctgggcatggtggttcacacctgaaatcccagcactttgagaggctgaggcaggcagatcacctgaggtcaggagttcgagaccagcctggccaacatggtgaaatcctgtctctactaaaaatacaacaattagccaggcatggtgacatgcgcctgtaatcgcagctactcaggaggctgaggcaggagaattatttgaacctaggaggtggaggttgcagtgagctgagattgcgccattgcactccagcctgggcaacagagtaagactcagtctcaaaaaaaaaaaaaaaagagtgcaaaggaggtgggagtgcatttagagacaggaaggggacaagtgtgcttagtgggcagtaggttaggaaggtgggcagaggcaagtcgtaagtgaattttatttttgagccattggacacttctgagcaaaagagggaaatgatctgacaggaatgctctcaaaggatccctctggctgcttggtggagacaaactgtaggtagcagaaggggaagtgaggagactgcttggagtggcagggggtttggggacacggggatggggtgaggaaggtgcagtgggccggcaaaggtaatgcagatgagagagggcagcttggaccaggcagtggggacagagaagtaggaacgtgccttagatttattttgtctgctgataatcagagatgagaggggagataaaaagaagcaacaatagttccaaggtttttgatctgaaacttattgaaattcaacctatgccacttgtcgcccaggctggagtgcagtggcataatcttggctcactgcaacctctgcctcctgagttcaagcgattctcctgcctcaacctcctgagtagctagaattacaggcatgcgccaccacgcccggctaatttttgtatttttagtagagacggggtttcaccatgttggtcaagctggtcttgaactcctgaccttgtgatccacccacctcagcctcccaaagtgctaggattacaggcatgagccaccacgcccagcctgttttttccctttttaaaaaacaaaaatacaacaaaacccacacaactttattgagatttacagtcatgcattgcttaacaatggggagaccatctgagaaatgcatcattaggtgatttcatcactgtgtgatcactatgaagtgtatgtgcacaagcttactggtatagcctaccacacaattaggctatatagtatagcctattgctcctaggctacaaagctgtaaagcatgttactgcactgaatactgtaggcaattgtaacacaatggtaagtgtttgtgtggctaaacatttctaaacagaaaaggtacagtaaaaatatgttattataatcttatgggaccaccatggtatatgcagtctgtcattaaccaaaatgtccttatgtggtgtgtggctgtaattcacttaacatacaattcacccatttagtatacaatccaatgcttttttagtgtattcgcagttgtgcaaccatcaccatcattaattttagttgattttttatttttattttttgagatggagtctcactctgtcacccagactggagtgcagtgacatgatctcggctcactgcaacctccgcctcccaggttcaagcgattctctggcctcagcctccagagtagctgggattacaggtgcctgccaccacgcccagctaatttttgtatttttggtagaggcagggtttcaccatgttggccaggctggtctccaactcttgacctcgggtgatccgcctgccttgccctcccaaagtgctggattacaggcgtgagccatagcactcagccactatcattaattttaaaacattttcaggccgggcccagtggctcactcctgtaatcctagcactttggaaggccgaggctggtggatcattcaagtttaggagttcaagaccagcctgaccaacatggtgaaaccctgtctctactaaaaatacaaaaaattagttgggcatggtggtgcacacctgtaatctcagctactcgggaggctgagtcatgagaatcgcttgaacctgggaggcgggggttgcagtgagccaagattgtgccaccatactccagcctgggcaacagaggaggactccatccccaaaacaaaacaaaaaaacattttcatcaccccaagtatgcattaccagtcactccccattttctttgaactctgtggccctaggcaacctctaatccgctgtgtctcgtctgctcctggctctttttgggtcttatctgtattgctatttgctcatctgtaacttcacagggtaactgtgaggtttcaaaaggtgatgtgaaaacatgagagcttgtctagcaggccaaacaaagtggctgtgcccttcactgctgccctgactcctggtttgccatcccagagcaggacagctctgacgatgcgttactgaggcagtgtgagctgtagtgaagagtgtgggtgccagacccagagggctggattgggaattctgaactcacgatttactagctttgcaattctggcaatgtttctagacctccttggggtttcagattcctcaactgtcaaaaatgagtcatagcaagtatagtcatgcatcccttaatgtcgggatactttctgataaatgcattatttaggcaattttgtcattgcgtgagcatgatagagtgtacttacacaaatctagatggtatatacattttatttatatattttttcttctcttttttttttttttttcttgagacagggtctcactctgtcacccaggctcaagtgatcctcccacctcagcctccccagtagctgggaccacaggtgtgcaccaccacacccagctaagtttttaattttttggtagagatgggggtctccctgtgttgcccagactggtcttgagctcctgggctcaagccattctcctatattttttcatgtggaaaacgcaatgtcccagcaccgttactgaatatcactcatctcctctacttgagctgcaatgtcaatatcaagtgccatatgtcagatttccatttttttctttctttctttctttcttttttttttttttttttaaaaaaaagacagggtctcactctgatgcccaggggagagtgcagtagcagaattctgaaactcctgggctcaagcaatcctcccagctcagcctcctgagtagctaggactacaggcttgtgccactacctccgactaatttttgtattttttgtagagatgggggtctcactatgttgcccaggctggtttcaaactcctagcctcaagtgagtctcccaccttggccttttaaagtgccgagattacaggcatgagccactgtgcctggccttatgtttctgtatatgctccactataatcttatgggaccactgtcttatatgtggtccattgactgaagcattattatgcaatgcatgactataattcttaagttgccgtgagtcacacatgtgaagcattgggaacagtgcctggtatgtggcaatgttaatgtgaatgttaattggtaccgtgttatctttattagtcaattaagaagtcctgcagacaggtggtggctcccaacttcatgaccaggagtggacatttctgaatccaggtggttgcaagggcaatagggtgacctgtttttagtgctggctgtgccttttgttggatctgtacctttggaaaagtcacttacccctctaagccttaagttgctcatctgtaaaatggaggttaaaatcatccttacttcaggcctggcacagtggctcaaagcacataatttcaggactttggatggccaaggcgggaggattgcttgaggcactgagttcaagactagcctgggctggccaggcgtggtggctcacgcctgtaatcccagcactttgggaggcgggcggatcacgaggtcaggagatcgagaccatcctggctaacacagtgaaaccccgtctctactaaaaatacaaaaaattagctggcgtggtggcaggcacctgtagtcccagctattcgggaggctgaggcaggagaatggtgtgaacctggaaggcggagcttgcagtgagccgagatcacgccactgcactccagcctgggcgacagagtgagactccgtctcaaaaaaataaaaaataataaaataataataataataaaaagaccagactgggcaacatagcgagacccctgtctctacaaaaaaattgataaattagccgagtgtgatggcgcacacctgtagtcccaagtactcaggagtctgaggcagaagcatctcttgagcccaggagttggaggctgcagtgagttgttatcacaccactgtactccagactgggtgacagaggagagaccctattaaaaaaaaaatcctccttacttcatggagctctgtgaagaattcaatgacctatttaatacctactatatgcccagcactgttttgaacaccacagacaaaaacctctgccctcctggagcttgtgtggagctagtgcagagggacagaaattaataataatcacagtaatcctaataaaataagaaagcatatttgtaaagcacctagtgcctggcatgtggtgagctctctagaagtagtagcagttagggttattatgtgaaagcattttgtaaagctggatagcacagcagagaggtaggtctgaaggtgactgtgccatgagcatgtggccttcattgaagccttacctcatctctgctcaattgaatttcattcagcctccaacgcccccatcttgttgcctgggtgaaatctttgtctcagggtgtagagctttctcctttcctcttttcatccagcatttactgaatgccactttgggctgagcatcctgctgggcgctggggctattgagctgcaaaacccagaaggagcatggtcaggagcctgcaggagggagcccagggcattctgggagcctcgtggccatgcacattagagctagactgtgaaggaacctagctgctgagttttgcttttattctgccaggggagactctgaaggcttctgagctgggtgataaagttcgtggataaactaagagttcacaacattcttgtttaagtactgcatggtaaaagtaaatatttgcattatggttaaatccataatctatatttaagcactgcagtcaaaccaaaaagctacaagatggagatgtaaaggcatgtagaggagcacagacctcagggcaaataacgtctccaatcgaagacagtacactactaaattagcaggaaatgtagccaaatggagcagggaggttttgaagccggataaaccagggttggcacttactatctgttttgagctattgcacgtctgggggagggttaataccctgcagggttgctgaagggattaaagaaatatccatcaagtgcctggcacttaataggcacacaatatgaggcatatattattagatattaatagcaatattaagataagtagtggagcatcatggaaagagttcttgtgtcagccagccctgtgttcaaattctgatacatccagagcaagcttcttaacctttctgagcctttagttgtctcctcacctgcaaaataaacaagtaagacctcctatgtagggttgatgtagggaataaataagaatatagactttgtaggctatgtaatagatgttcagttaagtgctattttaaaaccaaaatgcagtgagctctattgaaattttttgtttgtttgtttatttttgagacagggtcttgccctgtttcacaggctgaagtgtggtggcaccatcttagttcagtgcaacatccacctccctggttcaagtgatccttccacctgggcctcccaagtagccgggagtacaggcgtgcaccaccatgcccggctaattttttgtattttgtgtagaaacatggttttgcaggtggggcgcggtggctcacgcctgtaatcccagcactttgggaggctgaggggagtggatcacaaggtcaggagtttgagaccagcctggccaacagggtgaaactctgtctctactagaaatacaaaaattagccgagcatggtggcgcatgcctgtaatcccagctgcttgggaggctaaggcaggagaattgcttgaacctgggaggcagaggttgcagtgagctgagatcacgtcactgcactccagcctgggtgacagagcaagactgtctcgggaaaaaaaaaagaaacatggttttgccatgttgcctaggctggtactgaatattttgattataaaagttacatcttctaatggtaaaaaattcaaacaatacaaaaacattttaagaaagtaattacaaatcactggaaactccgttacccagagccaatgattatcttttggatacctctttgtgcaaactcttttagtttgaccatcatggtatatgtaaatttattctactcacctgtcctattttcactcaatgatatgttgtggacatatatccagttaatttaaatttatattattgttttaaatcagtaccttgcattatattatattatattgtaccagaatttatttaacactattgatggtcattgaagctacttccagatttttaccattttatacaatgctatattaagcaaccttggacaaagatcactgttcgcttgtttaatttcctcctggaataaatcactgtacatgaattaccaaatcaaaaggttttcccattataattttattaatttttttttttttttttttgagatggagttttgctcttgttgcccaggctggagtgcaatacagtgatcttggctcaccgcaacttccgcctcccgtgttcaagtgattctcctgcctcagcttcccaagtagctgggattacaggcatgcgccaccacacccagctaattttgtacttttagtagagacggggtttctccatgttggtcaggctggtctacctcaggtgatccacccgcctcagcctcccaaagtgctaggatcacaggcgtgagccaccatggccggctaaaatcttttaaattgttattttttataaagagacagggtctcactgtgttgcccaggatggtcttgaactcctgggctcaagcagtcctctcacctcagcctcccaaagtgctgagattacaggcgtgagccaccactgttggcctataattttcttgtgttagccagacttgtgttcaaatcctgatacacccagagcaagtatgattttgttacatattgctaacctgcctcccaaatcaattgtatgaatttgcactcccatcaacagtgcatgagttgtgtctgtttccctccatctttgctgaattctgccaatctttttaacctttgccactctgatctattgaaaaatatctcaatcttgttttaatctgtagttccattcctaatgaggctgaaaatcttttcaagtatttatttccatttgtatttcttcttttgttaatagcatgtttaggcctgttttttttttgttttttgttttttttttttgagacggagtctccctctgtcacccaggctggagtgcaacggcgcaatctcggcttactgcaaactctgtctcccgggttcaagcgattctcctgcctcagcctctcaagtagctgagactacaggcatgtgccaccatgccgggctaatttttgtaattttagtagagacggggtttcaccatgttgtccaggctggtctccaactcctgacctcaagtgatctgcctgcctcagcgtcacaaagtgctgggattacaggcatgagccaccgcgcccggcccccaaggattttttaacttccatattgtgcttaggaaaactgcctaattattaaaatatagttaaaagattaatagttccaggattataaaaatatccatttgtttctttcaatacttttattgtttcttttatcacatgtaaatttttgatctaggtggaatttatttagatttaatgagagaggtggagctctagcttaatttttctccaagtggctagtctgtggctagtcccattctgtttattgacttctttttctccaccagttggaaatgtcacctttatcatacactacaattcctcatacacctggctctgtttctatactctgtttggtttaataggactgtatttctttgttgaaattgctgttttagctgttgtagctatctaatgcattttaatatctggtagaacaagtcccagctcgttaatcttcttcaaagttttcctggcagtagagcaaagtggtaaaattcatggaccttgaggtcagcccgcctgagctttaatcccaggttagccgctaactagctgtgttaccttgaacaagttatttttttgctctctgaacttctgcttcctcatctgtataatgttaacaataacagtatctacctcacagtgtgtttgtgaagatgtgatgagacgatgcatagcaagtcctcaggatggcacctggcacatggtgagtggtcagtaaatgttaggtctttttttttatgaaaatgatgcacctatttttccagttgaattttaggattgttttgacaataaaatctcactgggatcttcattgggatgacatttacttggtgggatgattttgggataattaatatccacgttataggaccttccactctaaggaaagctctgatttccactggtccaagatgttatgctcttcagtagagttttatagttttctttttataagaccagtacatttttgttaactttatttccagatggtgtaattttttttatctattactattattattattattcttttttgagacggagtctcactctgtcacccaggctggagtgcagtgacaccatcttggctcactgcaacttccacctccaaggttcaagcaattctcctgcctcagcctcccaagtagccggaattagaggcatgcgccaccatgcctggctaatttttgtatttttagtagagactggtttcaccatgttggtcaggctggtctcaaactcctgacctcaagtgatcctcccgcctcagcctcccaaagtgctgggtttacaagtgtgagccactgtgcccagcccagatgatgtaatattttaattgctcttgtgaatggaatcctttttttcccaccatttttttttctcccaacccattttggttttttctcccaacctatttcctgtttttgagacatgtctcactctgttgcccagactggagtgcaatggcatgatcagaggtccctgcaatgttgaactcctaggctcaagcagctctcctgccccagcctcccaagtagctgggactacaggtgtgcatcaccatacccagctaatttattttatttttagtatagatgaagtcttgttatattgtgcaggctggtcttgaactcctgggctgaaattatacccttgcctcagcctcccaaaatgctgagattgcaggtgcaaaccactgtgcccagccatctcaccattattattattattttcttctccttctccttcttcctcttcctcttttcttcttgttcttcttttccctattcttcttcctcttcctccttctccttctttttttcttcttattttttttgagacacggtctcactatgttgcccaggctggtcttgaatgcctggcctcaagcaaccctaccaccttggtctcccaaagtgctaggattacaggcatgagccactgtgcctggccctcatcgcaccattttctaatggaattattagtagtacattaaaagttattcatttttgaatgcttattttgcacccaaagtgactataattgttgagtttggaactaatttctcccctacctggtgtcagctttcagacatccccttctgtcaactctaacagcaccccaggcttctatctgctagggcacctactacgttggcttgccatcatttgtaatccatctgtgtaaacacaggaactgtgtctatctaggctgtaagtccccagggctcagcacagggctggcatcccagtaagaggctatcagtgccaatggaagaaggtgccccatgctgtattactgttgttttctgggatagaggagtctttcctctaggatggagagcagagcagtgaagaagcaagcagtcccttacatcatctggctgactgtctaatttggagtagacattgaagtcatcattaatgtcaagagtgaattagatttttcattatatgttgaagaacgcattgagtggtatgggaggatggacggcttaatgaatgtaggaaatcaggcaaaaccttgccaaagaaatgacattcaaggagacatcaagggtgactctgcaaccctgtcttgctttccctgccccaactgcagaccagtcttagcacccagttctgcttgaatgaattcattcagaaaacgttgacaaacacctgtgtcagggcctctgctgttgggtctggggccacagggttgggtaagagccaatatatgagctcagatcatagctctattgagctggttgttacaggaggtggtcaagactttgcttgggatctgcccagcccacctttctggctttgtctcctgctcctgcccctctggactgctggcctgtccccaagtgaacacacttgctctttcacacacagacccatggagaccactccctatcatactcactggcacttctacccagaattcacctgagccaccctctttcctttgggctttcaaggcccagctaaagtattagctcctctgtgaaggctgccctctcggagtttgttgctgcctccttgtccaaaaggacctaagataataggttttaataatgtgtacagttatttatttccatctctaagatcccattagaccaggggccctcggagtcagtgagcttgtctttgtgtttttgctgggacctaatacacaatgggtcactcaggaattgcaattaaaatgggtccagagaaatgtgacctgcaagaataaagggatagggcaacccactctggtccccttccacgctgtggaagctttgttctttcgctcttcacaataaatcttgctgctgctcactcttaaaaaaaaaaaaaaaagaataaagggatagaatgcagaaggaagatgaagatgtaaggacaacttaacttagagcagtggttctgaacccaggcctccaggaaggcagaacggcaaaggggcagaggatgtgagctgtgtagttgaggtagttgggtttgaatcctggctctggcatctattaactccataaactgggacatgtagttgtatttcttggggtttcaagaggggccaggaataccttggaacactatagagaatttcatataaataggtataagtttttctggaaagagagtccattgctttttaacaggcttcacaaaaggtaagcaccactcagaaggggagacactgtctttattagttgtcaattgctgtgaaacgaattacctcaaaatctagtgacttaaaacaatcaacatttcggctgggcacggtggccctcacctgtaatcccagcattttgggaggctgaagttaggtggatcatgaggtcaggagttcaagaccagcctggccaacatggtgaaaccccacctttactaaaaatacaaaaattagctgggcccgatggcaggcacctgtaatcccagctacttgggaggctgaggcaggagaattgcctgaacccgggtggcagaggttgcagtgagctgagatcacaccactgcactccaggctgggcgacagagtgagaatccatctcaaaaaaataaaaaaccaaaaaccaaaaaccaaaaaaaaaaaaaaaaaccaccaccaccacaacaacaaaaaatcaacatatcatgtctcgctgtttctgtgggtctggaatccagcttatgtggatgattctggcttggggtctttcgtgaggttgtaggcaagatgttggccaaggctgaagtcatgtgaaagtttgtctggggctactgtcgtatagacctctccagaaagctgcttgagtgtccttatgacatggtggctagtttcccccagagcatgtgacctggaacaaggcagagctgcaatgttttctctgacctagccccagaagccacttatgctcatttccacagttacagagttcagccctaatcaaagtgggaggggactaaaaaaggatatgaatgtgaggaggtggccatttctaaggctaccacagtgccttagaaagaacttggaatgaggagcttggggtttaaatgttgactccagcaacaaccaattgtgcaatcttgggaaagtgtcttttctttactggcccacttttctcattcacctcgtatgatggttttggaattcaagagttaagtcctgtgaaaagccatttatataagcccccaacttcacatttagttattagaggaagaaaagtcatttagggtagggtgtaagttgatgtttttattataaatcatgggaaacaaagaaataacccattcaccgctctcatcacttgggcacaccacccgctcagcattttgatgttaaaatacattttaaaggttcttttccttctttcacagaggaaataatagaggaaatggcttaaactgaggccagaagcattatggtggatgtgagtaaatctctgcattattaagagagattaaaaattgggatgggtaccttattgaggtcctgaaatctatacttgaaaaccttaaagcatcagagagctgccattttccgtgatttcggtaaaaagcagctcaggttatccttcctttgaggccattctagggggtcccacaaatctttttaagcaaaataaaaatattaataattattaaagttgttttcacattgttgaggtatattgcattaagaatggaatttgtttttccatcataaaagtagcacatactaattctaggttttgaaaatacaaatataaaaaagaaaaaatattacccatagctactaccttaatctaaatgttctatgttttgcggttgaaatgaaaaagaatttttttcaattaaaaagtgtaatatgggccgggcgtggtggctcatgcctataatcccagcactttgggaggctgaggcaggcagatcacttgaagtctggagtttgagaccagcctggccaaacatggagaaaccctgtctctactaaaaatacagaaattaacctggtgttgtggcacatgcctgttatcccaccaactgaggtaggaagattgcttgaacctgggaggcagaggttgctataagccaagatcatgccactgcactccaccctggatgacagagcaagactttatctcaaaaacaaaaggtaatatgtccatggctcacaactgtaatgccagcactttgggaggccgaggcaggaggatcacttgaggttaggagttcgagactatcctgggcaacatagcgagaccctgtctctacaaaaaatttaaaaaaaaaattagctcggggtggtgggatgtgtctgtggccctacctactcctagctactcaggagtctgaggtgggaggatggcttaagcccaggaggtcaagactgcggtgagccatgatcatgctactgcactccagcctgggtgacagagtgagaccttgtctcaaaaaaaaaagacaatcaaaagttgccatagtctgatggttacccagaggtaaccattattgacattttgttgccaggcacagtggctcatgcctgcaatcccagcactttgggaggctgaggtgggagaattacttgagcccaggaggtcaaggctacaataagctgagattgcaccattgcactccagtgtaggcaacagagagaccctgtctcaaacaaacgaaaaagacattttggtaatttaaacacgttttcctccctactgggagactgaacagcaggatttaaacgatggtgaatggaaggtgagctatgagttagggctgcccatcacatgggcagattctgtgacttaatgacaataataaggtcatgaagtctcctatacagggtcttgctctgtcacccaagctggagtgcaatggcgcaaccatggctcactgcagcctcaaactcttgggctcaaatgatcctcctgcctcagcctcctgagtagctgggactataggcacatgctgccacgcccagctgaagtcatgctctctatccatgagcatctttataacttgcatagatatatttgggtgaaatcctgtcttggtctttcccgattctccctgagcaggttccaaacattgtttagggctcaaagggaaattagtcttcagagtttctccagtaaagtaattacggagatcgggtcatttattcaacagattgggtgcctaccatgtgccaagactgtgccaggcactggggatatgatgatgaaaccaaagatgctagcatgaacacaatcactaaaccaaagtcacacaaataaattaaatgtgggagggacaaggagagctatacatgtactgatcatctgctatgctggaagtttatttagcaaatgtaatcttatttaatcatctggacccaagggaggtaatctgacctctctgaatctcagcttcatgtgaaaacggggataatattattgagagagaacatttgttacaggggcaaaccctgttccaaggtttctttcactcaaagtataaacaatgaggcactttttacactttagacactaaaactttttggaggcaaagagggctggtatttagtgagtatctgctatgtgctaggcactttacagagatctcatttaatctcagttccattctttgaatttgctatgtaccctgctgtccaaatgacggcactgagtcagtgagaggtttcataacttgcccaaggccacagaactggatggagaaagactgcagagattcaaacccaggcctgctgacatgcagagccaatgagaatatattatcttgcagtgcagtttatgggatatatgtgtccctttgggaattcctgggtgtctgctggtggcctgttaacttggttcttgaatatgcactttgcttataactgtgcagtttgaaaagtgactcatccccaaactaggcagggttgagtgtctgtcctgtttatcttccacatgccacctgcactaacttctgaagataatctataataaaagcactgtgattaaaaaacagaaaaacacacaccaaaaatgtataggtttgtctgttggtgcttctgacaagaaaataaactcatgaatctcattaactttaaaaaaatcacatctacttaaggtttaatgactaaagccaactttctaacatatctgtaccgttctctgaacatactgttttcacacttaactacgatgttgtcacttgtttctgtctgattctgcaagggcagagaccttgaaatattcaaatctggattcccccatggtttgacccagctgaagtcaggcagtgttcgctgaaagaaataaaggtgtttccataatgcctgtattagctttcttttggggctgtaagaagttaccacagatttagtgtcataaaacaatattcatttctgtttcacgcttcttgtgggcccgacgtctggattccatggctcagctgattctctgcttccagtctcacgaggctgaaatcaaggtgtctatattcctttctagagagttggggagggggtataatctgttcccaagttcattcagcttgtcagaattcagctctgtgaggttgtaggactgaagtccccatttccttgctggctcttggcaggacttcctctgagcttttggaggctgcctggattccctggcttgtggccactttcaaagccagtaacagtgggttgaattcctctcatactttgaatttaattcctctgcctcatctctccaaaacatctcttttgcctcccttttgtgcttttaagggttcatgtgattacactgggctcacccatataatacggaatcatctaattttaagggctttatttccattggcaaaatatcttttgccaaagaatgctggctggtaatcccagcactttgggaggccgagatgggtggatcacctgaggtcaggagttcaagaccagcctggccaacatggagaaacccagtcactactaaagatacaaaaattagctgggcatggtagcgcatgcctgtaatctcagctacttgggaggctgaggcaggaggatcgcatgaacccaggaggcggaggttgcagttagccaagatcacgccactgcactccagcctgggtaacacagcgagactctgtctcaaaaaataaataaataaataaataaaaaagcaacatattcacaggttccagggactaggacttggacagttttgggcaagcggggaagacattattctgtctaccacagtacctgtattaaacatgtaaatttcagttattccctgtaggtcagagggcagtaaagctacttcagaagacatcggaaagaagccaaatgacttgccaaagagtactgtatcagccgtagattgaaaaaaaagaagttaaaaatcctttgtaaaaaatcaaggcaaacagttttttgagggacagtagttcctcctttctctcagggtaaagctagagagatttttaagaggtgtcttattctaacttgcagtcttttccctttgtaggattttgcttaccggactcacaagttttctgtgaccagtattagaagcagaaaacactgaaccccttggcgttagagtttgggctacaccataatggtctcctatcaatactggctctcgctacgtgttaacattagggagtggagagtgtgtttcctcacccagggaaaccgtttaaatgtggccactgatcctgccttcatagtttttaagagctggcatcaatccaactccggacggactctagaaatgtttctggacaacgactgaacctatagttacagaaaacctatgtgctgggcgctctgaatttcatttcaggttctaaaactaaggctcagagaggctaagtatattgcctattgtttctcagctggtaataacagctaccatttattaaacatttgctctatgccaggcgccatatcatacggacctgataatgtcaagatctcccttcacatcctcttccaatctgtcaagaattgtatgttaattttaattccaataatgccatgaaatacaagacaaatgcagatcagaaaactgaggctcagagaggttgagtggacagccagggagtgactcagccaagattccagtctaggtccgctggactccagggcctgaattctctccagggtactgcctctaaaaacgccctcaggtgcattctggtcagtatggccccagagtccaagttctttacacgacccgtcaacatatcaccaagttcctaagaacgctctaggctgctggtgcaggctctgcaaatacacagcggcctgaaagcacaggaagaaatgaagaaccgtctaagtccatcagccgtggaataaccgttttactggtatgagggtctttttgtctcattattatgtggcagtgagtcatttagaggtgaccaaaagggaaagtcctgcctctcgtcccctacgagaagtgtaggtaagaaccgtttaggcgaggagaagcacgaagtgggaactgcgagtcgagctccccatcctcactccccacccgcacccgccaggaggtcctgaagcaaaaagcaccgaaggggttaagggtggccgggggagcccagccaccgccccttcccagcatcgcctcccagaatcccgcaggcccccagccagttctcgcacctcgcgagactccacccagccccttccccgaacagcgacccgtccccgttcctagctgaggtcggtgctaggcggaggacgcgagagggagagcggaagggggccgccgggcacgccgggaagtgtggtccacgcgcttcacgcggccatattcttccggagcgggggaggccagagaggccgttgggactacgactcccaggcgccctttcggtttgtttttgttcaaaaaaaaaaaaccccacactccccctcctcactcttcacacacactcacacacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtgaggcggacagccgaggggggctccgtggggcccggggtggggggggctcgccgcgcacccccccactggggggggaggggcaaggccctgcccaccgcgggagggggcggggccatcttcctttaagaacgggacagccccgcaaggcgaggggtggggagcgctccgccgggatgggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtggtgcctttgactccgggggtggaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtgaaatagcttccttttggattactcccacaaagctcagacactttgagacatattcgggtaattatctgctgataccagtagtaacaggttatactaagatgtcagttcctaagatctgtcacacagcgaggttgtggtgcggatagcataagtgtctcttgacactgtagtttatatgtaatggttgtaattcagttttaatgatgagtgaagctcagacttaattttctctcttattttgaagtgagttttctgcttcaaaggtgttgtgcaaaaaaaaaaaaaatagactgtattgggggggttgacacaaacctgaagtacacctttttctttctcgaagtctgtaaaagttacagatttataaaaactgaaggaatttgggctacagaattttcattggtgcttgctatcctcttccctagtcatttgttgcccagggaacaaaaatagcaattgtttgtatgctgaagttttgtgcttcagtttattttggcctggcatgtgaagtttgaagattttgaggttccgaaatattttttttctgattgagtcaaaattggaagcttgggctagttttcaggatcttgtagaaatttcaggatttctctaacggttctgcacctggaaacaaatataggcctgatggggagtgggagagagctctcgttctcctcctcgacaatgagttttgtgtgttcattgacattctccttggcgttcctgttatgcgggtgtttatgaccctgggcacccaaggaaatttgcttgccagagttttacttgttagaggtaggtgaaagtacttttaagtcttgtgttatttatgtcttgacagaattatgaaatctgtttgtctcaaagttctgttggctcttactagttgactttaggaatttggggtccactgttaagtctctttagattctcgaatttaccgtggtctgaacttcaacatcgaggttgctatttctgttttatcattgactcaacttcaagccaggttatcagggtaagttattcctctttttcttctaaggctcttcattaaaaatagtaatatgaataggaattactttgtttgtttgtttttcgtttgtttgccaccacacccggctaattttttatttttagtaaagatggggtttttccatgctggtcaggctggtctcgaactcgtgaccttaggttatccgcccaccttggcctcccaaagtgctgggattacaggcgtgagccaccgcgcccagcctatgagtaggaattactttgtggtgctgttatacatgtgaaaaaggatttgcgagactttgggagtctgaggtggaataatcacttgaggctaggaattcgagatgagcctgggcaacatagacccggtctctacaacaacagcaacaaaatgagctgggcatggtggtacacacctgtggtcctagctactcaggaggctgaggatagcttaggccgaggagttggaggctgcagtgcccaatgattgattgtaccactgcactccagcctgggtgatagagggagaccctgactctaaaaaaataatgaggctgggcgctgtggctcacgcctgtaatcccagcactttgggacgccgaggtgggtggatcacagggtcaggagttctagaccagcttggccaacaaggtaaaacccagtctctactaaaaatacaaaaattagccgggtgtggtggtgcacgcctgtaatcccagctactgagggggctgagacaggagaatcacttgaacttgggaggtggaggttgcagagagccaaggccatgccactgtccagcctgggtgacagagcaagactcgtctcaaaaaaaaaaaaaaaagaaaaaaagaaaaaggacttgttgagaatgtgatatgcaatttgagtatcttgtgtgtgttttttgttttagaattttccatttctttgaatgggactggatggtaggtgagggggaactttttaagagtcccaggccgggcacggtggctcacgcctgtaatcccagctctttgggaggccgaggcagacggatcacctgaggccagaagttcgagaccagcctggccaacatggtgaaaccccgtctctactaaaaatacaaaaattagccaggcatggtgatggtgcatgcctgtaacctcagctactcgggaggctgaggcaggagaatcacttgaactcgggaggtggaggttgcagtgaacccagatcacaccactgcactccagcggcgacagtgagactctgtctcaaaaacaaaacaaaagaaaaaaccagtcctcttaatgtttaaaaaaagttgctgtaacactgtactggagaatttgtgagagcgtacactggactgagagaaacttgactaggagggaacgtaggacagttgattagaacacctgaacacttctctttgggcaggtgaatttggagtgcttgcaatggcaattgtatgcacttccatgggaacgctttcagattgctcctgaccccactcagattggtgactagagtgttactgggaatccttttaaaaattgtttttgtaggctgtgcgcggtggctcacgcctgtaatcccagcactttgggaggccgaggcgggcggatcacgaggtcaggagatcgagaccatcctggctaacacggtgaaaccccatctctactaaaaatacaaaaaattagccaggcgtggtggcgagtgcctgtagtcccagctactcgggaggctgaggccggagaatggcgtgaacgcgggaggcggagcttgcagtgagccgagatcgagctactgcactccatccagcctgggcgacagagcaagactctgtctcaaaaacaaacaaacaaaacaacaacaacaaaaaaacctttcgtagaggaaagaagattcttaagaatttcagtatagtgtaccccaggagattgatttttgcagatgttaattatgctgttgaaaaatagtctttctttcacacattttgtagtattgtcttttctaggtgtaagaagtagaccttatgtggttgagtggatataaatcctccaacttgttataaacagtttgtttgggagaaatagccaaggggatttccctttaaatcgaggacgctaaatggattctccctggcttcgagaaactctttgttgtatgctttatcttttactttgattcatgactgaccagttcttacatcaaacatttttttcccctttgaagtaagagaagagatacttaaaaaaaaaaatgtagtctagaaagagactaggaatagaacactgctgacttgttcttataccaagagctggaggcataaacagttttaataaaaaagaatactttgtatcttttgatgtaacttccctttagagattctgtttcccctgtcttaaattctcaggctatttctgattgctgtttaaataattggtagttactatttgagtcatgcttcttaaaaaaaaaagatataaaaattcgccagctcagctttcatttaattagtatcaaagaaatgttatctgtggcagtgaacattagtagcttgttccagggtttattgtaggtttgttcaagtcagtactgcccatcttggcacttaggttcttggaatacagaggtggataaggtttgcccctcagggcttatggtcttctggggatgaagaaggtccagacgcaggaacagaattttactacagtcatgatacgtgttatcatagttgtataaatcataaacagatatcccagttgctgcctcttgtctagtcatagtttctcctttcactctcaactgtcctggtttggaagataattgtatgtgttatgaaacaatgggaacattgaaaagagacatttacctctgcctggcagagatcagggaaggcttcctggaggaaggtgctttctgagctgaatcttgaagggtaactaggagttaggccaatcacagagggcataagcaggagctggtgacaacacatagcaggagagaaagagtcagagtgggtgagagggagtgtgtgtatttgcaacgtgtgggaattaggtatatctacaaattattggaacataaagtttgtagagtgtcactgtggatgggtagagaggcagagaccagattgtgagggttccatatgccaggccagtgagcacctactctgtgccagacattgtaggcattacttacattgtctctaatctgtccaacaactcgagaggaagacatcagtatccttcaaaagagaacctaggttcaggttgggttgtaattgccccagtttagaatgtaaaaatttgaatctaactctagatcctgttctttaccggtgggccagtggactttggaagcttcagcttttgcagtatgtgattaaggagctgttgaaggattttatttgctttctattattattattactattttttgagacagggtctcactctgtcaccctggctgaagtgcagtggtgccatcacagctcactgcagcttccacttcctgggctcagatgattctcccacctcagcctcctgtgtagctgggattacgggcatgagccaccatgcccatctagttttttgtatttttttgtagagacagggtttcaccatgtcgcccaggctggttttgaactcctaggctcaagcaatctgcccaccttggcctcccaaagtgctgggattacaggtgtgacccactttacccagccatatatattttttaaattctttaaagagatgaggtttcactgtgttacccaggctggagtgcagtggctatacacaggcacgatcatagtgcactagagcctggagctcctgagcgcagcaagtgaccctcctgcctcagtctcagctgagactataggtgtgcaccaccgtgcctggcctgttgaaggattttagagctgaaagtgatgagggcaggtttgctttgctgggttgacctcagtctataacatgtaagttctaccagagcagggatttggtcttgtttactgtgaatccctagaattgtgtctggcacaaggtacgtgttccatgtgtttgttgaatgaaggatgacaacagagtcagaatggatttgaggaaagcaggactggatggagggataaatattaagaggctgttgtgttgggtcaggtaagagactggttttgggacttggcggacagatgagcgagaaagatgacacctgcgtttctgaattaggtgattatacaggctgtcaatcaaggtagggaatacaggaagaagagtgggtctggagaagaggtgaattagagttgccaattagatgaattaagagtagagctgaattagagtagataatgaaggggtatagtcagtacacaactgaatatttgaatctgaaatttgggggagaagtcagagctagaggtagagattaggtagttatcagaatttaggtagtagctgaaactgagatgataatgttacccatggagaatggaaaatctgaaaagagaagcaaagaataggaccatgggaaataggggttttattttagtaccttctccaaaccttgactttggtgctgaggtcttatgttcttccatagagagtaccttccgcagcagacctatcagacgagatcgggcacattcagggtggtatggctgtagacagcagcatcgtatcagacttctttatgttttgcttgtgacagcagtacttggctatggcagttaaatggactgtaagatgttagcttgatttggagtaccctgagtagctgcacaggtagacaaagtacaaagatattgacagcttttttcttcctttagaagaataacatatctaaaacaactcttaaagcaagagagctgcagttgcacactaagaaaatactgcaatactgccatgacttggttataggtgatgctaacataaatgggatattctgtttctcattgcaccagtcatgcagaatcatagcatcatgtgccagatggcagaacgtactgtggcagttaacaccacaaattaacaacacagtggcagaaagcaccgtttaaaaatatgggtacttggccaggcgtggtggctcacttctataatcccagcactttaggaggctgaggcgggcagatcacctgaggtcaggagttcgagactagctctagtctctactaaaatacaaaaattagtgtgtgtgtgtatatatatatactaatcaaacttccttgggaaagaaaatgtgaatgcatttctgtgtcatacatttcttgtgcagcactatatattctgtggtttagcagtattaacagcatcaagctgaacagtaaccagtgttgctaaggtctcgcatactataccatgtatgctgagaagatatgcatccttagaattgagaattagaacatttcagttaattgcagtaacttttcagtaactagatatatgtgtaatttgatttctgaagtaattttaactgtggaaaaactaagttgtcaccagcggtacctcatagcataactttagcccatgatatatggatggatggatataaatggaaattgcacactgaaattaggacgtttatatttcttcaggtattagaaaactactcggatgctccaatgacaccaaaacagattctgcaggtcatagaggcagaaggactaaaggaaatgaggtttgtattgttcttgttgcttaacatgagggtttcataggatatgtgtctttctgtagttgtagtgatatgagtaagtacacctgtgtatgtatttgtgcttctgtgtctggtagtgagatggaactatccatttcccaaattgtgtgtcgtctcagtggagggtggcagtgggtgaacatccatttgttttcatttagaggtgcagtggctttccccatctccttgttcttccttaaatcttggcatagagcttgttttttgtgtaaggagtcagggcacattttctcttgtgctgttttggaagtttcagacctgatagcctctattgtgcctaacgctacccttttctctatgccgtatcactgaagttctttcttttagaataaaagaacagtggtctcatcaacataaaaaaccactgacttttttccccttactaattgcagtcatatatgatgtgaatttactaaattttgaggtgacctttattttccaaatttatggtgtagttttcctggagaagtaacaagttagaaacatagaatttgcaggcttgaaagccaggactatctttcatctttctttttcctcatcctaacttcaaacttaaaaaaaaaaaaaaaaaaagctgggggtagtggcccatgcctgtaatcccagcactttgggaggccaaggcaggcagatcacttaggtcaggagttcgagaccagcctggccaacatggcaaaaccccgtctctactaacaatacaaagattagccggcatggtgacgcatgcctgtagcctgtagttccagcttgggaggcggaggctggagaatcgcttgaactcaggagacggaggttgcagtgagccgagattgcaccactgcactccagcctggacaacagaataagactgcatctcaaaaaacaaaacaaaacaaaaaacaaagaaagtacttaaatgaggaaagaggagagcactacacagtccttgcctgggactcagagcaaacttcatgtttttgctagtcaaacttagctgctttaattgaccttttagggtcaaaaggccttcactttccagttgtcagttcaaacgttctcaagttgatgttttgtggggagggaagattgagattgtctacatcacatttatttgacttgtacttatccactgtgtagtgttataattgtgctttatttttgtttttatgggctatttcccatcatgctgctgtctgcactgctgttggaccactttgcctatagaaggtaaatgagtccctttgggacatatggaattgagaaccttaacttgtttctgcttcttgttcttagaggaattatgaagcagtcatgatggctcatgatgagtgagcagctctgtaatttgtagacagaggtataatatgtaggagtcacagaagagctgtgccagcatgctgttccccttgtagcagagatgctagcacacccacttgatactccagattttgcatagggtttcttttagagattggttcttggtgaaaaattttttagcatccagtgtgttccaaggcaaaataagtaatagttttttaatggtttttttagactcagaatttatttttaacactgcataaattagggcttctagttctgaaaaatgcaaagaggcttacttaagctatttatatattttttaacatgctggggagagggaagagagggtgcacaggtgactcctagcactaatatgctagtgccaaactcagttaatattaataatggtcatttgttgatatttttggtagcttttctatttaaagattcagtaagtagcatcctttgcactgaattgtcacgttttgtaacctgctgttgtggcagggaccatgaaacaacttagtatgccattgtttcagtttattttttaagcattactgggaactaaatccacttgacttactttttgcatttaggtttaaataattgttcctgggtagatacagaataaaactcaatctccccacttccagcagagaaaaaacaaatgaaatactgttctttttgtgtacttactagaaaatgtttaactggaaaaaaagttctgcttgttttattggcacagcaccattgattctgtgattctttgtcatagtattctgtggcagtttctgagtatgatatgtagattgaaatatagaggctaggaaacttttaatagtaaaattttactaaaaatttattaacttattaaaatataacttgaaaaaattgtgaggtttttctaaatttcttggaaatttgatttatattgtcaaaaagcactgaagaagtgttagttatggatttcgggtatcacataatgtttattccagagttttctgagtgtgatttatgtgaatttcatttggttattcttttactattttcacagtgaaattgtcatgagattttttcttctgtatttcttgcttagcttcttctcatttaagaatgagttggagggattaggtctttaagtaggcagatggattgtataaccctcatccattcttttgtggttttacagtgggacttcccctctcgcatgcctcaatgctatgctacattccaattcaagaggaggagaggggttgttttataaactgcctggccgaatcagccttttcacgctcaaggtaagtgatatgaactctcttttggtgcagtgattcttggacttttaatgtgcataaaaatcacctggtaggtctggaataggggccatgaatttgcatttctcatatgcagtcaggtgacactgatgtttttcttttttttagacatagtctcgctgtgtcacccaggctggagtgcaatggggcgagatctcggctcactgcaatctctgcctcccatgttcaagtgattctcccacctcaacctcccaagtagctgggactacaggcacatgccaccatgctcggctaatttttttattttttttaatagagacggggtttcaccatgttggccaggctggtctcgaaatcctgacctcaggtgatccacctacctcggcctcccaaagtgctgggattacaggcatgagccaccgcacctggccagatgctgttggttctaaatggcactttgaggtgttctaatatgaatcagatattagaaattatttagtcatagcagctcttgtttgtgtgttcatcttttcttgtctatatctttgtagattgtacaaaactgaagcataactatggggataattgcagatgtgcctttttttttttttttttttttttattctgagatggagtctcactctgttgcccaggctggagtgcagtggtgcgatctcagctcattgcaccctccacctcccaggttcaagcaattcttctgcctcagcctcctgagtagctaagagtgcactaccatgcccaggtaatttttgtatttttagtagagacggggtttcaccatgttggccaggctcgtcttgaactcctgaccttgtgatccgtccgccttagcctcccaaagtgctgggattacaggcgtgagccactgcacctggccacagatgtgccttaattaggattttgttgtagtaatgatgtgaaggataaattactggtcagctaatgtaagacctactctatggaaaataactgaaatgtgaacatatttgtggaaattaagtgacagtaattataaagtaagagtacttaaatcaggtagagttcataataaagcttaaatagggccgaaatgaacaggctaattatttttccaccatttgtgatatatatggtaatcatttagaccgggggtctgcaaagtttttctgtaaaggaccagaaaatcaatgtttttttgttttgtggatcatactgtctttgtcttaaccactcaggtctgccattgtagtaggaaagcagccatacccaaatgaatgggcatggctgtgttccaaaaaaaaaaaaaatttatttacaaatgtttgttttacttacgaaaacaggctgcaggccagatttgatttggggctgtactttgtcgacccctgatttagacataagatgacttgtcgacattggagaaactgaaaatttgatgctgaccctttcgttcttccatagtgggttataaattttagcagtcagtacaaactttttcctttaagttttgttttcttgatggactgtattcaaaataaatacctgaacaaataccaactatataacatgaagccataaaacttggtctttatatataaataaagtttatcttggggtcagatgtctgtgctgttttctatatttttttatatccaatagtttggtctttttcctttcagttttgtatgcttttcttgtaatcgagccttggaagagacagagccactgagcccaaaacctagctttgtggtcggctgtggtggctcatgcctgtaatcccagcactttgggaggctaaggcgggaggattgcttaaactcaggagtatgagaccttgtctctattaaaaaaaaaaaaaaaaaaaaaaagccttgcgtggtggtgtgtgtgcttatagtcttagctactcaggaggctgaagcaggagggtagcttggagatggaggctgcagtgagctgtgatcacaccactgctctccagcctgggccacatagcaagaccctgtctcaaaacaaaaacttagctttgtaacctgggagggatttaacccttctttttggtggaatatgcatccctggcattgagtcagtccttaataaatgatagcctttatgatgatctgaggtttatcattcttaattgcctgttaatggcatttttctattaatattatctattttttgagatagggtcttgttctgtcacctgggctggagtgcagtatcatagtcacagctcactgcagccttgacctactaggctcaagtgatcctcccacctcagccttctgagtagctaggacttcaggcgcataccactatgcctggctaattttttgtattttttgtggagaaggagttttgccatgttgcccaggctggtctcgagctcctggggtcaagcgatccactggctttggcctcccaaactgccaggattacagacgtgggccactgcacctggcctattattttttaatttaatattaatttatatttttagaaacagggtctcacactgttgtccacagctggagtgcagtagtataatcatagctcaccgtagccttgaactcctgggctcaagcagtagtcccacctcagcctcccgagtagcgtacaccatcaccccagctaatttttaaattttttcctagagatgaagtcttgctatgttggttaaactggtctcaaactcctggcctcaagtgatcttcccaccacagcttcacaaagcactgggatggattacaggtgtgagcaaccatacctggccctctattatctcatatatagcttattgttacatatgctgtaattatatatagttataattatttaatacatatatgtttattacaaatatgcctgttaatggtatattctgtttttaaaaggaaggataattacttttttctatgagtaccttaagggcaggaactgagttttatttgtgtttgtaatttggctctgggcagaattcttggcatagtacgtgctttatgtgtgaactgaattatatttcttcatcttaattttacaggtgtgagccactgcaccaggccccttcatcttaattttaatatatctttgaataaacaccattgtatgaacctgctgtaagcttgggagtggtctgttagtctacagcttgtgtctgagatgtgctaattgaatatttgctcagtacctcatcttaactgcctttggctttatgttgcttatccttcatagtatcttgttcattggccttttacatccataggcatcacttctctgatattcgttgtgctcttttaatggattaatggtttgcttggttggttcctctagttagactgtaaactccttgagagcagagtctgtattttattaattacccacagtactaggtacatagttgccttcaataaatatatatttaatgaacgaatttagtgaataatggctacatttttgtacttcgttattatttatttattttttttttctgagacagagtcttgctctgtaacccacgctggagtgcagtggtgtgatcttggctcactgcaacctccaccgcccaggctgaagtgattctcctgcctcagcctcccgagtagctaggactacaggcgtgcaccaccatacctggccaatttttgtatttttagtagagatgggattttactatgttggccaggctggtcttgaactcttgacctcgtgatccgtctgcctcggcctcccagagtgctgggattacaggtgtgagccaccgcgcccagccttcattattcttttgacatttgatgataaatactgtttatgattttctttttctttttttttttttggtagagacagtctcgctttgttgcccaggctggtcttgaacttttggactcaagcgatccacccacctcagcctcccaaagtgttgggtttacatgcatgagccacctcgtgtgtccttgttcataattttgatgggctgggcgcagtggctcacgcctgtaatcccagcactttgggaggccgaggtgggtgaatcacttgaggtcaggagttcaagaccagcctggccaacatggcgaaaccccgtctctacgaaaaatacaaaaattagccgggcgtggttgtgcacgcctgtaatcctagctacccaagaggctgaggcaggagaatcactttaacccgggagatggaggttgcagtgagctgagatcgtgccattgcactccagcctgggcaacaagagtgaagctccatctcaagaacagttttgatgaaattgtccctagatttgcatctggcatctagctcatatctcagagccagaatgaaggatgcttacctctgggtttggtaaattttagcttggttaattatgtgtgtgccttaatttttttgacctattataaaagcaatatacgtaaatgcaacagagaaaatgaaagtaatccataaaattctacctgtggccagctgcgatggctcatgcctgtaatcccagcactttgggaggttgcggtgggtggatcacttgaggtcaggagttcgagaccagcctggccaacatggtgaaaccctgtctctactgaaaatgcgaaaattagctgggcatggtggtgggtgcctgtaattccaggtacttggggaggctgaggctggagaattgcttgaacccgggaggcagaggttgcagtgagccaagattgcaccactgcactctagcctgggtgacagagactcttaagaaaaagaaaaaaaaattcagatacctgtaacctaaataattaatatttgaaaaaatttcatcattgcttctttcattcagttaatatattttgaaccacttgccatggtgttatatatagacatgtcttatatatgtgtatatatatgtgtgtatttatttattttttgagacagagtctcgctttgtcatccaggctggagttcagtggtacaatcatggctcactgcacccttgacttcctgggctcaagcaatccttccagcttccctagtagctgggactacaggcgcatgccaccacacccagctaatttttgtagtttttgttgaggtgggaattcactagtcttgaattcctgagctcaagcaatcctcccatcttggcttcccaaagtgctgggattataggcatgagccactgtgctcacccagttttttatttttagatacagggtctcgctctgtggcttaaagctagatggtgcagtggcaccatcatagctcactacaaccttgagcgcctgggcttaaggaatcttcctgtcagcctccccagtagctgggaccacaggcatgcaccactgcacctaattaaaaaaaattttttttatagagatggagggggtctcattttgttcctcaggctagtctcaaactcctggcctcaagcaatcctctgcttcagcctcccgaagtgctgggattacaggtgtgagccacggtgcccggccccttattctttttgaaggctgttttaagaattccagatttccagccatgaatgtgtgattactaactagtctcttgttatatgcctcatcaacaccacacttctcccagaagttgtgcaggcatttagtttattgttactcaggaatggatgagaaaggatatcaaagatctgaaccagctgattaccatcttggtcacttgagaactcaggtctgtccaataaacaccctaatccaaggtggtgttaaatacatatatatatatttttactttacgtttatttattttgaaaaatttcaaacctatagaaaaattgaggcagtaccatagtcttagtccattttccattacttagaatatccaaaagtgagtaatttataaagaaaattaatttatttcttacagctatggaggccaaggtcgaggggacatatctggtcagcgttttgccatgttggtcaggctggtctcgaactcctgacctcaaggcctgccttggcctcccaaagtgctgggattacaggcataagccaccgtgcccagccacctctgagcactttagatagtatgtcttaagaacaaagacatagcccggcgcagtggctcacgcctgtaatcccagcagtttgggaggctgagtcgggcggatcaccttaggtcaggagttcgcggcaaaaccccgttactactaaaaatacaaaaaattagctgggtgtggtggcgtgcacctgtaatcccagctactcgggaggctgaggctggagaatcacttgaacccaggaggcagaggctgcagtgagccgagatggcaccactgcactgtagcctgggtgacagagcaagacttggtctcaaaaaaaaaaaagaaaaaaagaacaaagacattttcctatataaccacaatgccgttatcacactcaagaaacttaacattgatatgattgtgtataatacatagtccatattcaaatttttctctcatttcaaaattattctttgtggcctaaaatcctgtatccaatcatgatatttttgaacaatccagactagttgttgtatagaagtaagtagtttgttttttttgttttgttttgttttgttttttgagacagggcctggctccgttgcccaggctggagtgcagtggcatgatcacggcttactgcaacctctgcctcctgtgctcaagcaatcttgtgcctcagcttcctaaataactggaattagaggtgcgtgacaccacgcctagctaatttttgtatttttaatagagatggggttttgtcatgttgcccaggctggtcttgaactcctggactcgaagcaatcctcccacctcagcctcccaaagtgctgggatttataggtgtgagccaccaggcctggcagttaagtacattttttaaggactaataaaaatgtagaaatcttcgttatttccggaatcctttatgttttactgccagtactaatgtagtaatgccagacagtagtcatgtctactgttccaggttgtccaaaggattcagcagcaaaggatgaaagtggtgggaagttttgcatagtggtcgaccaagggctagtttggtgagtgtcttgcctatgataatggacaggaagacaccagttattttattttatttttattttattttattttattttaattttattttgtgttgtgttgtgttatctttgagatggagtctcactgtatcacccaggctggagtgcagtggcgcaatctcggctcactgtaacctctgcctcccgggttgaagtgatcctcctgcctcagcctcttgagtagctgggattatatgcgtgagccaccacacccgactaattttttgtatttttagtagagacagggttttaccatgttggccaggctggtcttgaactccttacctcaggtgatccacccaccgcagccccccaaagtgttgggattacaggcgtgagccaccacacccagctgacaccagttatttaactcacatttctctgttttccttttaaaggtagtagtgacacctttgaaatcttttggcattttctttgcctgttctcccttatgtgttaaggataagcttacgtgcagaatggcttgttaagttttttctcctccgtacttggaaatctcatctggtgggacattagggtcagaattttgtatattatatattatatatctatcatgatatatataatgtattttatatattatatattatataaatatcatgatagatatataatatataattatatgttatatattttatatttataaaataaaaataaaaaattgcaattattttcaaatagtaaaaccacgtagataaaatataattctggccaggcacgtggctcatgcctgtaatcccagcactttgggaggctaaggtgggtggatcacctgaggtcaggtgatataatatacaacagatataatatgtctattatatattatatataatgttatatagatatctatattatatataatatattaatagatatattaatataatatatattatatattatacagatatctataaatatattatatataatatattatagatatatctatgtatattatatcacctgacgtcaggtgatccacccaccttagcctcgcaaagtgctgggattacaggcgtgagccacgtgcctggccagaattatattttatctacgtggttttactatttgaaaataattgcaattttttattttattttttggttctggaaacatttgtgtggacttacctatgattgtcaggtttactgatttgctggagattttttgggcatgacaaagggtttcttctttgataaaagtttttctgggtaatgtgatggtacaggttgagtatcctttatctgaaatgcttgagacatgaagtgttttggatttgagaatttttagcatcttggaatatttaccacatacatagtaaggtaccttgaggatggggcccaagtctaaacacagaattcatttgtgtttcatatttatcttatatgcatgaaacaaagttgtttgttttcttttttttttgagacggagtctcactctgtcgcccaggctggagtgcaatggcatggtcttggctcactgcaacctccgcctcccaggtccaagcgattctcttacctcagcctcctgcgtagctgggattacagacatgaggcaccatgcccggcaaatttttgtatttttagtagagatggggtttcaccatgttggccaggctggtctcaaacccctgacctgaagtgatctgcctgcctcagcctcccaaagtcctgggattacaggtgtgaaccaccgcacctggccccaaaataaagttttgactctgtgtgtgtgtgtgtgtgtgtgtgtgtgtgttttggagacagagtctcactctgtcgcccaggctggagtgcagtggcatgatcacagctcactgcaaccttagcttcctgggctcaaatgatcctcccactttagcctcccaggtagttgggactacaggtgcgtgccactgtggctgagtaatttgtgtgtgtgtgtgtgtgtgtgtgtgtgtgtgtgtgttttaatagagatggggctttgccatgttgcccagcctggctcttgacctcttgggctcaagccatctgcccaccttgacctcccaaagtgctaggattataggcgtgaaccaccatgcccagcctttgactgtgttttgatggcaacccatcacgtgaggtcaggtgtagaaatttccatttttggcgtcaggttggcactccaaaggtttcagattgtggagctccttggagttttggattagggatgctcagcctgtacatttgacagtttatttacagatgcttgcatcagtgcttggagctagtcctcagtggtgggataggtgaaaattatctctactttgagttcttgatttgaattcttttttcttaagcttttcctaaagtcatgtgtcagtgttgattattgcccggttagaggtaggatttgtattgtttttttacacttggaatttcctgttgtcataagatcactgtgaactcccttgtagtgttgtacattcttaggactttcatgctgaaatactatgcttttataaaatggttgttgtgtctttgctgagtttaaatagggtccaggccaggcatggtggctcatgcttaccctgtctcaaaaaaaaaacaccctcaactaaatatagttaaataggccaggctcggtggctcatgcctgtaatcccagcactttgggaggcggaggcgggcggatcacctgaggtcaggagttcgagaccagcctggctaacacggcgaagccctgtctctattaaaaataaaaaaaaaacctagccaggtgtggtggtgaacgcctgtagtcccagctactcgggaggctgaggcaggagaatcacttgaacccagagacagagtgagactctgtctctcacacacacacacacacagataaataaattgggttcataaatggtgattccagcactcactgtcaggtataacttcagtctttttttttttttttttttttttttttttttttttttttttgagacagagtctccttctgtcacccaggctggagagcagtggtgtagtctcagctcattgcaacctccaccttctaggttcaagcagttcttctgccttagcctcccaggtagctgggattacaggtgcagaccaccacgcccaactaatttatttatttattattattattattattattttttagtagagatggagttttgccatgttggtcaggctgactttgaactcctgacttcatgtgatccacctgccttggcctcccaaagtgctgggattacaggtgtgagccactgtgtccagccaacattattcacttttgttgttacataagatgtcacggccaggcatggtgggtcacgcctgtaatcccagcactttgggaggctgaggtgtgtggatcacctgaggtcaggagtttgagaccagcctggccaacctggtgaaaccccgtctgtactaaaaatatgaaaattagctgggattacaggcgggcacctgtaatcccagctactagggaggctgaggcaggagaatcacttgaacccgggaggcagaggttgcagtgagctgagatcgtgccattgcactccagcctgggtgacagagcaagactgcgtctcaaaaaaagaaaaaaataaaaaagatgtcagttatggctatttgtactttattatacttcatgtgatgatatatggttcagcatcagggtcttttttcagttaagttcagttgaacccttttcctgtttagaatattttttaaaagtataaaaaaacttaataaaagaaatggatggctgggcatggtggctcacccctgtaatcccagcactttggtaggctgaggcgggcagatcacctgaggtcaggagttcaagaccagcctggccaacacagtgaaactccatctctactaaaaatacaaaaattagctgggcgtggtggcggccgcctgtaatcccagccacttgggaggctgaggcaggagaatcccttgaacccgggaggcggagattgcaatgagcctattgcgcaactgcactgtagcctgggcgacaagaaggagactccgtccctcccataaaaaaaagaaatagatgactacatttaaaatatcttccatttaaatccatagtttacaaataaaggaaaaagcagtggaggaagagagtgagataattacttcatttttacaatgttaaataattacaattaaaatttttgtgtacaattccacatttaatagcaatttgcaaatgccttattgccaggtgtggtgtcttacgcctgtaatcccagtactttgggagcccaaggtgggagaattgcttgagccctggaattcgagaccagcctgggcaacatagcgaaacttttgtctctacaagaaataaaattagccaggtgtggtagcctgcatctgtagttggaggtactgggggagctgacgtgagaggattgcttgagcccaggaggttgaggctgcagctgacatcaagccactagactctatcctgggcgactaattgagaccctgtctcaacgaacaaagaaacaaaaaaaacccaaatgatttacttaccattaaataccaagaaaagaatgactggagtaagcttagatttagatacaacaaaatcatggagcttatcatttgaaaggcatttttgacttttcataggtgtgtagcaagcaaagtggtccttttgaaaaatgcaagtcacatcatgtcacttttctgcttggcctttgcctacttctcgaatggttctcctagcacattctaactggtcattattcattgtgtttcagccattctggccttcaacctatttctcaaacaccccaatcttgggtatactttagggcccttgcatttgctagctcatttacctggaaaattctgcggtaacttcttgcacataataggtgctaataaatattggctgcatgcaaccaaaaaagctggcttcggtagtagaagtagtagaagagaacattaccaaagtccttttttttgagacaagatttccctctgttatttaggctgagtgcagtggtgccatcacggctcactgcagccttgacttcttggactcaaatgatcctcccacctcagcctcctgagaagctgggaccacaggtgtgtgtcaccatgcctggccaatttttttatttgtagagaagaggtcttactgtgttgcccagaatggtgtcaaactcctgggctcaagtgatccacctgcctcagcctcccaaaatgctgagattataggtgtgagccactggtccagcctcttaccaaaatctttttttttttttttttttgagacggagtctcgctgtgtcgcccaggctggagtgcagtggcgggatctcggctcactgcaagctccgcctcccgggttcacaccattctcctgcctcagcctcctgagtagctgggactacaggcgcctgctaccacgcccggctaattttttatatttttagtagagacggggtttcaccatgttggccaggatggtctcgatcttttgacctcgtgatccacccacctcggcctcccaaagtgctgggattacaggcatgagctaccgcgcctggccgcctcttatcaaaatcttaaacttgttaattcttgtatctcaccttgcttttatatcagtttttgttatagaatgtgctttctttttaggttatttttcttctgctcagcaagttaactttgaagaatcttttttttcttgccttttttttttttttttgagacagaattttggttttgttgcccaggctggagtgcaatggcgcgatctcagctaacggcaacctccacttcccgggttcaagtgattctcctgccccagcctcccgagtagctgggattacaggcatgaggccaccaggcctggctatttttattttttattttttatttttattttttactagagacagtgtttttccatgttggtcaggctggtcttgaattctcgtcctcaggtgatccacccgccttgacctcccgaagtcctgggattacaggtgtgagccagcgcacccggcctcttgccctctttagagcagttctacataaatctgtggaataatctgctgacgttagaaataaacctttctcagggtgtggccataatctggttcgttgtaattgctgaaggaaaaaactgaacccttaggaacagtttaaacattctaggtggtttttagatatattattcctgttagagttttgaactttgatcatcttgttagaaaaaagaggccaggcactgtgcctcatacctgtaatcccagcattttggaggctgagtcgtcaggaagtcacttgagcccaggagtttggtaccagcctgggcaacatatggagacctcgtctctacaaaaaaaaaaaaaaaaaaacaaaacctgttagccaggcgtggtggctcatgcctgtgttcccagctactcaggaggctgagatggaaggattgcttgagcctgggaagttgcgactgcagtgagctgtgattgtgccactgcactccagcctgggcaacagagtaagaccctgtctcaaaaaaaatgaatttttgcattcatttaaaaatgaatggtagcaacattttagataataacttatgtagtctgtgtgaatctcatcaaatatatgtgatttttaatgcttggaatcctagaattttagtgagggaggagctctcaagttatctaatttactgtcattttacagataaaaactaaacttctgatagatgaaaggatttataccatacatctatatgataattgcatatggctgagttgaggttagaacccaggacccaatctttgatttgatttcttttcattatgccaatttagaataaaattttttctcttggttttctgacctttggccacttcatcttttgaaggatcttgtaagttccttgatatttctcaaaatgtcagttttattctcttcaatgaaagttcttgttaggtgaaagtagcctttcatatccttaaatgtgaacctgttccttaggctggagtttttgtactctccattatattggcatttatagttgttggttttcttttttttttttcttttgagacggagtctgtctctgtcgcccaggctagagtgcagtggcgcgatctcggctcactgcaagctctgcctcccgggttcacgccattctcctgcctcagcctcctgagtagctgggactataggcgcccgccaccatgcccggctaatttttttgtatttttaatagagacggggtttcactgtgtttgccaggatggtctccatctcctgaccttgtgatcctcccgcctcggcctcccacaagtgctgggattacaggcgtgagccactgcacccggccagttgttggttttcttttctgtgccagattgagtgatatatggtggtactaagagcactggaataggagtcaaggactgaggtacagcatagcacctcatgtattacttggtatctccacttgtctctaacactgaagaggtataattggttgtttaaaaactgtgggtgtaaaacgctagtatcccatgaaatggaactgcagaatataagtggatgactctgaaactgcttttgaaacaagcatgagggctcagtttctccatctctcgtgggctccaccatcactgtctgacatcctgatctcctaaggcatctttcctccatcccagagctctgttgaaaatctcttgggctaaaaaccagtacagaccttctgatactcacgttctagcctttttagattgttgtgtgtgaagagtaagtcagctgtggatatttttctttcctattttgtgaggcatttggtatttactggaggctgcctgttttgttgcaaaccttgttccactgtgtactataggaggtctgctcagaaagcctagttagtagagcagtaccatttgctttggtcaattgtagcagcagtctgttttttttttttttttttttttttttgagacagagtcttgctgtgttgctcaggctggagtgcagtggtgtgatctttgctcactgcaacctccgcctcctgggttcaagcgattctcctgccttggcctcccaagtgggattgcaggtgtgtgccaccatgcccggctaattctgtatttttaatagagatggggtttcacccccaggctggtcttaaactcctaacctcaagtgatccacttgcttcggcctcccaaagtgctaggattacaggtgtgagccaccgtgcccggccagcaatctggttttaaaggaggctttgacccctcatttggtaaaaggttccttctttgactaattcccaaaggacatctcgatctgtcttcaaaagaaggggtattccgttgtcagtattcctagctagctctgggagaagagagaacttgattgttttcagggccctggtcagagtctggttttatgcccaagggatgaactgccttttgtccttctacctcctgaagttcagagccctgtgaaaatgaagtggtaaaggtcaagtagcagtagtttgaaaagcaccagcactgggacgattttgtggtagcctagcagagtgggcaggatgcttacttcagaggtgctaaagatgtatttttttttggaacaagaaggttataaatgtttctattaagtttgattttaaagcatgagggttctgggaaaatgagaagattgtacatactctaggcttccttgggactgcatttgaaaaaaaaaaaacttttctttgggtcagccagtatgaaaactgcatttgatctcaatccttcagatcaggcttttggggagagttagttgaagaatttgtttagtctaagaaagttgcttctagcttagctaaatctggaagaaaaaatggaacctgatgtttgagtgctaactgtattccagacagacgttatactccttatattggtccttttgaagcataaatatgtttccaagtcctataataatgaggaaattgcctgtgagagtttaagtaaattgtacaaagtaacacttttggttcagagatttgtttttaatacagagaggacaggttaggaactttgaagcttcagctaaatgagtcagttctcaaatgtttgagaagcatgctcaaggatctggaggaatagcttaattaatttgtacatcatgagaggagtagggagcaaaaatatgtataatttcttctgaatgatgctgtcttttttgatgcagtggtgctaaatgggctttgcttgtatgatacttcttaaatgcattagctaattattttgttttagtcttcttttttgaaatacagatgactctttgagctggttttctttggaaagttatctgtcctgacaattctacttctaaaacttcaactttttttttttagtcttcatttccattgccaccaccctatcctaaattatcccgttatgctggatactgaaatagcttctgcctggtctacttactttcacttcgcccccttacgatccagtgctttgctccttttaatccagtggccagagggatttttttcaaaacataatttgattataacagatctatgtttgatacttatccatggtttcccatggcagttgcagaaaaatccaaaccttgtttggccacactgcccttctttcagtaatttgaattccttaagctttttccagtttcaggatttcccattttgaactctttctcctccactttttcctggccacaggtttcaagagctgacaacttacctcagttcttaagaggatccttcatttatctctaaattggattttcctgtgtccaaaccttacttgttatcacaagtttataattatttgggtgattgtttgatgtgtctctcctgactgggccttaggggcagagaatctgtattattttgttcttgtttatatccctaggagctcttatggtaggtattcaataaatgtttgttgaataaaggcagtggaaaaacacatagaagaggtgctgtggcagcagttctcagtgccaacagttgaattggtttacaatagtaatttttagtgtcaacaaggagatgtgtagtatggaatgtttattagcaagatctttttctcatggaatggaatgtttgaaaacctccaaagtgtaagtttttttttttctcaaaagaaaacagtcatatttggggttacttttttttttgagacagagtcttgttctgttgcccaggctggagtgcagtggcatgatcccggctcactgcaacctccacctcccgagtttaagtaattctcatgccttagccactggaatagctgggattacaggtgtgtgccaccatgcccagctgttttttgtataattattagagatggggtttcgccatgttgaccaggctggtctcaagctcctggcctcaagtgatctgccagccttggcctcccaaagtgctgggattacagatgagagccaccgtgcccggcccattgttacttctgaaatcgaaatcaaatgccatattgattcctgatcttttgtgtatgacctctctctctcttttttttttttttttgctacctctccccgaaagtttttaggatctttttttccacgattatgtaccttgatgtgggtcttttctcgccctttgtgctattaggtctagcaactcatgtgtctcaggtctgggaaatgattttacagtttttccagctggtgcgtaactagctgtttgttctgatactgtcagtatttaactttatgttagaaacatttcataatgcaaatgaaaaatttaagccaggtgcagtggctcatgcactttgtgaggctgaggtgggaggaacacttgaggtcaggagttcaaaaccagcctggccaacatggtgaaaccccttctactaaaaaaacaaaaaaacaaaaattaactgggcatggttgtgcacccccataatcccagttactcaggaggctgaggtacgagaatcactggaactgggagacaggtttcagtgagccgagactgagacagagcaagaccctgtctcaaaatataaataaaatacataaaaaatttaatattatgtatataatatccagcccaggcttttctatttgtcatgccctgtttctttcacatcatagccttactcagatgcctgctgatccttgattgaggtgtgatgcttgagagtcaggctcttaaatactactggcgaattcagtgcattgtggttttgtgacttcacttgtctcttacagaagtggggaagtggtttttacttcgatgcatggttctgaagtagagatgtctatctcctgatgcacactttaaataatccccatgttttccactccatactccatccttgtctggtttaagctcttagcctgtctgcagttcaggggatgaatctgcttggttcttttcagcatctccctctgcaacgcttagatctcatcttcctttgctttgctaactattctctttgcttctccatttgtttctctgtcattgatgacttccaagttatatccccatcctggatattccttttgaacgtcagactcatatattcagttacctcctcagtatctctattcggatatctaatggcatctcaaaattaacatgtgcaaaaccaacctgttccacccttgtgttggctgtataaattagtgggaactccattttttaagttgcttaaatcagaaacctgggagtcatcaattttggagtctgtccctttgctcttgtggcacatgtaatcacgaataaatcctgttggctctatcttcagaatatatctcattttatcactctctctgccaccagagtggtttaagccaccttcatctcttaggttattttagtagcttcctaactggtctccttccttccattcttgccaccttcctcaacaccgaagatatattttatttatttatttatttattttgagacagagtcttgctctgtcaccccagctggaatgcggtggcttgatcttggctcactgcaacctctgtcttccaggcttaagcaattctcctgcctcagcctcccgagtagctggggctgcaggcatgcaccaccatgcctggctaatttttgtattttttagtagagatggagtttcaccatgttggccaggctggtctcgaactcctgacctcaggtcatctgcccgcctcagcctcccaaagtgttgggattacaggcgtcagccaccatgcttggccaaattttttattcctttgggtaaagagatgtattttatttcctttaatttggtaatatagtgagttatgttaatagattctttttttccagtgctcaagcatccttgcattcctaggataaatggtacttcaacatgattttccttttaaatatacattgctggatttaggttataaattattgagaatttttgcatctgtatttacaagtgttacattctaatttcaggccttttccagttttattatcaaaacaagctgtgctgtttttcctctcttgattctcagtagtagtctctttaagatagtgattattcattctttttggtagatcatgcctataagacctgggcatgtatgtttttattgtgggaatatattgtttttactttccttgttatgaaatatataatttattttaaaatatgtatatacagagtttgtgttcctttaaagaataatagctaaaaataaattgcacgcccccacatccaaccatcgtcaaacaaaacatcttttacactctattttatttatttattttcccccacccctctagagtatacacccttttggagcctctgagcattttcctttccctcactgctttagaaacctctattcagatttttcatattaatgattcttttgcttttaacccacatgtgttactgaagtttaagtcctaaataataatttttcctgctttaaaatatatttttatgtcaatgaaatcatactggtggatgtattttctctgatttgctgcttttgcctctcatttctgagcttgatctatgttggtgcatttatagaaatacttcatattttctgctgtgtatcatcttatgctatcaacgtgccatatgatttacctgttcttagcatgtatttgggttgtttctggttcttgctgtaacaaacagctgcatttagtgcttgtgtatgtgtctcctgatgcatgtgtgcattcacttctctggggtgtatatgttgctgggaatgggactgagtattgtgagtgtataatagtatcttgtttttgttttttttccctctcagtttatggcataatttacgtacagtaaaatttaccaccgcccccctgccccgcctttttctttttctgaaacagagtctcgctctgttgtccaggctggagtgcagtggcacaatctcggctcactgcaacctttacttactgggttcaagcgattctcctgcctcagcctcacaagtagttgggattacaggtgcctgccaggctaattttgtagagacagggtttcaccatgttggccaggctggtctcaaactccttacctcaggtgatccacccaccttggcctccccaagtgttgggattagaggtatgagccaccacgcccagccaaattcaccctttttagtgtacaagtatacagctttgtgagagtttgatttctttagttcaaatttgttttaaagttatatttggtattttaacagtgctatttaaatatatgccatatatggcttgaatgcaattatcctagtacagatggtccttgacttatgatgtttttgtgtccctgtaagcccaccttaagttgaaaatattaagttgaaaatgcatttaatatgactaacctgctgtaaatcctaacttagcctaccttaaatgcacttagaacacttaaattagtttacagtgggcaaatcatcaaacacaaagcctatttgtaataaagtgttgaatatcttatataatttattgaatactaaagtgaaaaacaatagttgtatgagtagtcagagtatggcttctcttcaatgcatatcactttcatataccatcgtaaactcaaaaaatcataagtcagggtatgctgtatattttattggtgctaacatacttccattttaaaatacaggaaattcacctttttttgtgtatagtcttgtaagttttgacagatctatatacagatatgtaatccccacccatgattcttttttaatttaaaaaaatatatttttgagacagtctcactgtcacccaggctggaatgcagtggcatgatcgtagctcactgcagcctcaaactcctggccttaagtgctcctcctgcctcagcctcccaaagtgctaggattacaggaatgagccagtgtgccctgccaccaccataattaagatccagaacagtttcatcatcccagaaactttccctgtatccttttgtagtcagcttcttttttcacccccagctcctggtgaccactgatttgttctctgtccttgcagtactgtcttttccagaatgccatataaattgaatcctacattatataacactttgagtctggcgtcttttacttagtgtgaagtatttgagatttatttgtcttgtgatgtgtattagcaatttatttcttttttcttttttttctttttggagacaaggtcttgctctgtcacccaggctgaagtgcagcggcacgatcatagttcactgcaggcttaaactcaagcaatcctcccacttcagcctcctgagtagctgggactgcaggcgcacaccaccatgttcagctaattttttttttttcttggtagagacaggatctcactctgttgcccaggctgatttcaaactcctggcctcaaggaatcctcccacctatgcctctcaaagtgctgggattacaggtgtgaaccattacagttggctagcagtttatttctgtatattgcaggatagtatctcattgtatagatgtaccacattttgcgtattcattcttcagttgatagacatttggactacttcctccttttggctgctgtgagtaatgctgctgtgaataaatatttgtgtgtaagtttctatgtggacatacagtttcattattcttgggtagataaaccttggagtaattgctgggttgggtggtaatttctgtttaacttttaaagaaatagctaagctgttttccaaagtggcttcaccatcttaaattcaagtttttgttttcgttgtatttgaggcagagctttactctcttgcccaggctggagtgcaatggcaagattatattatagctcactgcagcctcgatcttccaggctcaagcgatcctctcacctcagcctcccaggtagctgagagtacaggtgtgtgtcaccatgcctggctaagttttgatttttagtagagataaggtctggctatgtttcccaggctggtcttgaacttctgagctcaagcagtcctcctgccttggcctcccaaagtgctgggattgcaggtgtgagccaccaagcccagccaaggtttttgtgttttagtaaaatttctgctcttcctggcaatacttttttctgaaatttactttgatattgatatagtcactccagttcttttcagtgcttagtttttgcatggtatattttttccatccttttgtgttatactgtctgtttcattatatttgtagttggaccttgattttttttttttccctaattcttttacttgggatgcttggacctaatgtgtgtctagtttttcctaatgtgtcttttacttgggatgcttggaccatgtgtatttaattattgatatggttgggttaagtccaccatctagctatttgttatttatttatttttagagccaaggtcttgctgtgccacccaggctggggtgctagtggcatgatcatggctcactgaagcctctaacttctgggctcaagcagtcatctcactgcagtctcccgagaagctgggattacaggcgtgtgccaccaagcctagctgattttttttttttttttccgagatggagatttgctcttgttgcccactctggagtgcagtggcgcaatcttggctcaccgcagcctctgcctcctgggttcaagcaattctcctgcctcagtctcccgagtagctgagattacaggtgcctgccaccatgcccagctaattctgtatttttagtagagatggggtttcactatgttggccaggctgatcttgaactcttgacctcgtgatctgcccgcctcggcctcccaaagtgttggaaggccgaggcgggcagatcacgcctgtgctgggaggctgaggcgggtagccactgctcccagccctgaaatctttcctcttttctaagatagacatttaatgcacacacacattttgatatgctatgttttaattttcattcagcttaaaatatctaatttttcttttgatttattctttaacttactgattatttagaagtgtgatattatattttgggaataaaaatccagagatcttactgttactgatttttgatttaattccattgtggtaagagaacataccttatatgatttgaatccttttaaattgattgagacttgttttatggatcagaataaggtgtcttgataaaggttccacgggcacttgaaaagaatgtgtattctactgttgttaggtagagcattctattaatgttgattggcttgttgattgataatgttcaagtcttctgtattcttaccgatttcctattctatcagttatagacagagggtgttaaaatctcaattctgttttgcttgttgattgataatgtttaagtcttctgtattcttaccgattttctgttctatcaattatagagagaggtgttaaaatctcaattctgtttgtttttggtttgaaatttacttataaggtacataagcatttatgattgtcgtcatcttgatgaattggtctctgtcattttgaaatgacagaacttactttgtctcataatatagctactcgtgcttttcatttgattagtgtttggcatatatttttatattttaaaaaaacttatcacctgtgtctttatgtttaaagtggttttttttcccaggcatcatgtgtttgggatcttgcttttatccagtttgatagtgtttgccttttaattggagtttgtagactatttatgtttaatgtgattactgatttttttttgagatggagtctcgccctgtcgcccaggctgcagtgcagtggcacgatctcagctcactccaacctccgtttcccgggttcaagtcattctcttgcctcagcctcccaagtagctgggactgcaggcacctgacaccacacccggctaatttttgtatttttagtagagatggggtttcaccatattggccaggctggtctcaaactgctgactttgtgatccgcccacctcagcctcccaaagtgctgggattacaggtgtgagccactgcggctggatgtttactgatttttatagagtttaaacaaccatcttttctatttgtctgatgtggtgtttttttcgtttttgtttttttaagatggactgtcactctgtcgtctaggctggagtgcagtggtgcaatctcaactcactgtaacctttgcctcctgggttcaagcagttttcctgtctcagcctcccaagtagctgggattacaggtgcgtgccaccacacctggctatttttttttttttttttttggtttgagacagagtctcgcactgtcacctgggctggagtgcagtggcgcgatctcggctcactgcaatctccgcctcctgggttcaagcgatactcctgcctcagcctcccaagtagctggtattacaggcgcccatcaccacacccagctaatgttttgtatttttagtagagacagggtttcactatattggccaggctggtctcaaattcctgaccttgtgatctgcccgccttggcctcccaaagtgctgggattacaggcgtgagccaccgtgcctggcctaatttttgtatttttagtagagatgggcttttgccatgttggccaagcaggtctcgaattcctgacctcaagtgatccctgcccttggcctcccaaagtgctggcattacaggagtgagctacgccatgcctggcctggattgaggattttttagtggttcatttttaagtcctttcttggctcattagtactttgttattttagtggctgctttagtgtttattgagttcagcttgtgaaactcagtctttaatattataccacttcacctatattacaagaaccttatagcagtacacttcattttcccttcagactttgtgctatgtttgtcatacacttcacttttacatatgttgtaaactccacaatacattattatttttcatttaagtagtcaatttttttaaaacaatttttttttttttgagacggagtctcactcggttgcccaggctacagtgcagtggtgcaatcttggcttactgcagcctctgcctcctgggttcaagtgattcttatgcctcagcctcctgagtagctgggattacaggtgcgccccatcatgcctggctgatttttgtattattagtagagatggggttttgccacgttggcccagcaggtctcgaactcctgagctccagtgatccgcctgtcttggcctcccaaagtgctgggattacaggcatgagccaccatgcctggcctaaaaagattttaaaagtaagaaaaaatgtcttttactttatatgttttccatttctggtgttctttattgcctatgagcggttccagattctcatctgccagattttcttcagttttttctcgtcagttcagattttctttctgccagaggacttcctttaatgtgtttcttgtagtgtaggtctgctggtgatatctttaagctttggtgtgtttgaaaaagtacttcctcttgtttttagaaagatatattcctttgatacagaattctaggttgacaggtttttttcattgtgtactttaaagatgttgctccactgtctctagcttgcattatttctcctgtaaaatctgttgttattttaatctttgttcttcagcgagcaaatttatcttttttgccttttttggttaatttttaagattttctttttatcactgctttttcagcaatgtgtttattatatactttgttgtagtttgcgtcatatttcttgtgtttgaattctcttgagcttcatggatgaaatttacgtattcagctactatttcttgaaatatttttcttttgtacttccccaccgcatctggagtctgtaattacatgtatatttggctgcttgaagtagtcatacaactcactgatgcactgttatgttttttagtcatttgattctctttgttttgggtagtttctactgatcttcatttcactagtctttatctttcccatgttaaatctgttactcttatccagaattataccttttatccttaaaaattcagtttttttcttttttttgagacggagtctcattctgtcacccaggctgaagtgcagtggcatgatcttggctcgctgcaacctccgcttcccaggttcaagcgattatcctgcctcagcctcccaagtagctgtgattacaggcatgcatcaccatgtctggctagtttttgtatttttagtagagacagagcttcaccatgtttgccaggctggtctcaaacccctgacttcaggtgatccacctgcctcagcctcctagagtgctgggattacaggaatgagcgaccacacctggtttgtttcttaaaaaacatcttatatttctctgcttaacgtgctcaatgttgaacatgtgaaatataataacttttcataatctcttctgattctgtctctatatcatctttgggtctgtttttatgtattctatttttcttgtcattatgggtcagatttcccagttctttgcaatcctaataaattctgtttagatgaaagacattgtgaatttcactttgggttgtggatatttttgtattcatgttggtatttttgagatttgttctggagtgcagatgagttagctggaaactaattcttttgaggcttgctttttagctttgttaggtggggcgtatcctttctgtgtttatttttgtaagggtatacagatatacatgttttcttatttccctctttatttattcttatttaatctgtaacaatctttttccttatattcgtaacattcttagttagggagtaattacctcttccctaactgttgcattagcttcttaattggcactctggttcccagactttttctgtctctaatgcagtgtacagactactgtcagaataattctaaagcacaattctgatattgtcactgtattgcttttcagtgcctacagcagtaggattcacttaaaaaattattcccctaatagtaatataaaaaatttttttgagctcaaactctcattctctctcagtatacatatttgtttatacatgaggtcacatactgcttactaagttagcattttttatgtgttcattttgaaataactctgaacagtggtatccaatcttttggcttccctgggccacattagaagaagaattgtcttgggccacacataaaatacactaatgatagctgaatagctaaaaattaaacattgcaaaaaaaaaaaacaaacaaaaaaaactcactgtggctttttttttttttccctgtatttttctttttcccgagatgaagtcatgctctgttgctcaggctggagtgcagtagtgtgatctcggctcactgcaacctccgcctaccaggttcaagcagttctcctgcctcagcctcccgagtagctgggattaaaggggtaagcccccatgcctggcctttttttttttttttttgtggggtgagcgaccatgcctggctttttttttttttttttttttttttttttttggtagagatggggtttcatcatgttggccagtctggtctcgaactcttgaccttgtaattcacctgccttggcctcctaaggtgttgggattacaggtgtgagccaccactcctggccttttttttttttttttttgagatggagtctcactttgtcacccaggctggagtgcagtggcatgatctcggctcgctgcagccactgcctcccgggttcaagcagttctcctgcctcaccctcccgagtagctgggattacaggtgtgtgccaccactcccagctagttttttgtatttttagtagaggcaggtttcaccatattggccaggctggtgaactcctgacctcaagtgatgcacccacctgggcctcccaaatgctgctggaattgcaggcgtgagccaccatgccaagccaattgtgttttaagaaaagtttatgaattagtattgggcagcatcgaaagtttacaaagtttgcgttgggccgcattgaaagctgtcctgggctgtgtgcgacctgctggccgcaggttggacaaacttgctctgggacataagtttaaaagttataggccaagtgccttggctcacgcctgtaatgtctttgcatttcatcagtttttccactgttatctttctgttacagtacacggtcagaataccacattgcatttagttgtcatgtttccttagatgtgaaacaaatttaccaattgtagtagggtatttacgtatagatcggttcgtttgtagccttatagtatctagttaaaacactgttataaagttattgttatgtatccttttgggtgtggtttctttccttagaaaaatacatttaaaattcattcatgttgttaaatgaatcaataggttgtttctcttttaaaaattgagatgaaattcacataacaaaattaaccattttatttttttaattttatatatattttctgagatggagtctcactctgtagcccaggctggagtgcagtgacgcgatctcggctcactgcaacatctgcctcctgggttcaagcgattctcagccttaaccattttaaagtgcacagttaagtggcatttagtacattcacagtgttgggtaaccatctttatctggttccaaaacatttttttttctttgaaagaaaaccccgtatttattaagcatttttctctctgtccttttcccttcactcgcttctggcaaacaccagtctgctctgtttctgtggatttacctgttctggatattttatacaaatggaatcatagcgtatgtagccttttgtggctggttttgttttttttgtttgtttttttttttgttttttttttttgagacggagtcttgctctgtcgcccaggctggagtgcagtggcgggatctcggctcactgcaagctccacctgccgggttcacgccattctcctgcctcagcctcccaagtagctgggactacaggcgcccgccactacgcccggctcattttttgtatttttagtagagacggggtttcaccgttttagctgggatggtctcgatctcctgacctcgtgatccgcccgcctcggcctcccaaagtgctgggattacaggcgtgagccaccgcgcccggcctggttttgttttagtaagatacttttgctggattaagaataaggttgggccaggggtggtggctcatgcctataatcccagcactttgggaggccgagttggcccagcctggccaacacagtgaaaccccatctttactaaaaatacaaaaattagtcaggcatggtggcgggtaccttgtaatcccagctacttggaaggctgaggcaggaggattgcttgaacccgggaagcggagtttgcagttagccaagatcatgccactgcactctagcctgggcgacaagagcaagactcgtttcaaagaaaaaaaaaagaatacgtagttgacaggtttttttttctttcaatactttaaagatgatataccactgtcttgtcactcaccttgtttctaacaagaaatctgctatctttgttctgtattttgcatgctttttttttccttgctgcttttattattttctctttattactggttttgagcattagattatgatatgccagtatggtttttcttgtgtttattgtgcttgtggttcattgatgttcttggatatgtcggtttatagctttcttcaggtttcggattttttttttttttggccatttttttcaaattattttccatttaatttctcttttctttttagtcaggtactctttatccaaacattaggctgcttgaagttgccccatagcttactgatagtttttgttttaacctgtgttttatttgaaagattctatttctgtgcctttgaatttactttcttttgcagtgtgtaatctgaagttagtcacatttagcatttttaaaaatctcacatattttactctttttttttttttttttttttttttttttttaaagactgagtctcactctgttgcctgggctggggtgcagtggcacaatttcagctcactacaacctccgcctcctggtttcaagcgatcctcccacctcagcctcccgagtagctgggactacaggcacccgccactacgcctggctcatttttgtatttgtagtagagacggggtttcgccatgttggccaggctggtcttgaactcctgacctcaagtgatctgcttgcctcagcctcccaaattgatgggattacaggtgtgagccaccatgcccggccatattttacctttttttatcgttagaattttgatttggtttaaaaaaaaatctttcctgtctctacttaagtttttgaatatatgaaatgcagatataactcttataatgtccttgtgtactcattctaacatctgtgtcatttcagggttggttgcaattgactattctctttagtatacttttttttccttgcctcttgcctggtgatctttgattggatttcagacatagagagttttacctcgttgggtgctggggatatttgtatttctacatatgttctttaactttgttattggatgcagttaagtcacttgaaaaccgttgattcctttaggtcttgtttgtaagatttgttagctgggaacggtgtagtagttggtttatggctaattcttcctcacttctgagacaagattcttcccaaatcttgagggttgtcttgagatttccagtctaatagctacttgagtgggtaagggcagagtactgttcataattcttttgggtgttgttttcctctccttgctgcccatggtcttgggtagtttcatcacactatgggccactcagtactcagtgagtacctctctagatctcctcagccctctactgtgtggtattgtcccatgaattctagctgcctaagtcctgcactctgagctgagctcgctgtcttcaattttgagttctgcagcctccatagggcttctgcttctgcatggtgcccaggaaactctcttcaggcactaagtttggccatcataggactcatatctttgtttctcttcctttggggattactgtctctcattgcctgctgcgcagcatcttgaaagctatagtttcatgttttgttagttattttagtggtttaaggtgagagggtaaatctggtccctgttgtgcttgaaaagtttttttcaacttttcttttagaaataattttaggtttactaaaagctgcagaaataatacagagttctgaggtgtctttcacccacttcccccatgataacattttacataaccatagtatagttattaaaactaggaaattgacattggtataatagtgttaactaaacctcatgccttatttcatattttcacatgaactattttgagctggcatggttaatatacagttctatgaagttttatcacgtgtatagatttcgtgtaattatcactagtcaggttatagaagtattccatcattttaatgaaatgcctttgtactactcctgtgtagtcatcatgtcctccttccagcctccaccaccaatcaaccaaccaactttaatcctggcagctaccagttgtctgaattttatcactttcgctataattttatctttctcagaatgtcataatacagtagtccccgttatctgtggtgatatgttctaagacccccagtggatgcctgaaaccagctatagtactgaaccatatatgtgtgtgtgtgtgtgtgtgtgttttttccccccccccctttttttttttgagacggagtctcactctcgtcacccagactagggtgcagtggtgtgatcttggctcactgcaatctgcacctcacaggttcaagcgattcttctgcctcagcctcctgggtaactgggattacaggttcgtgttaccacgcaggctaattttttgtatttttagttgaggtggggtttcaccatgttggccaggctggtctcgaactcctgacctcaagtgatccacccaccttagcctcccaaagtgctgggattacaggcgtgagccactgcacctggcctactatacatatacgcctatgatgaaatttaatttataaattaggcacagtaagagattaacaataataaaaaattataacaatatactataataaaagttatgtgaatgttgtttctctctcaaaatactgtaatattttcaggctgcagttgaccatgcgtagctgaaagcaagggtaagtggtgactactgtaaatagaatcatataatatgttacctttgagattggcttttcttttttaactcggcaaaatgcctttgaaatcgatccaagtcctatgtattaacactgtttctttttattggtgagtagtattctattcttgggcacactacagtttacccattcttccattgagagcatttctcccccctaaattacaaacagagatggagtcttgctttgtggttggtctccaactcctaggctcaatctatcctcctgcctcagcctcccaaagtgctgggattagaggcatgtgccactgtgcctggccccactgaagaacatttgagttgttcccagtttggggctattacaaataaagctgctgtgaacatttgcatgcagattttagtgtgaaaatatttttatttctctaggatgaatacctacctatgagtagaattgctgggtcgtatgatacatgtatatttaactctgtaagaaacgactacactgttttccagagtggtggtagtttttcattcccactaacaatgtataagaaatccaattgttctgcttttttattagcactttagtattgtcagtatttttccttctgttcattgtaatagatgcatagtagtatctcatgccttaaatttgcatttccgtagtggctaatgatgttgaatatcttttcatctccttaggttccatttgaatattctctttggtgtagtttatgttcaagacttttctattttcaaattggattttttcttactgttgagtgttctagacacaagttatttgttggatacgtgatttgcaaatattttctcctaatcttttaatttgcctaagagtgtgcttcatagagcaaaaggtttgaattcttatgaagtctaatttatctatttttaaattttatagttttttttggtgtcatatctaagcactctttggctaacaaaattttctctttttttctaaaagttgtatgctttacatttaagtctgtgattgcatttgaattaatttttaaattaagcataaggttacatcaatgttcattttcctttttgggggaccaattattccaaaaccatttgcttaaaatgattattctttatttattgaattgctttctcacctctagcaaaagtcagttggccatattttgtgaaaagttctattcctacgcacactgttctggctcattgacctacgcatctgttcctctgtcaataccgtactgtcttgattactgtaatgtagctgtatagtaagtcctaaaatcaggtagtgttattcctccaccttcgtttttctttttcagagttgtttcagctattctggtttctttgtctttacatggaaattttatttatttattatttattttcttgagacagcctcagtgttttgcccgggctggggtgtggtggtatgatcatagttcactgctgcctggaattcctgggctcaagggatcctcctgcctcagccttccgggtagctgggactacagatgtacaccaccactcccagctaatttttactttttttgtagtgctggggtgtcaccctgttgcccatgttggtctcaaacacctgggctcaagtgatcttcctgcctcagcctcccaaagtgctgggattaaaggcatgagccaccacagtcagctgtgtatgaattttagaatcatattatctacaataaagttttggtggagtttcaatagtaaatgcattaaacccattggttagtttggggagaagtgacatcttggccatgttgtcttccagttcatggatatagtatgtttttttacatttatttaggttgtcttttttttttaaaggtacataataattgtacatatttatggggtgcatgtgatattttgatacaggtatgcagtgtataatgatcaaagcaaggtatttaggctatccatcacctcaaatatttatcatttctttatgttgggaatttttcaactcttcccttctaggtattttgaaatataaacaaattatagttaactacagtcaccatactgtgctgttgaaccctggaactaatttcttctatctaactgtatgtttgtacccattgaccaacccctctttatctccctgcccccttcccagctctggtaacgatcattttactctctgcctccacgagatcaactcttttagctcccacataggagtgacaacatgtgatatttatctttctgtgcctcttcctttacttaacaatgtatttaggtcatctttggtatttttatcagcatttcataggttttagcatgcatattttgtacagttttgttagatatatacctagttttttttggtaaactattataaatgaaattgtgcttttaatttttgtttctaattgctgattgctaatatatagacattattgatgttagtgtgttgatctgtattctgtgacctttataaactcacttattagttctacaagtttttctcctagaatctttgggattttctctgttagaccatcatatcatctgttaatagggccggtttaatatattcctttctgatatgtgtaccttttatttccttttcttgcttgattgactagctgggacttgtttgctgtgtcgaatatgagtgcttagtgtggacattcttgccttattcccgctttcagatagaaagcctttagtctttcaccactagtatgatgttagttatagacattttatagatggtctttatcaagttgaggacgttttcttctattcctagtttactgagagtttttatcatgaatgtatttgttgaattttgtcaaagtttctgcattgatataaataattatgctttcttttcacatcttattgttttagtttgcatttccttgatgatgaattccttttcatatgcttactgaccattttatcatcttcctgcgtgaattttctattagttttgcccatttaaaaaaagtttttattttgtagcaattttaagctttcataaagttctaagtacagtacaaagaactttattttttcctgacccattttagagccctgttgttccttactatttttatttattttttgagacagggtctgtcactctgttgtacagactggagtgcagtggtactatcatagctcactccagggcataaacgatcctcctgcctcagcctcctgagtagctgggacaagtgtgtgccaccatgcctggctaatttttttaattttaattttttgaacttctgggctcaagcgatcctcttgcctcagcctcccaaagtgttgggattataggcatgcaccaccgcacctggccctacccttaatactttagtattaatgttttagtatatttgccttaaagttaatgacattctccttgctacctgtccacaatacattcataaaattcagaaaattacactgagtcattattaccatctaatcttcagatttcattaaagtttagctaattgtccatgtaatgtcctttttgtccaaagtatctaggtcagaattatgtgttgcatggagttgtcatatgtctttggtctccttcattctagaacagttctttaatctttctttgattttcgtgaccttgactcctttgaagactacagaccagttattttgtggaatcttttttagtttgaattttctcataattggattcaggttttgcatctttgtcaggtatagcagagaagtgatgctaggttcttagtgtgtcctgtcaggtagctctttatttcagttttttcctattattgattatctctttgatcacttggttaaggtagcatctgccatccttcatcactataaagctcctttttacccccacccctttttttttgagatggggttttgctcctcttgcccaggcttggagtgcaatgtctcaaaaaaaaattaatagtaatatatacagtcatagttagaagccaagatctagtttctaaatgtttgctgctgttggagtgttggtgatcccagttcctttcagtgggaaggggctaaggaatatatgggtatatttacatacatacacatatgttcactcaatctatatttatatctgtctttatctaaatatgttgaaaactatgagcttaccccaataatacaagttctaatccagtcattctagttttttccctttccatatgtataagtcctttttccaacaataataaatctgggctgggcgcagtggcttacacctgtaatcccagcactttgggaggctgaggcgggtggattgcttgaacacaggcgttctagatcagcctgggcaacatgtcaaaaccccatctatatggggaaaaaaaaaaaagttagccaggtgtggtggcacatgcctgtagtcccagctactcaggaggctgaggtgggaggatcacttgagcccaggaggtcaaggctacagcgagccgagattgcaccactgcactccagccagagctactgagtgagaccctgtctcaaatctattccctaatatatttacctaattatttaatcacccactcttcactgttgcagccctttcttcatgcagatgtcctctttactttgcttggactccaacaccctgtgttgggttggctccactctcatcccatggatgagttcactcaagctctgaccagtcacatcagggtgttctcccatatacatgcccttctcaacccgcgtgggcttcaatactctgtcctttgtcattccctgtttgggcatttcactcatcttgatctccaactctcacgtcataccacactcagatacacacagataccttctgtgctccactcaggctctgactctctactcttgtctacctagcctcaggcctccacttttgtatggatgcctaccttgctgtgtaccatgtaatggaagggaagactagtttgggggaagagaagggcagctcttcccatttaaaaagattggtttgtctttttgttttaggtttatagaattgaaatatataggtgggcttggtggctcacgcatgtaatcccagcactttgggaggctgaggcaggtggatcactttggtttaggagtttgagattagcctggtcaacatggtgaaaccccatctctactaaaaatacagaaaaattagctgggtgtggtggagggtacctgtaattccagctactcagaaggctgaggcacaagaattgcttgaacctgggaggtggaggttgcagtgagctgagatcgtgccactgctctccaacctgggcaacagagctagactccgtctcggggggaaaaaaaagaattgaaatatatgtatacacacacatatacacactctggatacatactgtatcccgagtatgtgttttgcaaatattttctcccagtctgtggcctgccttttatttcttttcttttttttgagacagggtcttcctctgtcacccacgctagagtgcggtagcacagtcacaactcaccgcagcctcaacttcctgggctcaaagtgatcctcccacctcagtctcttgagtagctgggactacagacacgtgccaccactcctggcccattatgtctgttttttgtagagatgacgtctcactatgttgcctagggtggtctcaaactcctaggctcaagtgatcatcccacctcagcctcccaaagtgctggtgagccaccatgcctggcctggcctggcctgcctttgcatttttattaaagtgtcttttgattagaagtttttttgttttgaggaagtctgttttatccacattaaaacaatatgtttttaggaacttttgcctatctattaatagtgcacaaaaatattttttggctttatatttttggctcttaggtgtgcgatttatgtcaaattaatttttatttttgagagggagtctagctttgtcacccaggctggagtgcagtggcacaatcttggctcactgcaatctccacctcccaggttcaagcaattctcctacctcagcctcctgagtagctgggattataagcacttgccaccatgcctatttttctatttttagtagagatggggttttaccatgtttgccagcctggtcttgaactcctgacctcaggtgacctgcccgcttcagcctcccaaagttgctgggattacaggcttgagtcaccatgcctggcctcaaattaatttctatgtacggttcgaggtagtcattcaggtttgcgtttttacgtgtttatcttgtttcagctttatttgttgaaatgatgttcccctctttattgaatagctttggtgcctttgtcaaaaatcagttgagtccatacataaggatatgtttttgtactctgttctgttccattaatctatctatttttataccaatattttactctcctgattttagtaagtcatgagattggatagtgttagtagtgtgaatcctctgtgttcttccttcttaaaattgcttggactgcttttggttctttgcatttatttttctttcttttttagagacaaggtcttgctctgtcggcaggctgtagtgcagtgacgcagtcctagcttactgcatcctaaaacttccgggctcaagccatcctcctgcctcaagctcccaaggcgctgggattatgtgtgtgagccaccatgcccagccttctttgcattttcatataaattttagaatcaacttgtcaatttttatcaattaaaaaaattgggattttgattaggattatgttgactttgtagggagaattaacttctcaacagcattttttttcaatccatgaacatggtataatctccagttattatcatctttaatttttcttagtgttttatagtttccaatgaggtcttgcatgccttaacatttttttctcaagtatttttatttttttaattttttaaattaatttatttttttgagatggcgttttgctcttgttgcccaggctggagtgcagtggcggaatcttggctcactgcaacctttgcctcccagtttcaagcgattcacctgcctcagcctccctagtagctgggattacaggcgggcaccaccatacctggctaattttttgtatttttagtagagacagggtttcaccatgttggccaggctgttctcaaactcttgacctcgtgatctacctgccttggccttccaaagtgctgggattataggcgtgagccaccatgcccagcctcagctatttttattttcgatgctattatacatggaatttgttttaaaaatttgtttcccagttttttgccctagcaggtatatagctgatttttcaataacttgtaattttgacataatttcagacacgattgtatttgctttataattctagctacatgttatttttttcatgtactaaagtgcagacataatgccccctaacctctaaatagttattaacaacaagtacattctctttcataaccacattgcaattatcaatgtcagaaaattaatgttgatatggtactgcttgctgtctaatgtgcatactttgagctgggcttggtggtatacacctatagtcttagctactcaggaggctgaggtgggaggatcgcttgagcctaggagttgaaggctgcagtatgccatgatcaaccctgtgaatagccactgtactccagcctgggcaacaatagtgagatccctatctttaaaaaaaaaactgcatattttactgaaattttacctattcttttctaatgccaattataaagcaaaattctggttgaggatctcatccttgatcacatggtacatttgtttgtcaaatctcattttctttaatctgaaaaagttctcacaaacattgtcttttatgacttaattttttttaaagtacagaccatttattttgtattaatagtaagttctccaatatggatttgtcttgatgcttttcattattaaagtaatgtttttgacaggaatacctcagcatgtcctcctcagtacattttatcaggagacacgatacctgtttgtctgatttctgataacgataacttcaaacacttggttaaggtggtgtctgccttatttctctcctataaatagtaccttgtagagagatacagtagtcccctttatctgctggggatgtttcaagaccagtgggtgcctgaaattacagatagtcccaagccctatatatactgtgttttttcctatgcatatgtacttttgataaattttattttattattcctttatttagtttttagaaatacggtcttacaccgttgcccagcctggtcctgaatgaacttctggcctcaagtgatcctcctgcactggtctcccaaagtgttgggactacaggtgtgagccactgtgcccagccccccaagtttaatttctaaattaggcacagtaaaagaataacaacaataactaagaataaaatataacaattgcaacaatgtactataatcaaagttatgtggatgtgatccttctttctctctcaaaatactgtaattttttggactgctgttgaccacaggttatttaaactgtggaaggtgaaacttcgggtagagggcacttactgtactttgagactatatgaatagtctcatgtactttcattcactggttttagcatccactgatgaaggattcctacctaaaacagttagtacgctgaggctgggtgcagtagctcacacctgtaatcccaacactttgggagaccgaggtgggtggatcatttgatgtcaggagtttgagaccagccttgccaacatggtgaaaccctgtctctgctaaaaatacaaaaaaattagctggacatgatggcgcatgcctgtaatctcagctactgggggagggtgaggcaggagaatcgcttgaaccctggagatggaggttgcagtgagctgagatcgtgccactgcactccagcctgggcaacagaacaagactctgtctcaaaaaaaaaaaaaaataaaaaaaataaaaaaaaattagtactctgagagttgttgtcaagtggtgattttttttttttttaagttccaccatttatctgacatctattagttgtggtttttcagtaagggggagagctttaatttattcccccatttgtttattcgttgtgaatttatggattcttttttttttttttttttttttttttgagatggagtctcatgcgctctgtcacccaggctggaatgtagtggcacaatctcggctcactgcaacctctgtctcctgggttcaagtgattcatcttccttagcttcacgagtagctggggttacaggtgcctgccaccatgcccggctaatttttgtctttttagtagagacggtttcaccatgttggccaggcttgtctctccaactcctggcctcaagcgatccacccgcctcagcctcccaaagtgctgggattacaggcataagccactgtgcccggccatggattcctttttttttttttttttttttaaaatatgaagactcgctctgttgcccaggctggagtgcagtagtgcgatcttggctcactgcagcctctgccgcctgggttcaagtgattctcctgcctcagcctcacaagtagctgggattacaggtttgtgccaccacacccagcttttatatttttagtagagatggggtttcaccatgttggccaggctggtctcgaactcctgacctcaagttatccacccgctttggcctcccaaagtgctgagatcataggcatgagccattatgcccagccctacccatggattcttattttattattgagttataatcttactatcatttttaatgtacaaattgtcgctgatttggccagtggaattgcatgtactccagcttttgtgtcctttttatgtgttttcctcattcctgaacacttctttacttacctgctttctgacccagcaagatgttctgggcttagcttatattttcccagccccacttctagaatcatccattttcctggggagctctggtttcttttagcttagaatagtatgcatgtatacatctgtacctgtttctctctttgtctgtctataggtaaatatagtattcatactaataccttgaaattagtctcttactgggggtttcattctaactttacctttctatatgtgcatcttgctactccaacattgaacaacctggcttctattatgtactttgtatctacctacttgctcagttttagtataaacacttagtagttttataattgttaacccattccactgtggaagaacaaatctaactagaactcagtatttgtttatagttcatttaggtttttagcctaaggatatatagtcaaaatacttgaagaattacttgggttagatctgtccttgtgccccttcagtgtggttatgttattcactttaagtatatgtcagtaaaaattttaaatgtatcacaaccacttcctctttttagtgctgtgggaaaacaagcactgttgcattacccttaagaaaagaaataaatttttttttttttttttttggaaacaggtctcactctgtctcccaggctggagggcaatggtgggatcgtagctcacgtcagcctcccaagtagctgggactacaggcatatgcatcctggctggctaatttttttttttttttgcagacatgggggtctcactatgttgcctaggcttatcttgaactcctgggctcaagtgatcctcccgccttgccattccaaagtgttaggattataggcgtgagccactgtccccaggtcaagaaaacaaatggatacttttttttgttgggggatttgatactattaacaaaattatatttgcatctaccttttgaccgattgtttccatttgattattcaaggcagtagtatttgtagttgcagaatattaaaagccatctaaatgctggtggtacatgagggagtggttatactttgatacatcaacatcatggagtatcatgcagctgagaagaaaatgaggaagttttcatgaaacgatagagtaatttccagaatatattgttaagtggaaaattgaagagcaaaatactctctgaggcacgcagattttgttgttgttgttgtttaaggatgaaggataaataaaacagatgtgtatattatcatttgtacaaaaagaaacacaagaagaatacaccggaaacaatgaggttggttaggggactaacaggaatggaatggagagttggagggggatggaaatggaagggatggtggggagcagtgtcacttactctgagtataaccttttatatagttttgatttgtaatcatgttatatttcacataattcaatatgtagataaaataacaaagatgggaaataaaaaacaaaatgggttacaaacaaaagatgaaacccagtgctattaacagctgtacaattcttgatgtgttcaacgtatttcattcttctttctgaatgtttgttcctggagccatcttttttcctgctctccgcatggacagtttgtggtgtaaggtggccagccatcctggtttgcccacgattgaggggtttcccggggtgtaggactttcagtgctaaaactggaaactcccaggcaaactggggcctgttggctactcttttcacgtgcatgtggctgttttcctcggactttccttatatgtaccttgggaattctcttcactttctcctggtatgtcctgcctttcctagatctcacacaaatctcatttattgttactcctttagttgtgtgcgcattctctacacaatacatttatgtagagcagattgacgtagagttgcttctagagaacaggtgcctaggaggtaaattgaggccttacatgtctttattctgtgttccacactagattgttggttgggctcagaattccagaagatgttactcttactactacattcttcagagctgcttttgagaaacatgccattgtgatttctggatatcgtgtgttttttttgaccggaagattttaggatctgtttctctcctgtgttttgagatttcatgataatgctgtggaatgggtctttttcattcattatgctgagtgttttgccttattaaactcggaaactggagtcttctcatttggggaaaatttcttgtattatttctgtcttttggctttcttcctctggaccttctatttgttggatgtgggactctcttaatggagcttctttttcttttttttttttaatcagttctctaggagataatctgttgtttttggcctctcatttttaatttctagcagattgttcatgttctttaatgttgctttatttttttaaaaaaatattctggctgagctgtagtacgtgtctgtggtcccgactactggggaggccaaggtgggagaattgcttacgaccaggagtttgagtccagcctgggcaacatagcaacaccccatatcttattttaaaaaaagcactctatgtttgttttgggcctctttgagaacatttactatgaaattttatttatctttgtttcctttcagttcttcttttgtttattgtgattatctttcatataacaatgtgcttaaatagctggtggttcttgataggtcactcaacagtgagcaaactgatggatcctgtgtttgtgagcagtgtttattggctgtgatagagggtggggacctagatgcttttaggggatcctcctgttatccatttctgaaagtgttttctcctaggctggtcactttttccaggaggagaaatcctttcatctcttgccatctacatgacagtaggctgtggttggggtcatagtactactactatttggggagctttgggagccaaggtggggagggaagctagtggtgtcatgattttctggtgttttttgtttgtttgtttgtttgtttgtttgttttgttttgtttgagatggagtttatctcttgccgcccaggctggagtgcagtggtgccatctcaactcactgcaacctctacctcctgggttcaagcaattctccagcctcagcctccctagtagctgggattacaggtgcccgccatcacccctggctaatttttgtatttttagtatagatggggtttcgccatgttggccaggctggtctcgaactcctgacctcaggtgatcttcctgcctcagcctcccaaagtgctgggattacaggtgtgagccaccatgcccagcctgcgtcatgattttctattgttggtcttatttagagtgtggcatctcactccatgccccatcccttgagctgtgcctctagtcttctgttccagaacttccgtggttcagtttaatcagaatataaatctgttttcctctggagtgggagaagggtgtattgccttactgtttagggacaggaaggagacctgagggggtctgactgttttattcagagtttgaaacagttctcctgttctcagcccctgcctctcaactcttgtctgcagtggttcctggtgcctcccacttccctgcgtgctccgggcttttgaagcactggcttgctttttgtggcttttccctctgcagccataaacttcaactttccttctttgctgagtcagttacttcttaccttcctgctcaacctggtctttcagatttctgttgacatccctcatctactgcctttttccttccccttactctttgtctttatgcatgtacacttttactgttcccttatagtcattctagtgaaccctcaggaagatgcaaagaagtatatgttcattttgccatgtttatccacaacccccaaataccattaaacaaaagaaaagaaaaaatatttaaaaaagaaaacaaaaacaaaaacaaaacaaacccttaataaatggagagcagctatgccatgttgttgattaagaagattctatatcgtaaagatgtcagttcttcccaatttgatttgtagattcaatgcagtacactacaaattttgaaaattgagatataatagttatatgtattttgggggtacaggtgatattttgatacctgtatgcaatacatagacatttttctttgtgttgggaacattaaaattcttcttttctagttattttgaaatatatagtaaattattgtttactataattttcctattctactattgaatattagaacttactccttctatttaactgtaattttataccccttaaccaacttctattttgccatgtttaaatatggaagctcaagcgtttgtacagagaaagtggaaaatgcccttggcttttatgccaaaccccaatccctctgtccccacctgccaccctggcctgttgcccctgttcttcccagtagctacaaccactatcattaatttaacgtgcatcctcctattcatatggaggtatgtggtatgtttgtttatataagtgtattttattttctttaatgtttaatagtgtaccatatcaatatagctacattttatttatccagtcccctgctatgaatatgtgcgtttttcactgttttctaatccctgttataaacactgcagcaacacttatccttaatctccatgtacaaacgtgtgagaatttctctaagggactattcccttaccttttcatattgtatgcttgggtaaaatggaagtgacttggaggctctttctgtgggggttagtgaaaagatttcattacattttctttgcattttgtaattatgatgagaaaaatataaaacttataaatcttttttaaaagttttgagaaacatgctttgttacgatcatgacatcaagttttatgcttaaaaagtctgtaattccttgtgtttaatgatgaactcttcaaattcctgatacagatctatagtcccttattaacaattctgaaatccaaaatattatgagaactgaatttttttccccttgactgatttagtagtaaaacctgacctgtgtaaactcattttgtgtcaaaactctgatgtagattgacaggtctaggttagcttatttgtttcacttggtctttgtctacattttatttttttaaaaattaatgtgtttgattatgggttgctggtggtgctgatacacaatatatgcatatattaacattctaaaattcaagaaattctaaataaaaacacatctagacccaaagatttcaggtaagggattgtggacctgtggtcaccattagctagaaagtttcagctgtgagtggcaacttacaagaatttctttctggttgatagaaactcctttcttattattagtaagaactcagacaatttctttacgttatattccaagagtgtgttcattttttaaataacagctcttccttttctttcgttgacatctataatattgaaattgcttttgataatgcaaatggatttcacattcaagagaacctttttatgttaagtattttgtttaaatggagaagccttttctcaagcatgtatggagattgctttccttgttttaattcttctttaggattttcatgagaaaattaaaacatcattaatggaccattttagccacagttttccaaagttgcattttgactttggatctttaaactttctgtatactttaataggtatgtgtaggtttaaaaaaaattttttttttttgatcagaatcttttgttttaggccaggtgtggtggctcacacctgtagtcctagcacttgaggctgaggagggtggattgcttgcgctcaggagttcaagagcagcctgggcaatatggcaagaaccccatctctacaaaaaataaaaaagttggccgggcgcggtgactcatgtcagtaatcccagcactttgggaggctgaggcaggcgaatcacgaggtcaggagttcgagactagcctggccaacatggggaaaccccgtctctactaaaaatacaaaaaattagctgggcatagtggcaggcgcctgtaaccccagctacttgggaggctgaggcaggagaattgcttgaacccgggaggcagagattgcagtgagctgagatggagccactgtactccagcccagatgacagagcaagactctgtatcaaaaaaataataataataaataaatacaataaataaataaataaattagcctggagtggtggtgcatgcctctagttccagctacttgagaggctgaggtgggaagatcacttaagcctgggaggtcaaggctgcaaatgagctgtgatagcaccgtggcactttagcctgggcccgcacagtgagaccctgtctcaaaaaacaaaaacaaaaaatacgttttagaactatcagttaaattttgtaagccattgtttacctactttaattgggatttaattcatagaccatacagttcaccaatttaaagtatacaattcagtggcttctagtatattcatgaagttatgcaaccatcaccatggtctgattgcataatatttccatcaccccaaaaggaaaccccagtaggtcattcctattctcacctcctcctagtccctagcatcaccagtctactcatttaattactaaaactttctaaaaagcaactcctctcatcttgttcttcaagagtatcttggctctttgtgaccctgtgcttttccatgtaaaattctgtaaaagatcgtgttgagagctttattggaactgcattgaatcgacaaatcaaaatgggaagaattgacatctttttttttttttttttttttttttttttttttttttttttgagacggagtcttgctctgtcacccaggctggaatgcagtggcacaatcttggcctactgtaatctccgcctcccagcttcaagcgattctcctgccttagccttgcgagtagctaggattacaggtgcacgccaccatgtctggctaattattgtatttttggtagagatggggtttcatcatgttggtcaggctggtcttgaactcctgacgtcgtgatctgcccgccttagcctctcaaagtgctgggattacaggcttgagccaccatgcccagccaaattgacatctttatgatataaaatcttcttaatcaagaacatggtatagctctccatttatttagggtttgtttgtttttgtttttttgagacagggtcttgttctgtctctcaggctagagtgcagtggtgcgatcatagctcgctgcaacctgaaactcctgggctcaagcaatgctcccacctcagcctcccgagtagctgagactacaggtgcgcgtcaccatgtgcagctaatttttgaatttttttgtagagcgggggtctccttacgttgctcatgttggtcttgaactcttgggctcaagtgatcctccttcctcagcttcccaaagtgctgggattacaagtgtagccaacatgcctggccttaccaaggttttaagcctttcttgataaagttttatgttttcttcataaaatgatgatatttcttttgtggaatttatccctgggtaacttacgttcgtttttgttataaattatatttttgttataaattatatttttgttttcttttttcttcaaccctggcaaatggatatattttctttttttttttttttgagacagagtttcgctcttgttgcccaggctggagtgcagtggcaccatgtcagctcactgcaacctccgtctcccattcaggcaattctcctgcctcagcctcctgagtggccgggattacaggcgtgcgctaccacgccgggctaatttttgtatttttactagagtcagggtttcaccatgttggccaggttggtcttgaactcctgacctcagatgatccacccacctcggcctcccgaaatgctggcattacaggcatgagcccccacacccggctgatggataaattttctaattgatgatgttaattggtgatgttagtatcacttgatttttccttttttttttttttaatgtgatctcaaatgtcacaatgtggccaaaatcttttactaggtctgagtctcttggatctttaatgtaaataattatgctatctggaaattatgacatgcttttctaatcccttcttgtttctattatgcattgaaaggaattctagtatactgttgaatggttggtgttttcttagtttttcacagccttcaagtcagccttctcctaagagatagtacttattttttgctcaggaaagatataaggaaaggcataactgatattttgcttttttttttacttcagaatctaatcttgggcagtttaaactttatcaatttaaatgttagctctcctttgctcagatttgccacattcgtagtgtcttgtattttttaaaacatctgacctgtgggagaacattttattttggtttacttattacagatggtttattttttttcaacattagcttcttttctagttaccttgccaaactagtatacgttatgcattttagaaacacttatttgtattaatagatgaacgtgagtaaaaagtatacagcaagtcttctttgtactgttttactcttgcaaaagtagaatgaaaagcttttgcagctttcctgtaaaattgaatttctttccatataaaaatgttcaaaatgtatttgtaaaaggaatacgtactcatcatcagtattaaaaaggttcagaataaagaatccctacaactacagtttttaaaagacaactcaaaaaaaaaatgggtgaaagacttgaacagatacttaaagaggaagatatgaatatggccaataagcacattaagaagtgctcatgcagccataaaaaagaatgagttcatgccctttgcagggacgtggatgaagctggaaaccatcatcctcagcaaactaacacaggaacagaaaaccaaacaccccatgttctcactcataaatgggagtgaacagtgagaacccatggacacagggagggaaacatcacacaccggggcctgttggggggtggggggaaaggggagggagagcattaggaaaaatacctaatgcatgcggggcttaaaacctagatgatgggttaataggtgcagcaaaccaccatggcacatgtatgcttatgtaacaaacctgcacattctgcacatgtatcccagaacttaaagtaaaatttaaaaaaaaaaaaacttcaaaaaaaaaaaagtgctcaacatctttagacattaggcaaattaaaatgaaaatcattgaaatctagcactctgaattaaaattaaaaccacaatgaggtaccattatactcccactagaatggctaaaataaaactgccagcttcaaataatggtgaggatttggatcaactggaactctcctcaagtgctgttgggagtataattttttttttaataaagttagctttcatccatcttatgactcggcatttctactcctagatagttattcaggagaaatgaaaacgtctccaaaaatttacaagaatgttcataatagctttattcataatagctagaacctggaaataacccaaatgtccatcaagagagaatatacaaatggttgtatatgagaatattagtctgtaataacaaataatgaactactgatgcatgcaacaatgtagatgaatagcataaacaggctgagtgaaagaagccagatacaaaagaatatatatgtatgagtccatttacatgaagaccaagaacaggcaaaagtacgttatggagatagaagtcagaacaatgattgccttcgtggggtgagaggggtggtttcttttcttttttttttttttttttttgagacggagtctggctctgtcacccaggctggagtgcagtggcgtgatctcggctcactgcaagctccgcctcccgggttcatgccattctcctgcctcagcctcccgagtagctgggactacaggcgaccgccaccactcctggctaatttttttttttttttttgtatttttagtagagacggggtttcaccgtgttagccaggatggtctcgatctcctgacctcgtgatccgcctgccttggccttccaaagtgctgggattacaggtgtgagccaccgcgcccggccgagaggggtggtttcaaatgggggttgattaggaaggggcacaaggaaacttttgggggtgttggaaatgttctatatcttgatatgcatttgttagaactcattaaatggtacacctaagatctgtgcatatcactgtgtttaaattaaactttaatttaaaaaaataggggaaggataggaggaggtatacattgatccaagggcattctcctacgtaagcacaatacagttatcacactcagaaaatttaacattaatgcagcattaccatctagtatgcagttcacattcaaatatcccagtgtcttgaaatttgctgagagtagatcttaattgtcttcacactccccatctcacactctccctctcatggtaactgtgtggtgaaggattggttaatttttttttttttttttttttttaaagacagagtcttgcactgtctcccaggctggagtgcaatggcatgatcttggctcactgcaacctttgccttccaggttcaagtgattcttgtgcctcagcctcccgagtagctgggattacaagcgtgcaccaccatgcccggctaatttttgtatttttagtagagacggggtttcaccatgttggccaggctggtctcgaactcctgaccttgtgatccacccgccttggcctcccaaagtgctgggattgcaggcatgagccaccgtgcccggcctatagaattttttatatgtaggatttagtgaaagatcacccattattaatttttttaaaagcttcatgatgaaaattattcttgtaaaatgttaaaatcttgaatcctagggcatgttttctggcacctgttattttcagtaacccatttcgtttttgtcagacatatagggttaatgtatgaaaagtcaattatgtcaaacttatagagtttatatggaaagattaatgatcttttacaaatgcagaattggctggatgtggctaattgtagaattggcctgtaacctagcacttagggaggctgaggtgggaggatcgcttgagtccaggagtttgatttttttttttaattttttattttttgagacagtctcactctgtcgccctggctgaagtgcaatggcatgatctcagctcactgcaacctccacctcccaggttcaagcgattcttgtgcctcagcttcccaagtagctgggattacaggtgtgtgccaccatgcctagctaattttttgtgtgtgtgtgtatatttagtagggggggtttcatcatgttggcccaggctggtctcgaactcccagcttcaggtggtccccccatctcggcctcccaaagtgctggattacaggtgtgggccacaatacccagcattttttatttatttatttatttatgtatttgagatggagtttcaccctgttgcccaggctggagtgcaatggcatgatcttggctcactgcagcctgcatgtcccgggttcaagcgatcctcctgccacaacctcccgagtagctgggaatacaggcatgtacaccacacccaactaatttttgtatttaagtagagtcagggtttcattatgttggtcaggctggtctcgaactctggacctcaagtgatctgcctggcttggcctcccaaaatgctggaattacaggcttgagccactgcacctggccaagcccaggactttgagaccagcctgggcaacagaccaagaccctgtctgtacaataaaaattatgcagtattagaatagcaaatcttactcttaaaagttttgttttccttgtctttttactgaaaatgcatggctttagaaacttctgggtagtttgaattgcagacaaccaggccctattcctgtttgtttaactaatgagatttgtaaacagtacttggtttccccagactctaggacctagaggaaggaaattttgatttagctcttggtaaagcatttaacacctaatttttctttttcattgttattttcttgatcacagaaaacaatacatgttaatagtagaaaatacccacaattgaaaagaatataaagcacttactaaaactctaccacctaggctaggtacggtggctcacacctgtaatcccagtactttgggaggctgaggtgggtggatcacctgaggtcaggatttcaagaccatcctggccaacatggtgaaaccccatatctactaaaactacaaaaattagctgggcgtggtggcagccacctgtaatcccagctgctcgggaggctgaggcaggaaaatcgcttgaacccaggaggaggaggttgcagtgagccgagatcatgccgctgcactccatcctgggtgacagagcgagactcttgtctcaaaaaacaaacaaaaaaactgccacctagagatggtggtggccaacagcttagtaagaatttctcttgcatttttctatgcaaacacattcaaattttcattttttaaaaaagatgatagaatcatactgtatgaatttaattgcctaattaagcttgtgtatcatcgtttctcttgtcattaaatgctgtacagctttcttttaaatggctatctgtggtagtgttccttgaaggaaataccttaaaattttttgtttttaaacttttataattgtgggaatgtaatacagtgaatgcataggacacaaatgttcagcttaaggaattattataaagtgaacaccctgtaactgccacttagatcacgacatcaaatatggccagcagccaggcgcacctcccctaccccccactgccccttcccagtcacagccccattcttccagctgaaggtaacttctgtcttgactttatgaaagttattttcttgctttcctttagattacctacccgtctttgcattcctaatgctgtagtttagttgagcttattttgaacttttcacaaacggaatcatcaactatgcattattttgtatctggctttcattcactattttgtttttaatattcatctatgtcgttagtagctatagttcattcattttttgttgctgtataatcatccatttattgaatgtactacaatttgattctgcctttggcagccactttgattgtttataatccagatttcaaatgctgcatcatgaacatgtgggttgtgatttgtgtagatgtgcatgtacttctctaaggaatccaagcctaggagggacgttgctgggtcagaggatgtttgtatcttcaactgtaccagataaggccaaattgtattctcaaatgcttggatctgttttcagtgtacttgttctactcctaattaacactacttgatattgtcaaactttaattgtagccattctgatggatgtggtagtatctcattgcggttttaatttgcattattttgcattttccttattgttagtgagattaaatacccttttatatgttttggctacttcagtatcctcttgtgcagtgcctaattcacatcttttatttttcttctgagttgccttttgcccattgatttatatttgttccccctctctccccgcccccaagaaggagtctggctctgtcacccaggctggagtacagtggcacaatcttggctcactaacctctgcctccttcgttcaagtgattctcctgcctcagcctcccaagtagctgggactgcaggtgtgcgccaccacgcccagctaatttttgtatttttagtagagacagggtttcaccatgttgaccaggcttgtcttgaacccctgacctcaagtgatccatccgccttggcctcccaaagtactgggattacaggtgcaagccaccatgcccggcctgatttataaatgtagtctaaatacaagttctttattggttatgtaagttgcagatatctttttcagctctgtaggtaataatgttttttgatgaataggaggtcttaattttaatgtagtttaattgatttgttttctcctttgtaagaatcaatatttttcatgtcctgtgtaaatctcgtattgggataaaagatacatatatattttttaggttttggctaatagttttccgttggcagcatgtgaacctttttatgccatttttactttcatcaagggtgtatgtatgattttctcatactcttgtcagaactggagatttggggtaactttgccagtgtaatagactttcttaattcattaaggagtattttatcttagtttgcccatgagagaagagagattaaatttgttttattataccaagaacatggcagtcaataagcataactaaaaatattatttagcttttgattctgaagaccatgtatggccagtaaggaaaagaggtaaagatgtagaaaactgttttcttttttttctttcttttttttttttttttttttttttgagatggagtcttgctctgtcgccaggctggagtgcagtggcgtaatctcagctcactgcatcctccacctcctgggttcaagtgattcccctgccttagcctcccgagtagctggtactacaggcgcgtgccaccacacctggctaattttttgtattttagtagaaacagggtttcaccgtgttggccaggatggtctcaatctcctgacctcgtgatccacctgcctcagcctcccaaagtgctgggattacaggtgtgagtgagccactgcacctggcctcttttttattaatttaagatacatgattttggctaaaactaatgaaaataaattgatgaaacttcaatgtagtggatcaagagactcatgaaattgatgagttagattgttgtgggcacctgttttaaatttatggtgcctttttagcagaatcatgactttatcaactctttttcacatacttttattcaaagaagacattctcctcctctgccccaacttatcttcttcttgtctccaactgccagtattctcatccacactctttgtagttttgaggtgtgagataactcccaagttcttcttgggaatgggtagagtttaattctgagtctacatgtcgtgagtctattggaagaagcttttcttaggaggtgaaatttgggatggagttctcctctacactctagccctgtagccacaatctttggtttagatctttggcattttttgttggacatctttcatagtgtctacctcttcttcctgcctctaggcttcccgcggttgccagatgaaattccgaaaactcaaatcattcctgtagttaatattcttcagtgactccggaacaatcaaattcttgatccctccacatgggtcttaccatctgccctcgtgccctctctagcttcctgcatattgagttccccacagccctagtttccctgagtttggaatattctttcacatttgctcatcccactatctagaaacttcctacaatctctctactgccaacctgtctgtctagttgctaatttattttaaaacccagcttaagcaacacatccttttggatgtgttacttccctgatcgttattcacctccatgccgtctttcgctcaactcattgaagttaggtgcccctcttctgggctgccacggctctccatgttcacctatgtactgtactttgtattgtaatcagtttaattgacccccctacttatttgagctccttgagagcagggccttgattcctgctccttagcactccaccctccccagaactaacatggtatagcttataggaggcaccctataaatgtttaatgaatgtttgaatgcaaaagtgtatctaactttcttaatgatatatttatgaaaagaacttgctgagaaaaaggtcagttagaaagggttaggaacttgtcagtattctaaatccctctttttcaaaagcatacacatttaggaatgactgccttgctttaagaatttgtagggttttgttcacctgagttgtaccttgctgtcacagaaggatgccctgcagtggtctcgccatccagctacagtggagggagaggagccagaggacacggctgatgtggagagctgtgggtctaatgaagccagcactgtgagtggtgaaaacgatggtaaggaccctttaatggatgggtgagggagccacagcaggcactagggactaacctttattttcctctcttccagtatctcttgatgaaacatcttcgaacgcatcctgttctacagaatctcagagtcgacctctttccaatcccagggacagctacagagcttcctcacaggtaaggaagaggtagagcctagcctgggaggatgaatgatgacaggtataaggcaagatccctccttctcctgtagtgagctgtgaacatgttcagagagtgaagaatagaagtctggtctccagctgttagtagcatttaacagggggccgcaggaaaagtgaacagtaggtttgagcagagtaagttttttctctttctttaccttggctgagtgattttgttcattctttttttttttttttttttttttttttgagatggagtcgcgcctgtcgctcaggctggagtgcagtggcatgatctccgcttactgcaacctctgcctctggggttcaagcaattctcctgcctcagcctcccgagtagctgggattacaggcacgtaccaccgtgcctggctaatatttgtatttttagtagagatagggttttgccatgttggccaggctagtctcgaattcctgacctcaagtggtctgtccacctcagcctcccaaagtgctgggattacaggtgtgagtcaccatgcctagcctgattctgttcattcttgtaatatacacgtgaacattcagggagaagtgtggttagtgcagagtagagagaacaggagattgggagtgagcagtttgaatgataaccctgcacttactagccttgagacttggggaaaattccttacctgtaaaatggggataacagtacatttttgtagcttggaatgatgcttggcacagtgaccagcacgtagctcagtaacattaaccagtgctcttgtcagcattatttgacagatctggttgaagacgaacttcattttacaagagcgtgagtagagatagtgtcgccagggaatgcttttgtggctctgcagttgacttgggctctcttttgttctctcttggaacgcaggcgaacaaacaaaagaaaaagactggggtgatgctgcctcgagttgtcctgactcctctgaaggtaaacggggcccacgtggaatctgcatcaggtatgtgtaaactcatggttgtgatgctttttcctcaggtcctggggacctggcctccctctgtcagcagtttctgacctaatagtgcgatactaggagagctgtcgggccacaggcaagagccctgccaatggatgaggcctgccataggttctagtgctgggctctgctgtgtgccttcctctttgtctcccagggcagtcgtgaggatccaacggaggatttgattatgccagtgctttgtaaaaggtgtagtgctatacaaataaagatggcagtttggcacctgtaaggtgatattttaaagccagaccatgaagtggtggtttctctcagcctaaggctgggagatggaagcatcccagtattgctggcagcatctcagggagagctgggagaaatgagcttgtctgagagccatgggcgcggcttggtgatacttttgaccagtggaatgctgtgccttcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtgagtggcgtggcacttatttctctgcctgtaaagggggcccctgcaggcctagtgagaagatgatgtcttctattccaattcctttaccagtttatttttacttcttgggtggccctctattttttgtttatttttactttgtaatttgcttatttcatttgtagctctctgctaaactgtgagaactcctttcaggcagagatgatgccatactgtttctcgtatgtccctgtaggcctagtctatgcctgccttgtactgcatagtaagtgtttgagtgagtgaaaactgcttctgagcttctcagtgaagaattccaacaccccttttctctcttcggtagcatgttgccacatttgttcccaacatctgtagtctgtatcagacgctcccttttttacaacctagtcagtatgttgagtggaagcatgtgttgaattttggggatgcaaacaaattcagtagtgctattatctatacctcccacccctcaccccaccccacccccattagggttatttgcaatattagtatgctctttgctatttcaggatttaattcttaatgacccacatgctggttttttttgtagatgaaaccattaagaagacaagcttttgcttctgagaattagagtaaacctttgcccatgtgagaactaggtttgctgtcttgctgcttttccagctcatcagcagtgctcaatctaaggtctcacaggtctctagtcctagtgagtttttcagataaaagtaacatttgctgaggcttctgtgagaggtattagcatctcagttggctttgaacagtccttagtacatttctgcatggagatcatccctctccagcccattcacagaaggcttctgcagatttttctatagtatactaactagatttacttttagataattctcatgatttctccagttgagctttgtggagcctgttctccagctttggagggaagctcagaacctgccccttgcctgattttctgtgggaagtgtccttttcaggctgtgacacagcacggtacagagttttgtctgaggagatgcaaccccaagtgttctcctgggtttgatggcaatgacagtaacctggaaagaatatacaggttaggatggactggacaattgagcagattgtgtgcagataactcctgggtagcttgggtgctgtcaccaaagttttcccatcagttggcatttgttttttcttttaaaaagctgaaatctataccttgcttcaaaaatcataggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtgcacatgggcagcctcccctttgcctctctctgggtgggcttctgttctcttttaagtttatttattaggatttttttcccccttgatccttctaggtggggacggatggcctgttgcgtctcagcagcagtgcactaaataacgagttttttacccatgcggctcagagctggcgggagcgcctggctgatggtatgtagacttggtcatctcggacggcttgcgacgcacctgtcgtgtggtgttgcatgtctcctggtatttaaaacccaagctcgctcttctcaaagggttatttagtataagacaggctttcctcattactaataaatgtggtgggtattaatatgccacacagctctgaagaaataacagggtgtttaggtttagactttcactatattgtatgtatgtactcattcatcatctcctttttatcattaaaactataaacacctattccagtaatcatggcatggtctggaagggtggaggaaagtacactgtggagttgagaagctccaccatgctctgtctttttaggcattgtcacttggagtgattgttagcttctattaatttaattttgtggggaaagtgttgagagggctctaagaacacccctaggtttgatgatttgctagcaggactcagcatatagttatatgtacagggctgcggtttattacagcagaagaatacaaagtaaaatcagcagatggagaggcacatggggtggggtccaggggaaaccatgtgttggcttccaaggtcctctctcagtggtgtcacacaggacacatttaattcccccagtaacaagttatgataacatgtatgaaatgtctactagggaaacctgttaaagactcggtgcccagggtttttatcaagggctgatcatgtaggaagccactgcttggcacatacccagcttccagattcccaaaaggaaggcaggtgttcagcataagccgtattgtttgcataaacaatttaggcacagtgaacaactcatatcagttagggtggttgggaaccctcctgaaatctaagttcccagatgtcagccaagggctgttcttttaagtaggcctttctaagagtaaacaatcaggcctacctactatgttaactttttatctacacaggaaatatgaatggttcttttgtttgttgttttgctttttcgatcaaggagttgcttggtctcactttaaggaagagtgaatttcccttatagtagatgtgttagctctgtccctataagagcatgatgtgagagagcctttagaagagacgtgttgttttaaaactgggagattcagctgtccataagacagacattaatatcccgaatgcacttactagaagaggtttatttctccctaggtgaatttactcatgagatgcaagtcaggatacgacaggaaatggagaaggaaaagaaggtggaacaatggaaagaaaagttctttgaagactactatggacagaagtaaggcagttggagctatgagtcctggtctggggttttgaggggatagaggtagatggtctcaaaatagcatatacttatgtgttggacaagaatgtggagattgcagtgacacttgggtcatttatcttaatgccattcatagtgaagctaacagaagtttttccatggttagattgtgcaccacacagatttattttgttctgagatatctgtgtttctgggtccatattattcatagaaataagagacatgtccactctggcctgaaactgatggctgtgattttgatttgcaggctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccgggtaggagactgtttgattcctggctgccctggagccaggttttctttgagggtcatgagattatagagcccttaactctggggccctgaagttaattatgtgggaatgtagagctttttatgagaggtttgcttgagacagccttcaagtttagtgagataggttcttttcttcctcacttttttgttcactctgttgaagttatcttgagaggtcaaaatcctttggggttttaaaatctttttaagatagcattagattctttgctatagtgactcacacagtcccaccagaaattaaatttagaagtgtggcatataacagcccttgagcagaatcttctctgaatggtgtgttatggcgccattttactatgatgatttcattgttttaaggaaattatttgattctgtatgccatgacccttaagctactagaatcctagttttgctttacagtccctaggtcagatcacccagtcagttaaaactattttctaattctttttttgcagattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgcagttgtggtctcagtcatctgtggctgcctcgctggtgtgggaaggtcagctggagtgctgagctggaagggaaggagtagacgccagctctcctcaccttggctctggagctactcttcttatacttggagctcttcttttgggaggttagtccaaaaggaatgacttggcagcttcactggtctttagccattcatgacttggcggacttcaccacatagactgcagtcagcgttctactgagagcaatgagaatgtttccccttgggagtgcgagtcacaaactgtgacatccctctgcagcaactcatccaaacagcttcactgaggttgaggttgccaagtggcttcctaatggttagtggtcttctgtgggagggtgactagctctaaccttggaaaaccttaaccacaagcacctctttctgtagcctctggtggcagtgagaggaaggtgctggcccagggtggggtgtctgatgctagttgcgtgagcctgagtagacgacgtgcttcagggattgacttcttgagaagtcctcagacgtctctagagtacgtaaatacattgactttgtgcttatcagaaataattttattagtatataaataagccaaaacagcaaaatgatgggagtttaaacatatattcattaattttttcctgtgaattggaggaaaaactttgtggtgggatatcctttggggagttcaagctgccattttgtattgctgccgtttgatcgacatgcagttttgagaattgatggttcggaggccctgtagtgactgagcaactgcctgctgttggtgatatgtccttgtgtcacagaatccatttgcccacttatgtctgcaggagctcagaatgcattacggtcccagatcgggaccttccaatgcctgttgcctctcctcagggaggcagaatggtgtagtgagttcctagagtatagcctctgcgacgtgccagctctgtgttcttgggccatgttatttaaccaggctgccaactctcatatatgaatgggtgtaatagttcttacttcatgaggttgttagtgcctgccacctaggacataatgactattagttcacagcaggccaaggcaataattgttaggtgaacttatagtagaaatctatacagctactgccagctacttcactcttgctccagaaaggagctgtcaggatgtaggccttgtgcccactgcgctgaggggtgatgcaggctgtgaagtcactttggaccctggcttttggtctcaggccacagacctgaccaaaggttgagtgtagtcctgagtttagactgaatatttggtcaggaaggcttattttgctcatggtccaaaggacaagggaaataatgtttcagaatataggaagaatggtactggcctggcaaggtgtcatttatttgctatccagcctgctgtaagactgtgttagagtgtgtgtgggtatgtgtgcatgctaaatagagctgcctgcatccatcaggggtcttgatggccaaagcatctgcctgccctgtctccctgagaggaggggacccaggctgtgttgccctcgtgtgggtgttgtttgaagccatagaagtggcaggatgtggaactttggagattgctccaaaattggacaacacccctatgcttcctcttgtctctggtcaatttgaaagcctagaatgaacatctctaccgtaagccatagacgaacgccctgtgagaacaacagttgtcagtgctgtgttacctgatatgggtgggtcttaacctttttttgggaactctccccccatggaatgcacatacaaagttttttggggtttttttgcagactctcactctcttcaggctggagtgcagtggcgtgatcatagctcactgtagcctcgaactcctgagctccagtggtccttccacctcatcctcccaagtagctcaggctacaggcacgtgccaccatgcccagctaatattaaaattttttgtagagactgttgcccagactagtcttgaactccaggcctcaagcgatcttcccgatcttcccgccagcacacctggcctcacaaagttttgcatactgtgtcaggatttaccagctccttaggcagctggggccctttgtttaagaaccactggctgagaataaacctaataaaatctgtgtttatacaaaagatcaattaagggaagataggattttgcagagattcttcttgcaaagaaatgtaactactaagcttccctagtgcattttaagttggaaaaatagcatatgcatgttttcctatttttcataaagggaggtttgcctgttttgtcattgaatacattttagttcactcttctgaggggacattcccatttgatgaagtcttttatccactgttaacaacagtggtgcggagcccccaaaggagccagactagaataagggagcacttttctgccctcaggcaatttctcctgggaatctcagtgctctggtggactgcagtatttcctgtggaaggaggtaagtgtttgcagggctggccagcaggccagcggggtccatgttctggagctgttgtcacaggttgtgggtttctaatagtcttaatagtttgaggagtctcagtggtgatcatttgaggcaggagaaggaatttccgtggtattaactgaggatttgctgcccctcagcaaaaggaaagcggcaagggaggtgtcaagggccatcgtcttctggctctcagtgagtctcagccccaaagtcatgcccttctccattttatgtatttggctactgcacagactttctatgagaaaaaggattcttatgttatttaaaaatcaaggttttaataactgccataaatgtgtatacatatatatgtatatatgtatgtgtgtatatatgtgtatatgtatgtgtatatatgtgtatatgtatgtgtatatatgtgtgtatgtgtgtatgtatgtatatatatgtgtatatatgtatgtatatatgtgtgtgtatatatacacacacacggaattttagcaaatgtatgcttttaacatgcctaaagttgtttttaaatccatgatcatgttggttcccagccatattcctaccatttttccttaaagcttaacctaaaccatatatataggatgaaaaaaaattagcacaaataagtatctttgggaaaagcagcccttttgtttccttcaaggtgggatccagggttttgcatagaatggaatgtgcagcactgaaggttcagaaccagggatcatgtttgctcagttttccaaactagcacttagggattgttatgggaatttggtttcagtcagttggccatgtgctagggtgagaggttgtggaaaagctacaagttttttgctggtcactgaatttcagcaaggcgtgtaccccgtgtgcctctgtgtctgcacgtggcgggtaagggaactgagatttaaaacagtgcatgagagttctgcctgtgctcagcaactgaagggcacctgggaaaggttcatttccttccctttctaacagatgaggtgctggaattacaggtttatttgttctagaaaatgtactgaggaccttctgtgtgccatactattggctaggaaaaggtggaatctactagtagaaagatgtttcggtgcccaactagatgaggaaggatgagaagtggcaggcggtgctgctgttgataggacacagtggaagcagagcattcggtttgttgttcagtgtttattaagtagattcagtcttatatatgatatacagattcaaaaggaaaaggattccacatacttatgaaatcagtgcatttagcaagtaataccatggagataacagctcgattaacagctcattggtcttttgttaagtgagggagagagggagtcggcctgtgctagtcattccacaaacaaaacagaatttagtcacatcacgtagagaagacacattctaagaattaaaatattaagccacatttactggtaaaactcactatatagaacacaaataatttttatagagagcattgaggaggaagtcctcacctgcttagaagagccacgttaagttgcataggtgcatatctgtaaaaatataatttagaggtgaagccattaatagagtcacctttaaaagttggtgccatccactgtttgccttaagtgcttactatctggagccctgtgcccctccccggaggtgggacctcatgaaggagctgcccccagaggaaccctgaagaaatggcttgtactatctgcactgaaagtcttaaatctcatctcagatatggaactcatgctcttccaaaacatgtctaaattatgccagaggactaaagacctcttgggttgtccctaaatcctggatggcttgatcctgaaggcaacatgagtcattctgaccttcccactcccaggctgcccagggaagaactacattcatcccacagctctgcagcaaagtcctgccttcccttttcctctgtccatgcagttacccaccagcagccaataagaggtctctcttctgactcctgctcctaaatggaccacataattgaggcatatgggccatctaccaggtggaaagtgtttttcagccaatctgagttctacgtggtataggttttttgttgtatttttaggtggaaacgtaggtaaaaagtgagaggtttttgtttgtggctttgctaagcagatgagcttagtgaggtgcatcttcctcctcaagagcaagtcttgcagaacacacagggactgggggcatctgtacatgtaaacagtacactttcactgagtccaaaattaggagcaaaaatacaaaggttcacattggtcttaggtagatacaggcgaaaaaggattgagctgtttagctcagaaacaacaaaaacaaagtttctaaagcaccactaaattatataaaaatcagaccatggacggattgaaactggtattctggtgaaatactttactattttgtaaaaagttttacaaaaaattacaaattaaaagtatcaaccctctgagttcaaagcagcattttgaaaatgaactggtagttaatcctgtaaccacccttagagttgtaagtggcccttgggaatagggatggatgggttccacctgtttgaaatcctcgaaaaccctcctaactccctgcctgtccccctccccgtcagcactgtccttgggaataaactgtcctttgtaagagtggtgacggtaaaatgaatttcagatgggttacacacactatcacttgtctacctgatgatccaccactaagaccaatgcccacttctctgatgctacccttcttgtgggattagcctcctgcaaagactctggaattggagtatcctactcttgcatttcctttttaacttaggatcccaaatgatcactttgtgccctgaggcccttcagaagatttttaaatggctgtgggacaagggctttgggagctccttttgggagaaggcagtccctctggtgagggtgagacagcagtgagcttagttcatcagaaccagctctttggtgccctccaagtcgggagtagggggaaggggttgaagctgcatcttttaaaacaaaagcaaaacaagttccctgactgagccagctaaatggaatcctgtttccatgcagaaacttgctcctgattctgccatctctagggcttcaggtgtagtttcactggaaaggaggagcccacccaagaggtggggtcgacatgatgaaatccattgtcctggaggggcctgggaggcccaatggactttaacaacatattctttcctttctcttgaaaacacattgaacctacgctcttgccgcagtactaaggcaggctggagggtggtcagttccaacagcttgaactcagaaaaacatgacttcaaactgtagcttatgctgatctttagatctaatccttgtgtgggtagggggagggagccccttccccagtctttctcactcctgtctgccaagaaatgcaaacggttcatgtctagcttgggtactgcctctgggaggagaagtgacacgttaagtaactgataccaggaattctagggtggcgattgtctctgccaggttttaacattaagattttcacaaataattgcctggggtaacatttttgcaaaagatcttactgattactttgtagtattgttcacacacaaaaataaatatttacacgaattcaaatgttgagtagtactgagcaggtggggccagatgtgtggatggctggggtgtgggagaggccttgggcactggaggttgtgctgtgctaagggtgagtctcaggtgtcctggccctgaccagaggcctggggattggtcagatggaaggcagaggtggtgtggctggatggggtattggaggccacttgagagataacgaccacccccaacctctaggggccggaagtaagcacggggtgggcaccctacctttcagagttctggacctgaggcaggatggggcatcctcactggtgccccccccatccctccttggggggagtctgccacagtgccgggaggcagtggccacagctgcaacaggcaattggctgcagaaaagctggtttgggaaggggtgcctgttctgggagcgagtggctctccgtggccatcctaggatccactcggccctggctcccctggggcctctctgctctgagggaggaaaggcaacagagggcttctgccagctctgggcaggggcgggcagcagagagctgctgtcatggctacggagtgttgcacggagaggccctgggggcctgctgaggtctgggcgagtccctggtttagcagcactggtaggtattgcactgagcaagaggaagtgcctatcaatcaatcaatcagggaggaaggaaaccaggccagctttttctttttgccctttttcacactccagggattatgggtttcttccaggaccggcccctccggaagggctggtcttaggagaacccaagtggctcctccacttccactgatccctttactccaaacatggcgcaaggggatgggagctgcagcccgccctggagctcacggctgcctgatagccggggctcaccctgaagaagtggcccctcttggcaggagtgagtctgaggggccaggcctgtgcacagaagttcagacctggctcctgggcagcggggtgtgagggcaagggccctgccaaccggctgccatctcccagcagtccgtcctgtcaagcagctgagggccagagctggagggctgcagtggctggttagggacaggacgctctctgggttccagctcctggacacccagtctggacttacttacctcccaggcagacacattgtgtgggggagttggggttacagctgttcagaacaggctcagggcacatcctggaaaaagcccacgctggagtgtgaggtagaatacaggtgaccatggactggggcttctgtagaatggggtcggggtgcctcttttgttttgctttgccatgggtgtgggtgaggtcctcctgcttggcgttgcctagggaggtgcctggtggtgtccctgtggcagcactgggatctgcaacaggatggcctggccaagggctagcggccacagggtgcaccaggcatgcagaggaacagccagcctggcacctgtcctgcccctactggccccagcccacatcagtgtagtgatatggaatgttaggtatggggatacatccttctgatcagacagacacagactagcaatctgtacaaacacaaaagaatccattttcagaaaaataaattactaaggggagaggaagaaagggtccactttgcttttctcaataaatatgcaattctgctcacctaagacttgaaaggtaattatctgggggtgggattctaacatcagggtccacgaaggtgattctaaacagagctgcagccccagcgccttgtcaggggagcccccaacccttccagagctgccccgttggcctcttccaagcaggtcagagcacccgtgtggtgagattccaaaaaaaaaaaaaaaaaaaaaaaaaagtgtccttgtgcccaaagtctcaggtgcttggagtgtggctagaaacagctcttttggatcccacctctttcaaaaacaaaatgtaccaactggtgaggcaggaagccaggtccaggctgggacagcctccttccctagggcagtgcgctccaggtgccggtggggtcagttctgctgtaggatgaggttttccagttcatctgcagagcgcagcaggaaggcagcagactcccggtagcccgcgatgagctgccgcacggcgctgatctccgtggggctgagctgagcggtgggcacgggcctgctggtgctggtgctggagggggtgggcgtgggggtggtggaggtggtagaggccccgcctttcatgctgaggtccgtgggccctgtggagagggaagtagggtgagaagggagcagccaccctgcctggcatctgggaggtgtaccttccttggcactgtcataacctatggcctagtgcccactgtgagttgggcactgaagtccgtggctctggtccatctccctgatggctctatccctagtgcttagaatgggcctgcgggcgacagggttctcagagaatcctcagggtgatcttgcaaggatccggttttaggtgaggaagaggcggccttggggcaaaggaactcctaagatctgcctctcctcagtgtggtgagcagagcttgggaatgggaaatactacttccattgaggaactgtgggacaagtgctaaaagaaagcctctgccagtgtgcctaaaggagcagcacccatctgtgtgctcttccccagcccagacaccgaggctggaaggggagatggtgtgcaggagactctgcaggtaggcaggggcccaacacacctgagagatgcgtgtggggaaagcccaggaggagctgagagtcgagccacaaaaggccaggagaagaaacatctgtgtgcccagacaagaaaggggcttctgtccagctggagagaggccagctgccctggttgtctggggggagaggtacaggccagactggccaggccataactgcacccccaggagggaccatggcagccagtggatggaggaaggggctgggtgtgtgaagcctctttctgctaagcctcaagcacctcgaatcccccctcctgggaggagtcctgtgcctgagtgaggtggagggttcatgctgctaggatacgagggagtgtgggccggaaccatcaggacaagactcagactcgcttctggagaaactgcccgccctttgtcctcggatgatggcaaagagggagcctgccatctttcaaaacacactaggggtgtgcgtgttggggaggggaccgccaggccctgtcctctcttggcctttcccaagaagctcctggctttggagtcaggcaagtgtggattcaagtcctgctctgctacttcattggcaaattctttaacttctctgggcctcagagccctcatctgccaaaactaggcggctcctgcgagcagaagctgagatgccggctgtgaaacactcagcacaggctgaggctccttctcagcccacaggaggcctgactgcctagactggcccaatagggaagggcttccaaagaggtttcagggctttctgaatgggctcccaggagacctggaagctcctggaatttgaaaagcattctacaaggtgttcggcaagaaacagccaaagaagagagaatctgggcaggtgcaggcagagctgccgcttccctgggaagccttctctgatgcagccaggtcagcttctctgttgtctgccctccccctggagtcccttccccacagctttatcttccacgggggtgtgaggctcccccagctaccctgaaagttctgatggtcacattctctcatgattgcatctccatggcagtttttatgctgctatgaagagagatggacaagctcttgtcacgggaggtatccagactggaagtaacatcttgggataaactatggaaacctgactgctgctaaaaggaagctggtgcagcccccaaatggggaaggaagctggagtctaagatgggacagtttgtcacatggggttatttcctctccggccagagaatgtggacaccaaggaggaggtcctaggaactattttctaaatagcgtccttggaattgagagttaaggaaacagttgagtctgttaaaatcaaacacagggggaaggggttggggctgtgtctggaaacagcagccaaacaggtgactgactcccagggtgttgtcacaatgcgggactgagaagcttggaacaggagtgcctctgctaacttctggatattgcaggggatggacccagagggatgcgggggaagagggtctggttctctctagggtggttctggtcccctctgcgtcatgcttgggagtggccagagcctcctggcatagtcaacatgagcagtggtcccggttcctttcttttctcctctccccaagtgctatcctgttcatgcctgtgctcagagcttcctcccttctctcctgggctgtagctgaggcttggaaaggagaaggtccctgtttcctgcagctgatctgatctggagacacccccgtgtagactctggttacagccagatgctcaggttgccgagggactgccgtatggtgggtagagggataggagtgagcatgagttacccagcaccccaggcaagacaggccgagcctgattctatctaagctgatttgcatctccagatgacaacataatgagcaaagtgaggagctctgagccattaatacggctgcccggctgaggtaccaaactgattgaacaatacttgaaaggctgaggctggggaggccagtggggctgggtggccctgcaaccacgtggctgcctgttgtcttccttcaactgctggaggatttaaacaatgttcttcaaatgaggtactagtgctcaaggacaggggctgccccaggcaaggaggtaaatgaccagatttctgcgtcagtggcctccccacccaccatgaaggaaccagggtattcacagatgggagactgagaccccaggatgcacaagggcagagccagctgcctccctggaagaatcattctctggctgctgtttgtgcctcttgggcaggtgtgaacgggcaggcatgaagcaggctcagccctaatatgagaggcccttaggagggtcagggggacttggcagccgcagccctgaaataggtcatgctgggtggacaccaggtagaggcttgtcaccatcgcctgctgctaggagggagcaggccccagaccaccctcacctcacctgctgagccccagacccccatgtgtagggggggcagggcttttcttcctggaatgaaaggagcccgcctaggacagccactccacctctcaccgtgctggccactccggccttagcttcagggattagggccaggcggcctcttattttaggttaagaggcattaggaagggatgaggagttaagcccaggcaggaatcttccagggacctgcatacacttcctggttctggggggtggcgggggtcaaggcgagtggaggcagcctgggcttcctgccatgggtggggactagctccctcccttgctgcccaggaacagtgaggggtctcctgcagccaaggatgggggcttagggaatcctcaggcatgtttagccaagaccttgcaccagggttccccagcttacaggtggcacctttctccaacctactcaggttcctcaattcttcccttcattccctggcttctgaacgacccccaaagcacatggcttctgcctcttgctctgcccattcaaaccttcttacaggggcagacagaatgacacagaccacacaattcacggcccttctgtgcttaaaacctagcaggggctcctcctgcacacagaacacaacccgagtgcctggcccaagaggtcctgtgacccaccaggctgaccccactcctcccctgcttcccttggcctcacagtaaaggggtctgaggttccccattccagttcgtgctcacggcagcacctgactccatgaggaagcctctgtctcttcgggggctgtctcctctaatggtctgtgccccatctgcgcagagtagcctggggagttaccggaaaagcacctactgaatcacccagctacaggagcggagcgagggagcaggtgtgcaccatcaccccaggtgtctcagatgtaggctccatgaatgcaggggcaagaacggaggcccagcacccaggtgaggaaagctttcacctcacaaggcaggccctgagctgaggcctggggagggagccgccctgcaggccagcggggccacagctgggccaggccagcagctgtctcactgagcctcagtcgctatgggtgagacagacggggctgcggagattcaactcaggccaagaacaggcccttggctgggactcggcacccacagggaccctgggggagtggaaccagtgagaggcgccggtagtgaaggtgggaagtgttggagcaagcgtcactggcggtgagaagggggcggtaggtttttgctttaaccaactgagtctccttcaccttccaatctaaggaccagctaagacgatgaagtggaagggtgccagagccgcccctcctgctccctatgctgtgaggcagcccctttccatcactggcctctgcttccctctccccattccgctgcccagggctgctctgcagacccagctgggtgctggtcgggaagccagagcccaggcctcccccgactcaccattactgtggtttcctgtttggagggaggcagggggctgcaggttgctgctcaaggccccgtacccgcggtaactgtagttgaggccgccgttggcgtacacagggtcctgggagtaggaggaggctggcagtgagtaggtggagtgggtgatggctgcggagtcccgcgagtgctgcttgtccagggctatgggctcatcctgcagaggggagaggggggcgctggggaaaccaaggggcagctggccccaactaccatccctggacacaaggtggataaatgctgcggccccaggactcctgggacccaatgctgcggtttgacctgtgggattctgtctgtcccctcccccagccaccttccccccgggggctttccccaactctgctcatctccctgtcagcgtatttgatcagggccctctggtctccagatgaagtccaggcttccgtatgaggtctgaggagctctgagaacaacacacctgacctccacccacctcctctccttgtctttgccctcctgttccccctctgcccttctcccgactgtacccatcacagctccctcagtccacacccatataaggcctgccctccctggctgcccaggagcggcccctgtagtggctgcggtggcaggtacctgtgaggactggtagatctctagacgcatccgcttggctgcctttcttgtctcgctctcacaggcagctgccaggatgttttctgccatggccgaggtcagatggggtggcgtgggtctggtctgcaggcagaacggggatggagctagcatggggcccgtgggggccctgggcttgtgcagagaccctgccccaggggtgggtggcacagggtggggtttgggctccagcgcctcagtctatggagctgtgtgatctttctgggccttagttccctcatttgcaaaccagggattatggtacttgcttccagggctcctgggaagaccctgggtgaaggggcccgggcatcctgggagtgtggcaggaggtcagtagtggcaccgagggaaagtgtgggccaggcaggggggactcaccatctccatgccgttcttcttcatgcgacggcaggacttgaggtacgtgcggatgcgcttgcgggcccgctcctggaactcagggaactgccggctgcaggactcgatgatggcctggatcttctccttgggctgcttggagatgggcaccatgcggtccaggttctcgtccacaaagagacgcacaaacatctgtggagacacgggccatgggaagggctggccctggccttgcccccatcccaccccacctgtttccggccggtgctcacgttgaaggccttaagacgctcagggtccatgccttcagagtcgttcatcttgtcattgtcctcatggtcatcgtggtcatcgtcgtcatcatctgccgtcggggcccggcccactgtcaggtcctcagggcagccgctgacctcggtcttgatggaatcgtagctcccagagctgtaggggggggactaaaaggagggcaagaggcagagggttgggccaagcagctgctcaagcccttgctgggtctcctacaggcggtgagcttggggaccagggtggcacgcatgccctgctgccacgagagccatagctgcgaggccctgagcaagtcactcccctcttctgctcccttcatctgtgcaatggggacagcaatgctaccacctccctccctgggctgccgcagggaggaccgactgcaatagtgtatgcagagacctggttcccggggctgctgagcgcttaggagggtgtcagctgtttcctcagcagaggccaacaccaggacctgccacgtgtacaggggaaaggcagacatggaaaggactcccaccacccgccagcctcctctcgtgccaagatatattttggcttcggggttttcctccctgatccccaaggggctgcaaccccaagttgacaaccgagctgtcaccaaagcaacgagcatgctgtctgtcgggaggaggaacagatgcgctgggcgaggtagccagccagggcgacaggtccgttcagcaggatgcgttcccgcagctcctgagctggacttctcctgtctgccccccacccaggacagcacagtggccccttgagaatatgcgggtagaaagggagagggaaccggatccggcctcccccagcagtctcctgtcctccagtagagaagggctccagccctctgctcccaccacgagtttctccctggccaagcccctcaaccatctctccttaggagcagctccctcttttcccccatgcccctccatcttctcatccttcatggctcagctcccacaccacctgtctcctgcccctgcctcggggcaccgctctgggacggctgaggaccactgttgcctttcggaaagtttgtgccttcgatgtgtcctaagtactcgttcagatcgtgactgacagtagcctggggacactgtccctgccctcaaggaggttggcatctagcaggtaaggcaggctcagggaacaggtggcggtatggtcagaccctgtgatgtggcagcatggccatggcacagcccggaagggaacagcactcactgaggagcaaatccaggaagaagggcattgcctggcacctggtcccacagcacggcccccgccaggcctctctccctgggaccaggcccgcaggggttggtgccctagggtcactggcctggtgcctgtctcttcgtccacatacagacttggataggggcaggatgccgagggcccccgctggctaccataactggccgtgtggccccaggcaagccacattcccacgccactcctcagccaaaccctgagccagggccagggcagacagatggagaaaaaactaagataggagctgctggtggcgttcctgctctcatctcacttccctgggccccccatgtaccctgtggccacagtggcaatggctgctgaacacaactcacccccttcatggaacagcagctatgcctgtcccttggacccaggcaaagcctgctctggccagaacctgctcccagccacctgtgctagacacatagcaacaactcagcactgagcccatggtacagaatgtccccacgagacattccaaatgaggcaggcagtagcacctactccactctctctgcagaagagaaaacaggcccagagagggagaagagcctgtccagaggtgtaagctccaggaaggcacctctggcccccgggcccaggttggagaagaggcactactacaggaaaccttagtggcccggaggcagcttgtggaagtgtgggggaggccccaggaagcaggggggatgcccactggtaggggtacgtactgtgcccacccttaccaccgtccatcagcctagtcaaaggaggagttccactgcccacatccctgggccctcgcccttttttcgcacgacctataaaatggggacaggcacgcagacaaaccaggcagtgggaggcctcgtacctggctgtgccgaaagtggccacttgctgttatccccagcagatgctgttctgggggagggggatgggttgtggggatgcatatccacctaccacctctaccaaggcaggggccgtcagctccacttcacaggctcggagaagggggcctggcttgggggcacactccaagccatctcccattccagagcttcaccaggaaccgaacacataccagccacagccaccaccctggctcggtgtcacacacatgggctggctccagctaagctctgggcgtatacaatttcattctcgcctcgcgacagccctttacagaaagaaatggactcagcccccagccccacacacctcgggggtggtcttcaccccgtatttgacgcggctccgcagcccgtcggcaccgcagccatccgaggggtaggaggctgtgccaagtgccgtggccggcgggagcttgtcacacaggttgatgggctgatcctcggcggccgtggtgaagtccatgggggccacggcgccgttgccattcatctcggggaaggcagggtcgccctgcgtgctgctcgacgtggatgggttcagggtggaggagccattgccgctgccactctcagaggaggagtcatctggaatgagaggcctgggtgtgaggccccacccaaggcactgtggccactgcagccacctcggagtatcccaccctgtgtcctcctcatgagtgtccctgggttggggtgagtgctgctaccccacctcagaggcaatttgccccagcccacagcctcagctgaggcagccacagggtcccctctgccagaacagaggggccatcaggaggggtgtggccaggcagggctgtgcagggcatggagggtcttcctgcaccccaaactcgcaagcgttatgtccaggcttaagggagaccgagctccaagggtttgggagtgagtggcctgtcagagggccctggaggccctcgaagcccggccaggctctcccttctccccagctcccaggaccgcacctcccacccaccctgctcctgctgccgggcactgccttgcagcttcgagctctcagagcccctgcccacggtgggccctcaaatgtctccttcctctgccggaagcaggaaggatggctctactgtgacctccagccattcactccctcctgtaagcaagcccagccctggcagcctaggcacaggcacggtggcccccgaatctgcgctccgtgcaggccccacggcctgggacgtgcaaagccggggctgcaaggtctggggtctgcacgcggcccccgagtgggcctgcccggcgtctcagggtgggcagccccggcaaagcactgcgagggcgccccctgccgcaaagagcgcggcaccgccagcctgcgggcgcgggggaggaaactttaaccaggggaccagacagttccagatacattccaggcctctctgcccacccagccccagccccagccccggcctcctgcttgctcagctgagacggcagaggctgaagctgcacgggaactcccggggtcactgtcaggtgagcacccgcgagggtcccggggaggtacgggtgaccctggcggctccacacctgcacccagagtgggtgggggaggggtggtcacagcgggccctgccgccccttcccccaggccagggtcacgccggaccccacccccaccctcccagccggcagattatgaagatttagtccccggtgctgggcactgggcacgcgcacctccagagcgtccccatggcgaccgagcggctctagcgccccaaccaattgctggcctcccggctgcccgggggcgggtccaggctgcccatcatgcagccaggccgggcagagggggatgggaggccacggcggcgcagtgcacccctccccctcggctgcagcaggtcccctgggccaggcgtcctgtcctccttcgggcagcctagctccaccactccctccatcctcccgcagggcagctccgggctctgctcaaagcccgcccatagctgcccctcactggctgcatcctcggagtcccggcccgcgctggctgtccccgggaccccacagcctactcgcgcccagtctggagccaacacattccccagcatttttactgagcacctactgagtgctggcctggaaacaaagtaatgactgcaaccaaggtgccagacctcctgggggacagatgtgccttactcagcctcgtgggtaacagggaaggtgaattgtgagaatgggggtgcccactttcctccacccgggaaccagaccagctcctcatgcagctcccactggctgctctccagcgcccaggccacccacatcccacctgtgagagccaggcctaatcctcactcccctgtcccatgctttcctgtagctgagtaagagtccggcccacagccactggcactctcagtcctgtgacctctgcagtcccccagcccagcctcactatcctgtgctggagctctgcaatctgcctgccatgacacctccagctgagcagatggcagccagccttcaaggtctggttccacactgccacttcaggctggcacttttctccactgtccctaggaaggaggcactcacgcctccaaccccagcttgctgcccggccctgccagggatcctcatgctcccttcccctggcccagggtcatcgtgagggccatctgccccaccaggacagaccctgtcaccagagaagcccctgcacctgaggtccaggagcctccacgggggacagggatgacacccatactggctggttacccacgctcccatgagctgcagggggcccatccttcacccaccttgcaggtgcgacttcacataccgacaccaccctcacaggccacttgcttgaccttggagggccttagattcctcctctggaatgaggggctgctcctcagtgggcatcgtgcctggcacacagtgagcaagtggtcactgccttcatcacaggcaccaggcccaaggctggctgcagtgccacaccctacataggcccagaagtgacatcccatcatcccaccacccacctcccaatcaggttttcccgagaagatggacttgccctccgccactgtgagctccagagacacgctgctcagggtgctcctggagcctctaccaggtcagatgcccggcacgggggcccagactctccagctaccaagacctttgcctcggggctgtgcccccggctgcctggctggggatcgacaggcactagtgccggggcagaacctcccctaactgcactcagatgccaccctggtctggccagggaagtggttgggcgggtaagacccgtaaggcaccaggtgctaggacctcgtatggccaagtgttccaagctgttagaagaaactggaaatctgcaccattatgtaaacagattttaaaatattggcgactcagttacatggtttactttttttttttttttttagggtcttgctctgttgcccaggctagagtacagcggtgccattagggctcactgcaactgctgcctcctgggctgaagcgatctccccagcagcgcacaccacgacgcttggctaattttttttttttttttttttgagatggagtttcactcttcctgcccaggctggagtgcaatggggcgatcttggcttactgcaacctccacctcccaggttcaagcgattctcctgcctcagcctcccaagttgctgggattacaggcgcccgccaccatattcagctaattttgtgtatttttagtggagacacggtttcactatgttggccaggctggtctcgaattcatgacctcaggcgatccgcccgcctcagcctcccaaagtgctgggattacaggcatgggccaccgtgcccagcctcggctaatttttaaagttttctttttttgtagagaacaggtctcgctatattgcccaggctggtctcaaactcccaaggctcaaaccatcctcccactttggcctctcaaagtgctgggatgacagacgtgagccactgcgcccaacccattatttatatttttaaaaacttcgacaagtaaatgggtacacaaatgtggtctattcatacgatggaatagtatccagccatgaaaatgaatgaagtttggataagcgctgcaatgtggatgataaaaacacgaggctgtgggaaacaggccagacggacaaggatactcagtgattccacttctacgcagcatctggaacaggcaaattcacagagacagaaggtacagtgaggctccacgggctgggaatgggcagttagtacttaaagggtgcagagtttctgttgggggatgaacaagctgtggaaataacagtgcttctggagtgtacacttaaaaatggcaaattttatgtcacacattttaccacacacacagaacccagaccaaaaacagcccctttgccctagtttataggctctatctgccattatctcattttctcatgccgcacacacagagcctactcagagggacaacatggatcgcgaaagcctgccttccccagtgacaccaaggtctcgcctacccccagctccgctcaggcagccccggcatgccagcccccaccccacacagctgcccccgcgccacatgctctgggggctgcctgcaacctgaggcccatgttttgccgactggggaggccacaggtttgagccgcggagtggctggaagaggctactccaccttctggagcctccgtttcctttcagagtgggtcccacagccgtaaaacacggttctaaggtgaggatggtgcccgagatggggcaggagctcaaaaggaaaccccaattccctgcaccccacattttctcacatcataactcacccactgccgacgcacgaggctcccagactgcaacgggggcttctggggatcccggagcccagcctgtgacagtctgaggtgggcccagtgagagggccactgtggggatgggggcaactgccaccctcggagctcatgctccagcagcgacaaatcaaacctgagggctccagaggagacggggctctgaaggggtgtcaccagctttctggcccctgagccatggtgtctcccctactctcggcgactcctgctcgcccttctgtgctaacccgagcaccaccacctcagggaagccctccctacctgccccgatctccatcgtggcaccggctgtgggccacggctctgcagaagccatcccagggacggtggggcgagggctgaagcctcatgaaccaacaggggcagaggtgctgctcggggtggggttggtccagcctgtccctcggccccacaagcagtggatttgatgccggctgcagccgcaagggctgagtttactccaactggaagccaggtccctcctttgggcccaccaggcccttccagcgagcccctatggctcacccacccgccccagctgtgacccagccttggtacttgctgttccctcttcctgctccactctgtcccgggtgtccccttggcgcagtccctcacttccagggctctgcgtaaaggtcaccttctcggtaagcccagctcccaccctgctctggcacactgacccctctacctttcttttctttttttttttttttttttgagacggagtcttgctctgttgctcaggatggagtacggtggcgtgatctcggctcactgcaagctccgcctcccgggttcatgccattctcctgcctcggcttcccgagtagctgggactacaggcgcccaccaccacgcctggctaattttttatgtttttagtagacatggggtttcaccgtgttagccaggatggtctcgatctcctgacctcgtgatccacccacctcagcctcccaaagtgctgggattataggtgtgagccactgcgcccagccccctctaacacagtagtattgcaaggagaggataagtgcttggaagaaattacctatttcttccaagcacttatcctctccttgcaatactactgtgtttattgtgtctctggcctgtgcccagccttcacagaagcggccccagccctagagacccagagttggtgcagctgtattgggtgggcctggatggctcctgctgccccctagatcacacccctccctctggtgggggcaactgagtcttcctgggctcgccggggtgagtgcatgccccaggcctggccagtcaacccatcacagcaactggtaatagcgtgtgaccaagctgggcccgaggacatcacgcggggactcctgctgcgatggctgggaaggtgctctctacctggggttgctgggcccgtggtgcagggaggcccacgctggggaaagcagggctgatagggggcacagatgatcccctgaaatccatctgtgcctgccacctaggaaggccctagaggttttggtgagggagctaataatttccttattggttaggccggctagaggcaggctcacaccaatggcttggtctctgagtagtccagggtcttctccctggcagaggccaagggatgggacccgggggctgggatcgctctgcatggggacctcaccatgacgcccagctcagtcctgaggaggctggtacccacaggagggggtggtgcccacaggagggctcatgcccacagaaggggctggctgcaaccctcacacccacccctcactgcacctggccaggagaacgcgcctgtcactgtttggggaaagaaggaaaagagagactgggggcagttgggttttgatccgattggaattcttcctcccacaacccttaaaaaaaaaatggatttaggccaggcgcagtggctcacgcctgtaatcccagcactttgggaggtagaggcaggcagatcatgaggtcaagagatcgagatcatcctggccaacatggtgaaaccccatcactactaaacatacaaaaattagctgggcgtggtggtgcacgcctgtagtcccagctactcaggaggctgaggcaggagaatcgcttgaacccgggaggtggaggttgcagtgagacaagatcgcgccattggacttcagcctggcgacaaagcgagactctgtcttaaaaaaaaaaaaaaaaaaaactgatttaaaagagacatcgacaggcgcacaaacccttgctgtgatggaatgcagtggggcccgggcagggatggtgctggtgtagggtcctgcagtctgggcgaccttgggcactgccacctcctgggcctcctcttatctacagtcctgggagttgccgctgacgccctcctgggctctggcactttatgactctgtgaagaaacccagctggctccatgggcaccgaagccccagcacacaggcctcacggggtgcaggcctccagctgggaggctcagtgggaagctgggagttctggatggaccctccacacctggagctggaagtggaacctaagggtgcccaggtgacctcttgtccccacctggtccccatcttgctgcttccatgaggcccctccaggagggtcacccttgaggccaacctgctggggcccagtgtgatgaaagcagggtgggcctgcccccagcccatggctgcgtgggcagcagagacatgtcctgaggggccttggggaagcagcccgggatgcaccccctctcagcatttccacaaaaccaggccctccccactgtggcaaagggcgactccttcatctgggcaggacccggagcccaccacctgtgcccagaatgcctacgggcagggaaggactgccgtgtccgtctatttgaacatggggcaatgtgctgctattcaaatggaggaattagtgatgaatgggggaaattgttcctccctctgtcccgtctccagaaggagacaaaaaccccttttacctcagcaaacaatgcccttatgtgggcgccagtgccccgcagcccgcacaagcccagctctgtgcgaaccaccaatcgccacaccgcgctctggggcccacagccagtggcaccctctcccggtgggcgactcccaccagctcccaggctaggctcggagaacgggaaggcccaccatccctgggaccacaggccaggtacacggccactggaggccagcaggccctgcgtgcagactgccttccgtgtccagaggtgtggctgctggaggcagtgccgcctccatgagactctgtcacagcagcagccaggcgggggatgggaggggcatcaataattcacacacaacagggcgacgggggaggagggggtgggagactgctggagccacggcccaccatggccagggaggcgtggacagtagggctatgggctgtggtctgggggtgctgaccctgctctgaatttgaggcgtgcacctccccaggactggccccctgcctgctttgacaaaggccagcgcccaggctgtgtttacacgatgcgtagttccaaggagcaccaggctcagggcaggctgcccagctcttcctccagaaaggcaggaggggtgcaggggtcaaatgggggacactaggaccctaccatccgggtgatggggccacacggggcacctgcattctccacgtggccctcaggccccagctgcctgcacagctgccctcctgagcgcccagctctgtccctgtggttcacacagcctggcccggccccagccacggagcagggagcccatgccccccatctgggtgccacacttgccccctgatttgcagccccggggcgccagttcctctacccccacagcatgcgcctcctctgcgtgtgcccctcagtgcccgggcagtgggcgttcctgctgaaactctggtcactctttgcttaggcaggtgccaatttaggccctcacagtcgggagcagcactgtccgacagaaacagagtgggagccgcatgagggatttgagtgccctagtacccacattttaaaaagtaataaagaaacaggtgaaatcaattttaataatctactttatttaacccaatatatccaaaatagtaccatttcaacaaataattgataccgtgttatcagagctgagatatttcaccttcttctttcctacggagccgctgagacgcagcgtgtattgcacacctgtctgcactagccttttccaaggctcagtagccgtccttggctaatgaattagacgtcacacacctagatcttcccctaaaactgaaatcatttctctctgcagagaccctggggttcctggcccgtagagaggtgtccaagctgcagatgatgttcaggccttgggacaggtggctcaagcggtggggccctggagacagacaccaccttcagtggagggggaggtggacaccaattatgcgtcaggtcccgagtgtcaggcggcgggtaactcatcatgcctgatttgcacaaccaccctctgcagcagacatcagggaggaaccagaggctccagggggaagtcaccgacccatcacccgggatgagtggaggcgcccagacaggccccaaagcaccacccaggccgcccagtgctctcagacattctgggagcctccaaggccagccttgatttgcccatctgtactgtgggacaattccctacccctgctaccagactgctccacttcctagagcccctcccccaacacctactggccactgatgccccggggaagcgctcccaggatgaactgcctgtgtgtgggtgttctccctggccccgtcctccaggccaagcacaggcggtgagaaataaacactaattcagtgtgcaaagatcgagccgagacacacagcctgctccccgtgttctcagagcaaacagagccactccaggccaccatgtgtgaatgattcacggggcagggccctggccccaaagcccctgcaggccctcctccagccctcccggaagccagtctgggttcggtgcattgcagtccttaggtcggagtgatgacgccaacgcggcctggtcacttcctggttcctgggaaagtcacccttgaacaggctcccggtggaggtgcctcaggagggcctgtccctgacacaggagcctgcaggatggagctctgtatgtgtcctgggctgaggggtggtggcgaagggcaagggcactgatccccacgtggccccactgggccaggctcaccttcacctccattctttttttttttttttttttgagatggagtcactctgtagcccagtggtgtgatcttggctcactgcaacctccacctcctgggttcaagcgattctcctgccttagcttcctgagtagctgggattacaggtgcccatcaccacgcccagctaatttttgtatttttagtagaagtggggttttgccatgttggccaggctggtctcaaactcctgacctcaagtgatctgcctgccttagcctcccaaagtgctgggattatgggcatgagccaccacgcctggttcacccactttctcagtaggtgaacctctcggctcctcaggccccagagcttgtcctccccagcatcccagacaaggccagggctgtgtaggccctgcccactcctggataaagggatctctcggtgctgtctcccagcgtctctcaccccttggcgggccggggcccagcacagcccagcattgtctgtgccgcctgcggcccagctgatgatggacactttcctgtgacccgggactgccagtgtggcccacagccaatccctggaaggcttgggccccagctctctgctcctgggggaggggaggccaggaggccgccgcctgctcatctgttgtgggtatttggagccttgaggaggaacaaacagctcttgctcctggggtgggggtgggtgggacctgcacccagagaatggggcccagctctggtttctggcctcagctgtgagaattagggtcagggcaatggacacagccataatgagcaggtgttggggagaaggcttggcttaaaagcccactgcaagagaagcctttcacaggccagcccagggaggctggtgcaggggccacacctcctgccatgcaatactgaccagagcagacgtctggccatgagtgttgggtccacggggaggcagcagcaggccggagttctgtgcctcctggtgggagagggctgctgtgacccagggatgggcccaggggagggtgggcatcacctgaggaggacactagaaagagccgcggcacaggggtaatgcgggtaatggtctctgagcccgggtggcctggtcgttactcccaccagctccttccccatcagccttatggcttcctgcctgatccctcacttgaacggcttcacgctgtgctggggacaccccatggcaccctgagtaccagaagccagaagcacacttctgcctggcaccttctccttggatggcagcactgactcctcgctgcctgcttagctgcccatcagtgtgggcacctggatgggtctggcatttgccagattgagaagcagggtcttgggaacttggggtccctggacagggcctggcacatgtgggtggggagggagggacagggactcaggacaagctgtgagtgcctgggtctggttgacaccaaggaccccctagcccggctccctttacgaagaagcacaacccgggcggtggttgggagctgagagcaggggtggggatgccgctgagggtggctgtgaggtaagctgcagtcagggtcccacaggcctccatggcagaggggaccaagggagaccaggctggctgaggaggcaagactggaccaacggggtggtgcgcagggctcagagaatctgggggaggtgaggaagaccgcccacatccagtcccagcctggcccccaatgggcctgtgctgtccacatctggtcctcaaccgcctggcaaggtgggccaagatgatcacccccagcccagcaaggggttggcacccgcccaaggctgcctggcaaggagggaactgagcaagatctgagctctgtgtgcccccacacttccctgcagacctcttggaggccagggaggaggcacacaggggagggggccgggccaaggagaagaggccaacagcactgctgctgtaaataccgagccctgggcactcaggaaacacacctgctccccagagacccgccctgctgcccagtttgcatttctgggtggtggagggccccacccaagggcagcaggggccaggaggtaggaagccttggtcttctcactaagagctcctgggggcatgccaggatgaggggccacagcccccaggccatgtcacagagagaagctgtggcccagagttgggggatcggctagctcaagaccatacttcggggaagggccggccagatccatggcacagcacccaggacctgcctacaggatgccacatattgggcccgaccactccatcctcccagaacccttccatgccagaccctccccagatggcctggctgtggcctctctgcccttctctcctggttggagcttggggtcatagggagcttttggaaacaggtgacccaagaaaccctcaatcctggcatcgggcacctcctcccttcccagccccctgctgccacgcctctgcccagcttcccaggccacctcctcccaggccctttctctgattccccatctctgccaagagtgactcagtggccgttggttgagcacctattcagtgctagggcctggggataaagcccaggacaggagactcaggccacatggggccagccctgaggggcaccctgcagcgccacttccagcaatgaaaaacagggacttggccaagcacggtggctcacgcctgtaatccctgcattttgggaggccgaggcgggcagatcatgaggtcaggagtttcagaccagcctgaccaacatggtgaaacactgtctctactaaaaatacaaaaattagccaggcgtggtggtgcacgcctgtaatcccagctactcgggaggctgaggcaggacaattgcttgaacctggaaggcggaggttgcagtgagccgagattacaccattttgcactccagcctgggcaacagagcgggactccatctcaaaaaaaaaaaaaaaaaaaagaaagaaagaaagaaagaaaaacagggacttgagtgtccttccacaggagtggccaaaacgctggctctggagagacccagtccctgtggtctgggcaagttacttcccctcggagacgatgtttcctgccctgtggaacagcgacatgtatagctctgggctcacagggtcaggctgggcacacagcagggtcaggctgggcacacagcgggctcaggaatgggaccccagtcactggactgactagacaagctttgaactgtggctggcccacatcagtgtcagggaggccaatgactatgtgagaaaaaaggcgccaatactgcctcattgaaaagaaaatgaggctctggttacttagatacatagaaaagtctgagaaaaatagggccccagacatcattatttttcattttcttttttcctcctttatttttctatttttttttcttttttttcttttttttagatggagttttgctcttgttactcaggctggagtgcaaatggtgtggtctcggcttactgtaacctccgcctcccgggttcaagcaattctcctgcctcagcctccggagtagctgggattacaggcatgtgccaccacacccagctaattttgtatttttagtagagacagggtttttctatgttggtcaggctggtctcaaactcctgacctcaggtgatccacccgcctcagcctcccaaaatgctgggcttacaggcgtgagccaccgcacctggccttctcctttatttttctacaataattgtaatacttctgaaataaggggagaaataagggacatttctacaaagatgtggctcctgccctcagcaagctgacagcctgcaggggtcccacactggtgcctgtttggcttcaaccaaaccccagactcctccagggaggtggggacagggctcatcacccctgtgtgtcacaaggccaacgctggtgtgactaaagtggccaagaacctggaagagccaaagggccctcagtgcctttgtccagactcaggcctgcacagtgcgggagcccgtgtgtcccgaggcccaggttggaggagcggcctcatctgagaggcgcacacaccaggccctgacctgccccagccagggctccacacgactcttgctcagcaatcccccgactgcccaccctgcagaaggcggatgcaggcccagcgagcagacccctgctctcccctggcgctggcttcctgtctgcccaggaggtgagtaatgtccgctccctgcccccacgcatcccttctggaggccagacgggcctcacattttccgctcaggaaggggcagagtgagaggcctgctgaagcacatccaggggaaacggaaggagtggccccgcctgccgggtcaggaacctgggccagccccggcctgcaggaggcgcactggctcacctgcctccgtgcatgccttcgttcattttcatccactcattcattcaacaaacagcaccccagcacctgcgtggtgccaggccctgtgctgggtgctggaggcctggctctcagggtgcttatggtacttggggaggagactgcatcaaacagatcatcccacaggtggcggcgtaagtacagacggatgtgctgttcagccccaaggcaacgccagaccacagtgcctctggacaaagtctctcaggcatcctccctccacaccctatgatgtgcacagagccctgttcagacccaaaagaaagcccacgcctcagccggggcttggccgagggtctttaggggacctggcccgtgcctgggcaggaaactgtggcaggagctggcccgcatggccctgggccccaaggagggagcgccccaagtgtgtggagagggccttctttggttccctagctgccctgcccatcttctggggaccctcacacatggcccctgcccctgccaaaggggagagaggagaagcactggcacctccccaactctggctgagttgccccaagtctctccctgatcctaagtttcctccccatgagatgagggcactgtgagtggtgctccctgccaagcaccagtggctgtgatcgcagggacctgggagcatcccaggacttcagagtgtggggaactggtgtaaagaggtctgggagaccaagactcgcagccagtggcagggttgggggcagaagcctaactgtgtttcaggacaagcagacactcaccccggtagaacctcagaggcaagctcccggggagtgaaagctgtggcacccgcacaactcactcttgggctcagtttcaggacaagcagacactcaccccggtagaggctcagaggcatgctcccggggagtgagagtggacactcaccccggtagaggctcagaggcatgctcctggggagtgagagcagacactcatcccggtagaggctcagaggcaagctcccggggagtgagagcagacactcaccccggtagaagctcagaggcaagctcccggggagtgagagctggcacccgcacaactcactcttgggcccagtggtctccgccatgggatttgctctgccactcagccttcatctgcctttgttaaaatctttaaagaagggccccaacaaatccacagctgtagatctgtgctaactgcctggctccctgaaatcactcctggctggatcacttgtcagcagggatggggtgctgatatggttgggatctgggtcccctccaaatctcatggtgaaatgtgtcctccagggttggaggtgggcctggtgggaggtgtctgggtcatgaggggcagattccttatgagtggctgggtgctgtatggagtgagttctcactatgagttcatgcgagagctggttatttaaaagagcctggtacctcctccctctctcttgctccctctctcaccatgagacatgcctgctcccccttcaccttctgccatgtctgtaagcttcctgaggcctcaccagaagccaagcagatgctagtgccatgcctgtacagcctgtggaactgtgaaccaaataaacctcttttctttataaattacccagcctcaggtattcctttatagcaacaccaaacggaccaacacaggtgtgtcatcagcacagccttgggagtccccacactcccggcgaaaagaaaaggcccaggtactcagatgggaaggatgtccccagaaacaaacaacccaacttatcccccatcagaggcggagctccatctgctctgcaatggtgtgcttgggtaggtctcagtaaatgtttgttcgtttgttcattcggggataacagacattcagcaggtaccgacaatgggccatgttcgcaaccgagtcccaggggcagggcagagaccaagactgaccttacagcaggcctcagacttccacgaaggacggaaggccagagcccacacaccaagcccacctgggcatcagtggggttggggggcttctgcaatggagaccctcgggcggggagtggagcacacagagggctaaagcgggtgcctctgcttgggctgtccctgcctagtcctgcgtcaataacaggggcctgagagtgctctgatgggagccccttgactcactcatgggagctggacctcacatttctgcaccgtgagcaccttcaagaggggctggttgtatgtctccaggggggccagaagatggcccaggactctaggctggaaacccactgctctggacagacaccaacaggcccacaggcccagaagaggcagcagaggccaggccagctgcctgggccttcccaaggcctgtgccctgcccagggtctcagccagccagcggggtggcccacaactccatgagtgtctcggaggggacagtgaggcccacggccctgtggtcaacagcatcctccctgtcccagctctggtgtccatcaggaggggaaggtggtgtctgactaccccaggctgaccccgcactgggctcttggggacctacagaccccccagcctccctgcatctctcagcctcatcctcatggccaggccagccagcctctgggcagcaggtgctgagggaaccccatggaccccacagaaatgccactgtcagctacctgatcctgacagcccccaaatcaccagacctccccaggacgtgtctccaagagagatcacgctctcaaagggtggtcatgaggaataacagcatgagatctgcttgggaatgagtagggggaccatggtcccttcagccccactgctctgggtttctgaacaactgtcccagacccttcttgtgggggaccacagcctgtggccccagctgggctctgcaggcaccgccctcagtgttccttgggcgtggcctcaatcggctcagttgaggcgggaggtcagctgctgcgcttgtcccagccccagagccccccagagcacgtggctgcccccgccggtccccacccccgtgggaacgctggaaggcggcactggcctgggaggctggcagcacgagggggtcgcaccgacctcacgaggcatcaagcacaaaagccttttctttgccggcagccacgcaccccactcctcctgcagccactccctgtgctccccagcccctggcccagacacctccagctgcctccagactgggtctcctcccaaacaaagccggattcaggccttcgggaggcaggcgcgcaggttctgccatggagatgaactttgacccaaacagcaaggctcctaccccttatttactctttaaggctgacccgtttcacagagttcacattacacccctttttaatccgcacctccctcccacattccaggcctcgaccttcaacccctcctaattgctggctccggctcctacaccccagttcttgggcccagctcactcatccctgcccccaaccatctcctccacggaaacaaaggcgatgctggggtgctgtgctcacagggccacctcacaaccctggcacaccaaggtagatgccagggtcccagagcccaaccacttgggggagtccacgtggaggccggggtggatctttggggtctgattcctgaccctaactctccaacccctgagaaggaagcctctattccaagggaggctggagtaggctgcctggcaggccctgcgcggaggcggtcagggctagggaagaatccggacagctccccagccagccgcatcgcatcccaaggggctagggtgaatgtgggcagctgcactgcctggtcactcaccaggtgacctgggctatagcctcacatgtggctgcagaaacacagcttgtttcccttgctgggcagcggaactgctctgggttaggtacactgtgaaccttcccaggcctgcccctggtaactctgaaacccacattgcagaagcccatggcatcccggcaaccaggcagaccccccgccccgcaggctgccagtcctatgggctctctccctcatctttgggaggaaggagccaggagctggggcactggggcccatggagatgctgagaacactgggggcagtgcaagcttgggcctgagccacccaaaggccttggcccagattccgccaccctggagtgtgtccacacctctcacctgaggacaactgggagcagggggccgggcacagcccctcctcaactgccaccaaggggcactcaccgtcctcttgactgtggaggttctgcgggctccgcatcctctcgtcctggctggggctcaggctggaggccaggtgcgggtcagctgacatccatgtggagtcgctcatatcaaaatcctcgctgctcacagaagtctcatcctgagcagggacaaagaaggtgggcattcagcagggacgggctctcatcagcctgaggcagccttgtgggtggaccccagggccagtgggcgtttgggagtgccctgaaggcggcaggagccctcaaaccttgaagtgagggctgggtggtgctcccccttgcccggtggaagtggccccggctctggttcctgtcggaagccaaggctaagggccggcactgtctgtaattgaagacaattatgaggtctcgcatcctgcaggggcggatggcagggcctggctcttacccttgtgagccaaggttgaaacaagcgctgtaaacaagggctgccgctccctgctctcagcccagggaccggggctcactctgcacaggacccggcggcaagaagcgggcagcagcacatgcccgccaccaggcactgaggctgagctgagtgcccccagcaggcctggcgccctgactcccatgaagcatgcatggaattcctttctcccactcccccagcccagaggacgtttctgtcttcctccttcctaacctttgctgtgcttcaaagatacgctcttgggcagcttccagggctgaaagggccagccccagaagtgcagagaaggaagggggcggggcaggccagggttcggaccagaccgcaaagggggttcagctcaagggcctggggggccgccagggcgttccaaacagccggatggcctgctagagaggaccacgcctgcctcctctctcctcgctgccggcttcgggccggcccttggccagtcatccgggaacccccggggcggggccccttcaacccagccctccagggggaagggcccccacctcctccaggcccagcctttcaggagcagcaagcaactgtgcctgggagctggctgtaaaaccaagaaagatgacccagcagctcccacacccggagttctggcctccccccagcaagacacaatggcctctgtgggcccccagtgaggacctctgacagagcaccccccaagcctcccctccggggcccccctcacagacacctcttttatagtgagcaaacacactttggttggaactttcttagactgctgtccctgaggcagacacatctgctccaagtgctagggaaccagtgtggattcgcctccactccctcccccaccggctgggctggtagggagtttcctggaatttatagcttctgtgcagtgtggaccctctgctgaatccagaggacaggagctgggctgtgacgcctgtagtccccacgcggcacacccagggcctcgggggatggacagagcccacgtgtcctctagtgtcctctccccacacacaggcacacgcactcactctgcctccctcccacaggctgcctgctccataaacacaagcacctccacccacagccctccttcgtgaaaactcgctcacacacccggagggacacacacacacacacacacacacacacacacacacacgttcaaaaggctctgcacaaagggtacaaagggacaacaaaactctcccctgtgctaactggatggagggagacgaaggggagggggaagagaggctggcaggtgggggaaggttccttggagccttgagcaaggctgcaaggtgcagccggctccccatcttcccagctggtcgtgccatgcgggctccgggaaccaggaacggggcatcttgcatgggccccttgctacttcctggatgcccagggggtgccatgctctgggtttgacctgaagtcacagctgaaggaggaagactcttgggtattgttcaaatgctcacgacttaaaagacagagtattctagtaacagttgaaagtgccacctactccaaactccccatccatccattcgacaggtatttactgagcacctgctatgggccaagctccgctctaggtgctgggaaactcagctgtggaccagacacactcctggcctgcctggcacccctcgatccacgagggagatggacaatgagcagaaaaacattgatgacggctgcaaagcacatggaagcagggcaagagggcagagggacctgtttgccagggcagcccagaaaaaccccacgggtcagaaatgctggagcagaggcctgcgagaagtgaggaggggagcccatgaggtctgtgtggctccacgcaagtttcaggcacaggcagcagcaagtggggcacaagctgctgggtttgaggagaggcaaggaggctgctgtgggcaggcatgggcgggcacacggggacagaggagccacacgaaaagttcccctcccacagtgcacgtaaccctggcagggccgtacctgccatctctaggttggagaaaggctcttgaactccactcaatacgcacactctggcctctctcagccaagttcaaaccataacaacagaaggcaaagcttctcaggggcccagcgctcccctggacttgtggtatttcaccctcactacaggtccaccaggtaggtacagttgacagccccgctccacagatgaggaaactgaggctccaggaggttaaggtgctcgcccaaggtcacgagctaacacgaggcagagccagatctgtgcaatcgccaaggactggacacgccctcctaactgagttggccctcgcctagaacccacactgctgctgtgaaccacaatcccaattccaagctgtatccagctgtcactgtcttgtgggtctctgccctgtctttccctggaaaaccttcggtccttccaacagtggggaccagactgtatgtcctctgaatcccgcacaaggcagtgagacttgttgaatcaactgaattgcctggcatagtgttggtgtttaatgaggacgctccattaatttgacaattaaggactctggtcccattgcgcacagttcttgaatggagggcatatgaagcccaggatgcaggctggtgggctggtggcaccctggtgccctgcaatgcctccctcctgccgctgccagccaccccacacacagccagggtttctctggctcacatcactgaactgttcacccaaatgccccctccaaccctcactcccttgatgggtcccactgggaaaaggtgggctacacctaacctggcatcaaaatcacctgattaggaggagcacccagtgcccacaggcacgggacttcaggctaatggttttattagatttcctcccatgaccccataacacaggcacccacgtcaggcctagctccagctctgataactgcccctgcgaggcccgccccgcctgccccaactgcccaggggcacgaagccagcagcacagctggtgtgtagacccaggcagcctgtgcccagagcctgcatcacactgtcaccgcaccatgggccacctcaccacatctcctcccttcaatgggaggaaccagattccttaacaaccaagtgtctcaagatgaggcccagagggaactcatgggtgatgaggctatatttacacacacacacacacacacacacacacacactctctctctctctctctcatgcatgctcactttcttcaatgagttgttgcacatttattgagcatctactatgtgctggcactgtgctagggacatagataactaaggcagggctcctttacaccaggccttgttagctaggaaaagggaccagcaaaacttctgacccacctgtaggtgcagtggggagacactgtggacacactgcctagtcacctaacgatgactgctttctccccagctccccaggaagttttcccacagcctccagggttctgccatgtggaccccagttttgtgaaaagtggttctaagattctgatatcttgactgctatagcttttttgaaagacaggatcttactgtcacataggctggagtacagtggtgcaatagtggctaactacagcctcgaccccccaggctcctgcctcagcctcccgaggagctggcactacaggcatataccaccacgcctggctaacttttaattttttgtagagacaagggctcactatatcgcccaggctggcctcgaactcctgggctcaagtgccttggcctcccaaagtgctgggagtgcgggtgtgagctgccacacctggctgcgacagcaaattttttttaagtgagaaatcaagtctattaagcctaacttttcaaaaacacacaatacaaaaataagttttggtcagacttacacaaacccttcaacacccagactttcaagggctgaggtagagaagaagacttcccaagacccctctgcaacctgtctggcgcagcacagcccagttcatgggtgtaagcccccctagccgcagatgggcagactgtagctccagtccctcactcacaccctaagccaaggctggagaagcaggctaatcacacaggcagttacaagtacacacagatcagaacccgtcaacgacaactgtgcagagggggaaaatacacccaagtccagagggccatgctggaggcactggtgcaggtttgagagtggccaaggcctcaggcctgctcagagacccaaggtgctcactggctcacccagaggtcacagggcgctttttacttttcccttcaggaatctcagatgaattgagggctattttctccctttctgttaacaaacttcaacaaaacttacattagagaataaaagtgtgggctgggtgtgatggctcacacctgtaatgccaacattttgggaggctgaggtgaatgaattgcttaaggccaggagttcaagacccacctgggcaacacagtgagacgctgtctctatttacaaaaaaaaagtgtgtgcaatccattacttctgggttccctctccccagtccccatgtgactggccagtcagctaccccctggtttctctagcctctgccctttggacaccctgaagcccgtggccttgcccacccagcaatcatttattccagcaccaaagccatcatgggtcacagggtaacagagccaaagccaaatgctcttctgaaaagggaacttaagagttaggcaggcagatgggtagcacccagtcagcctctgggacacaccccaacctgggagccctgcctctggggcagagggagaggagctgaccagactctccctgctcttatcttcagtccaaaattcatggacaggttcagtctctctccacccagcttctgaggcccttcctcttctgcatggtaactagcacaaccactgcccagcccaggaggaggagaaaacgggagaccagaggggaaatggtggaaatgggcctgtatccatggcttgtaactacgggcaggtgctatcagtaacctgattattttacaactggggtcaatttctctggaactgggttcctggtgcctctgaagttgagccatttgcatcctccaggacttgggatcctggggcgtgcctcacacggtattttccagacccttcctgagagctgtaattctatctctacagcttgcttgagaaagaaaaggaggaggatttgctgagaatttagtgcaattttaagccataagccctgaccaggagccctgggtgtgtgtttcagaggagggcaggggcagggatgtgcaggggatgtttctgggccaagcaggaaagagacccctctctatacagcccccaggcttgttcgacaggaggctaaagctcccactgggaagaacaccagcctcagggggttgccccagcaccagctctatcccaaagcggagtctcttctcaacccactggtgggcccctccttctggacacctgtaggccccttccaggccctggacattcttccacacgaggcgactctcccccttgtctccatgtcagcgagcattacacacgcagccttctgagcatgccaagaaggtactgaaccgcatgtgaccccaacttaaccacttcagttcatcagatggcttattaatggaagacgaaaaacccccagcatctaaagcaacaggggttcaaatccttgttgtgaaggagccgcacacatgaaacaggagggtggtctgagccacagctcctggggggtgtggggtcccaaggctgttgcttcatggctacaccccaagcccacctagccaccagggaaggaggccagccttccagcactccctgcacaattccactccttcctgcaaacatgcctcctctgcttactagccatgcaagcaccagctcttctgggaaatatgaggcaggaagggctgagacacagccaatcacctaccacactggaggcattctcgctctctctccctcacactcactcacacgcacactgtgtctgtcagaagcgtattcccatctacatgtggtcctctgttgtccctgctgtcatagacacctggatgctggaagtgagcatttcccacaccttcccactgtatatcaagtggaaaacaggcttttgttcctaagcaaaggcacctggctgctccccatcagcattcctcaccacgagggcctcgctggtaccctcagaccctgccattaatgggggtttctttaaaagtgaagctggagagaggagcttcagcagacagggatcttccagccaaaaggaaggctggaagggagccgctgtgagctaatcccctgcagggctgtccttccaagaaaggaacccagacaacacagaaaaagttcttgagcaattcccaggcggtccagctccacagagccccagggtaggggccgcaggaaaagttccccaaaggcgtcttctcagctgggaggaaggccgtcttctcagctgggaggaaggccgcagtgagctctgttcccactgtgcggcaggaaggtgctgaatagggtggtgtcgcccagctcaagaggtgctgtcttaaaaccctgctctataaagcaagcccagcctgagcctggattagacaggagcttgatattattcaaggacacatttaggccctaatggctttccaatgaaggggtaatttactacccggggggctaaactaccacagggcctgggccataaacgggccttttccccagaccaactcagtccagaatccggcctgtgtcaggggtcaagacaggggcctggtcccatcacacagatggctctccccagaagagccatgaggtcccccaaacacctctccccacaccccctttggtgtgtgtgagttggtggggcggggcgggggggggggagcaggctggggttgccagctgattctgggataagtagggctttatctcaagggagaatctatttcaagccacaatccttctcagaaagaggaggaaatcacagagtccaaacaccatttcaggtgaaatcaggaggttattcatctcccctcagagcagacagaaaggaaaatcaatgttttagagggggaaaaaaggttccatttgaattaatgggtttgtggcttctccattgatctgagcctcttcacactttctttttgtgcttttgtgctcttggggagaggggagggagtagggaatggggaggagggggtgggcctcccataaggaaaaggacggtctaaccttaacctttctacaggaataatgctaattagcgaggcttaatgagaacttcccccaggaagcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccgaaaagcaacactctcatcaccaaaccgcagaattagaccccgatggagaaaatgggtcaggggatccattcccaccccacccctccaaatccagaccctccgctaccacagatcagcctcgaaaaaagcttgtgcttcaacaaggatggggaactgccctcgtggaattctgtggggaaattgccaaaaaaaaaaaaaaaaaaaaaaaaaaaaacaactaaaaaaaaaccctgataaggatcccacctcctgattcctctggtcgcatccgaagaggaagggcaatttctactgactctttacgctaccattcattcacggtggaaccagcagagaagagaaaacgagacagccacagcgattgtttgcaattttgaaacagactgcctttaaccctccaactttttttctgtaaaaagccttttttctttcttcctctgaaagctttgcattgtgaacaatccatggtaaacaaggctccctctacagccgcgagtgcgaagtacaaccccacaggttcagagcccagcgtttacccgtcagaaaaataaaatgatgacaagacatcacattagcgccacgcaggcttccttccgcacatgctcaagactctgctgtcaatagaaaactcacactttctttttaaaagagggtttaggcacatttactcatttgcaccttttattcctgaaatcaaatgtgttttcaaaccaattcactctccccagtttactggatcttctcatccttggtgatgtggggcaggtgggaggctttatttatccacacatgctggtgcccaataatgatttttagaacgaactagtggccacagctcttaagttcatccaggaaatgtgtttccaaacgcgggaactgtccatcctcactctgaaaatgagataattcagactcaggatttccctttccccaccacattttcagagacctttgacttctcctggcctgaattactatttcacagcagtggtggacatctgagcttgaaatataaagccaaatacaactgaagttcaaaggtggaattgaacccagataacccacctcttctctgactaataaaagagagctagtaccgcccaggagggcagagcagtgattttctgtaggcatgaaacgtgaactcatttactatccctgagataaaacagcccagccctgctcaacccacagaaaacagttgagagccctgcagaaacctggctgttgagcggcactgcaaatgaggtgagttttcatgtgtgtgtgctgaagccctcagaaatctcccagatccttattcctacaggagctgccactcctggagtaaccttgtataggttgttttcagtgtccttgtgccactcccccactccttaaagtggccacagcatgagtcccaatgaggaatcgggtgacctagtttcttgaccactaattctcccagtgatgtgtcccttcttctggccccagcctggtaggagaccatggcagagaaagctgatcccatctgcttcggggggacaatgctgccacaggtcccctccagcctctgaagacattgggtgcttttgtaaacagatgattagggtatgctctgatggggctttttaagcagcaaacccctttctttcatgcagcttcccatatgaagtaagcatgtcccacaagtggggacctggccatgggactctggtttgccattattaggacaaataggatcttagcgtgaccagagcagacactgttcaagcacgtcaaaacattaaaaaaaaaaattatccccacaaatgacttattaatgacagagaagaaaatgtacctgcaatggggcgatctggcagacacttcccaatcaagtcatcaaattcagcagcctccaaagtggggccaccagacatgatgtcctcggctcctgaagggaggcactggaagacacagcatcacttgagccatgtgctcccccaacatgcttcacctgaatctgctcctcaagagacaaccagacaagaaatccagaaagagaaactccacaacacaacagtcttggactctacaaaacattcattgtcactaattgactttctaaacgataagatgaaagagaaataacagccgggtgcagtggctcacacctgtaatcccagcactttgggaggccgaggcgggtggatcacctgaggtcaggggttcgagaccagcctggccaacatggtgaaacccagtctctactaaaaacacaaaattggacgggcgtggtggcacacacctgtaatcccagctactcgggaggctggggtaggagaattgcttgaacccaggaagcagaggttgcagtgagccgagatcataccgttgcactccagcctgggcgacaggagcgaaactccatctcaaaaaaaattaaagagagagaaataacaactaaacttaatgtgtgactcttcttagatcctgtagagatggaatgaggtgtggacaaggggtgggggagaggcagaggatgggggtggaatgagggtgggggccagggtgggctctgggctgagtggtcagggaagagctctcccaggaggaagccactgggtgtcctaatccccagagggcagaagttgacagctgggtgaagacctgggggcactgtcttccaggcagagggaatagttggtgcaaaactgctgatgaaaggaaaggtgaccagagtgctagagcaatgtgggccagggggagggcaggagggatgagcatcgggggggcaaacagggccaagcatgcaacatcctgaacatcccccgtgaggtgtgtgggctttacactgggagtgaggagaggatgcaatctgagttacgtttttagatcaggggagatgagattataaaggagcagaagtgatgacagggaggccagtgaggaggtctaatggaaagagtatcatcagatggaactagttcaaattctggctctgacactagatggatgactttgggcaccatacctaaacctctctaagcaacagtttattcatctacatgtgatccacagtttttgtttgttggttttatttttttttttttttgaccaaatcttgctgtgtcacctaggctggagtgcagtggcacgatctgggctcactgcatcctccacctccctgactcaagccattcttgtgtctcagcctcccaagtagctgggattacaggtgtgtgccaccatgcctggctaatttttgtatttttagtagagatggagttttaccatgttgtccaggctggtctcaagctcctggactcaagtgatccacccgccttggccttccaaagacccactatgtttaacgtgtgtttaacgtagcatttggcaccaaattttcctctttgagattacaaactgtggtagacagtctccaagatggcccatgatgaccctcaccgcccagtttcataccctggtaccatcgcaatgcacagggctgtggaaccaatggtgcattgtggaaatgagggtgtgtgactgccaaggctagatcctaaaagacatcttgatcttttccccagagggagtacttggtagatggtagcttttatcatcaggattgtacatttcataattgcacaatcggggtcacatccctctctctaaatgctacactagtttactctgccaccagcaatatctagcagcactcatttcactgcacacttgtcactgcttactattagcaatctcttttatctctgtcaatctgagggaggaagaacagtgtctcttattttcctttgctcctcttcacttgggaatgtaagtagatgtttctgtgcactgtgtttacggggcacttgtatttctttttctttctttcttttctttctttcttttccttccttccttccttccttccttccttccttccttccttcctttctttctttctttttctttctttctttctttctttttctttctttctttctttctttctttctttctttctttctttctttctttctttctttctttctttcctctctctttctttctttctgactaacctgttcatatcctttgcccatttctctatttgaattgttggtctttttttttttttttttttggtaagaactttttggaaataaggaaaattaatcttttgtcatgtattttgcaaatatgttttccttttgttgtctttttatttagtttatgacaagatttttttagccatatggaaattttacatttttatatcatctgattttttttttttcctttagggctttagggcttcaggttaaaacaaaagcttttttccactctaagattacaaaagtaattcacctatattttcttctggaaactttatgtcttcattacatttaaatctttattccatcttttatttatctcaatataagtaatgaagtggggatctggcttatttttttctaaatggctttctaagtggtgtcaataccatcttttatcttttattttttatttttgaaacagggtctcactctgttacccagactgaagtgcagtggcatgatcttggctcactgcaggctcaatcccctggactcaagcaatcctcctgccttagcctcccaaagtgctggaattacaggcatgtgccactgcacctggcctaaatatcatcttttaaataactcatctttatccactaattggaaatgtcatcttatactaattttctattatgtgtggatttgtattatattctgttgacctattcctgtctcagtattatggctttaaaatatgttttctgggccgggcgcagtggctcacgcctgtaatcccagcactttgggaggccgaggcaggagaatggtgtgaacctgggaggcagagcttgcggttagccgagatcatgccactgcactccagcctgggtgacagagtgagactccctctcaaataaataaataaataaataagtaaataagttttctggcctggcatggtgactcacgcctgtaatcccagcattttgcgaagccgaggtgggcagatcacttcaggtcatgagtttgagaccagcctggccaacatggtaaaaccctgtctctactaaaaatacaaaaattagctgggcgtggtggtgcgtgtctgtagtcctagctactggggaggctgaggcaggagaatcgcttgaacccaggaaggggaggctgcagtaagccgggatcatgccactgcactccagcctgggtgacagagagagactccatctcaaaaaaaaaaaaaaaaatatatatacacatatatatatgtatatacacacattatgtatatatatgttttcctactaggtagggctagcatccatctctaccccataaactgtccctgctcacaccataacaaaaataattgaaacagtgtcacagccaaggggtactctaggtacagcatatttatggagaaaggagagatgtttctcctgggggactggggggtgagagggaaggttcctggaagagatgacatttactgtgaatcaaagaagttgggaggcttgcgacaggtggaaagtagggaggcatccggctggaagaggaggatgtggagaatccagggcttcacaagtgcctggattcaaaacacctgacctgtgggctgggccatagcgctgactatccatttattctttatattaactgatttttgcatagctgcctgcaacctcacagtcagtttgacacctttgctgaaatctaggagaaacagtccaatactatttcctcattcttctctatttagataaattttccattacgaatacaactaactgagcctgacttgttgaaatacattctcctgaaaaccatgataaaaggtaaaaattacaatttcattattctccttttcaaaaagtcttgctttaaaatgtcatcagttaattctggtcatgtcgctctcctattccaaaaccttcaataactcccagtcaccggcggaatcgagttatagctctctctggtctggcgttggaggccccactggcctgctggccttatttccttctgttcctctctgggaactctgtagcagacggactcgccatcttttgtcccctagtcacccatgtgcgacccctccatgcctttgaccacacatgtttttaggcctgtgttccttccacacatatgtacagagccactaccacacaccaggcgccatgacaagtgcaggtgacatggcaatgtacaatacagactcagggttgaccatagggagcctccaggccagcaggggagagagagattaaacaagtgatgtcatgggatcctgatctgcatgctggtcatgggcggtgtattccagtttgtacttgatagtcctgaaacattctaggaaggaagtccccagggtgtgagaaggaagtagcagatctgggagggctccactgaggaggtgacatttaagttgggcactgaaggatgaatgggtgttcatgaggtggaaaggtgcctgggctgtcaacaaagacaccttccacctcagccaaatcaagatccctccacagactgccgcccagctggctctgaactgacgcgtttgtggtactttctgtttcctgcattaacttcattttccgaactgggccattcgctctgagggctgggacaggttcttagaagagttaccctgcacacagtagggatgcatcactgcctcactcgggccccttcctgcccactgccagcacagctctgaagtcttcgatagagctcagaatgaagcgggccatcctggacacgggccacactttgtaactcccatggggcatgcacatgcctcttttccctcccttctttcctggtgcccttggagaggctcagagaaactaccaaggccagccacaaccctgcatttctacttgcaggtgtgtacacaataaaatgaacacagatgttccctaaagaacacacagtaggctgggcatggtggctcacacccataatcccagcactttgggaggctgaggtgggaggatcacttgaagtctggagttcgagataagcctgggcaacatagcaagaccctgtctctgcaaaaagaatttagctgtgcatgatggcatgcacccgtagtcccagctactgtggaggctgaggtgggaggattgcttgagcctgggagatcaaggctgcagtgagctgtgattgtgccactgcattctagcctgggccacagagcatgaccctgtctcgaaagacagaaagaagaaagaacacatagcagactggtaggctggtcatagcagcactattcacaacagctcccaactgtccaccaatgaaggatggatacattgtgggccccccataccatgaaatattactcagccataaaaagaaacaaactactgacgcatgccataacacagatgatgctcacacacttatgcttgtgagcaaacgagcacatgctgtacaattccatttctataaagttctagaacaggcaaaatcaatgtatgctcctagaagtcaggtcagtggtcaccctggcccaggggcagtgactagagggagcacaaagggtctttagggtggtgctgatgttttgtttcttgatctggacatgggtcacaggaggtggggtcagtttgtgaacttggctgagctgtgaaactgagtgatgcgtgctcttttctgaatgtgcattatgcttcagtagaagtttcaaaaggggaaacagcaagccaggtcagcttccatggctaagcagcctggagctcgctgtagtcgattactgcaacccactggacaccaggcacctgtgctgggcagtgtgtatgtgttatcttatttaatccaccaaataacaaggttgatattcatttgccattgtgcacatgaagactaggggcttctgggagaagattaagtgactcacccagtcacccaagagtggagaaactggcactcagagagcaggtgacacgtccacaatcatggagctagaagctgctggctgtgctggaccaagatgtgtgggtctccagggtgtgtggtgggccctgctaaggtgagaccactgagccaggccacgtggtgctgcgcttcaccgacctccagcagagcaggaggaatccaccagtgcgagtcagatgcagccagagatttcccttgggccaagacctgggaatgggctaggactgctgtgaggccctgccttgggatggaccccagggcttctccatacaagccttggaaggaggctggccttggaagcctgaagggatgaaactctagctggctctccggcaggtgaggagaggtaaggaccctccacaggctgtgggggtgtgagactaacttacgttcactcggtccaaggaagccatgcagggaaacgggcaggttaccaagagaaagaggcaggcagcaccttctgcctaggcctgcagtcccttcatgacagagcccacagctccggtgtggatgatggcccaaggctctggggcccgggatgctgcatggggacctttctggggctgaatctagtgtgtggggtcatgtccaggtgtggaggggagtgggcagctgcggacacgctctgtttgcactcaggcccttgctcggtgtgacctcaggcaggtgacttgactctccaagccttggtttcctcatctctaaaatgaggaaacaacagcagggacttgtttttgaaggttgcagtgaggcctaaatgcagcgatagctgaagaggcctggactggtgctgggcacagagcaccgcccgaaccatagttatggatagtgatggtactacgaaaactaagtaataactcagtcatcagtccacacgcatttattgagcccctactatgctccaaggcccggtccaggtgcagggactgcagtggtgagataagcacacctgggtctgtccatgtggagccgatggtgctggtgctgctgcggcctcagcttgtccctaccctgactgttgctttctttttcctttctctttccccaccccttcccttgagaaataacagcattaagattggagagactagggctctctttcttactaattctgtgacttcagacaaattactggctaggcgcagtggctcatgcctataatcccagcactttgggaggccaaggcaggtggatcacctgaggtcaggagttcaagaccagtctgaccaacatggtgaaacctggtctctactaaaaatacaaaaattagctgggtgtggtggcacatgcctgtaatcctagctacttgggaggctgagacaggagaatcatttgaacccaggaggtggagcttgcagtgagctgagatcatgccactgcactccagcctgggccacagagtgagataatctcgggaaaaaaaaaaaaaaaaaaaaaaaaaaaaacacacaacacacacacacacacaaacaaattacttaagctctctaaagccgagcctcagtttccctgtgtgctgaggaactgagttctgtgtctgggggtacccagcacacagaaggcccccaacaattgctgttcctgctcccctgcctacctccctctcctctcttcttcctccccactttccccgtttcctttcttttccattctttttctctgcccaagccttcggcatcttaacacccaaagtgattgtcaaagtttagttgatggtgcccaggctgtggcagagactgtgaaccagttttcttgatattatgccctgaatcaacattctcccttatctttttcaaccacagagggtagaaacatgaaattctttctttcccagcctcccttacaactgggaaccacgtgacccttttgcagcaatgagacatcaacacaatgcctcgaatgtggacaaggttggagcaatagcaggcaacttgcaaccatgaggaaaagcctcaataacatcacagagacaccaacccaacattgcaaatggcaccagcggcggctcctccattcttcttgttttaggagtaaaataacttcatgttttgctatagtcaactgggtttgggggcctgtagtcaaaagcattcctggcttattcacatggctcctgtccgcgggtggactagatggcaaggatcccccactcccatgtggccttttctctttcaagaggacacaggagcctcttgactctttgaagaggacacaggggtgctacgctacgtccaggcacctgctgtgcgtactgtggtgcctggggagcagacaagcatttagttccctcacttgtggactctgaaggagggaaaactgtcacggctgcagcacaagtgtgcctgggcacttcctcagccacaggagtatcccagttaaagaacatcttctgtttctatcttatctcttgaggtatttagagccattctaaatgccagagccttagaatgaccatggggctggcagggcatgggctctgtgactcatatctgtcgaggaggctgcttgtggttgtgctggatcgagcccctctccttgactatcttcggcaccgcaagccaaagctcagggctgcccgggcctattcctgaggtggtgcaggagaggcagatgggctgctggggacgaaaggggtaggtaggcgggctctgggctccgtgcccagcattgccagcaacatgcctgtctgctgctgacccctgacccactcaacttcctccccagaagacagtcccttgaagaaaggggttcctccatcaaaatgtaaaatttgaaagccacagatgtctgacccaaacctgctgatctagtaacagggaagctgcagcatgaagaagttagatggctggggcgcagtggctcacgtcccagcactttggggaggctgaggtgggggaatgcttaagcccaggagttcaagaccagcctgggcaacatggcgagaccccatccctacaaaaaatacaaacattagctgggcgcggtgttgagcacctgtggtcccagctactcaggaggctgaggtgggagaattgcttgagctcaggaggtcaaggctgcagtgagctgtgatcatatcactgcaccccaataaaagaagttagatgactcgtggggcagaggcacacctagaaccagagtcgctggactccctctcaggtgctcatctccactttcgacctgagacaggcccaggtccctgccctgcttccctctggcagagaaagatcaccactaggcttcacatcacaacacatgtgcacccggctggcaggccctgggagagctgcctttgaagacggctcccaggcatagctcccccttactcctctatctgagccccactgctgttcctaccccagggtctttgcatgtgctgtctcctgtgcctggaaagccctcccacttcatctctgcagggctggccacttctcaccattcaggccttggctcggatgctgcctcttcagagaggccttcttgccctgaggcacagtctgtcatcttactctattttaattatctaccccaaatttcctccttttgcatatttttttatattgccttgtttatcatctccaggcctgtgagctcctagggatgggtaccttatctgtctcattcactgtggtatcttccgtgcttggaatgacctccagcatgtagtaggaacctcggaaatgatttttgagtgaaggaaggaagaaatttctttctttcttttttttttttgagagagtttcactcttgttgcccaagctggagtacagtggcatgatctcagctcactgcaacctctgcctcccaggttcaagtgattcttctgcctcagcctcccgagtagctggaactacaggtgcctgccaccacagctggctaattttttgtatttttagtagagacagggtttcatcatgttggccgggctggtctcgaactgacctcaggtgatccacccgcctcagcctcccaaaaagtgctgggattacaggcatgaaccaccacacctggcctaggaaatttctttaaaactacataatgctgtgttgcagggaggacaagggtctggtcggccgtgagcagcagctgtgctgtgtgcctctcagtctgaataggggtcggggagctacccgcctgccgggatccacacccagtcaccccgagcaaaacaaagcagacagcacaaattcacaaagcaatactgtgccctcctaccctcaaaaaaaaaaaaaaaaaaaaagcccgataatgaggtaaacacaatcatgaccaggaaaaagcttggccatgcttcttccagtccacccaaagccattatctctaattgatctccagacatcagctgctgaagcgtctgaaaccctcctgcaccctccaggtctggttacaaagccctggcccacccacccgccccatggagtcaggtctcctggagctgctctttgctgggggtgacagggcctatctgggccccacatgaaaaggacccatcaggctgacaagagtcagggtgggtcaagaacctgtgtaaaagtcacaaccactaaatgctcagctgccagggggctgagctgcctgagtttcagtgccttaagtagaaggcttgacaaagccatcaggggtcccgcattcaaaataaaaagcaaggaaaaccagggacggctgcagaaaagcaccctgcccaaaatatcccactagttctgggtgaaagaggcacccaaaagctggagtgaggagtttagttgcaaaacggaacgggacttagccacaagatcacgaatcccttctgggtcttggttaggctgtggcggtcacaagggcagccatcagtacagggaccatctggatgttttgagctgctccttcctggcccagcccaggaaagacgtctcctttcctgttaggtctctcttgtccttagaaacagaccggagtcagctccctgggctgcctggcaggggtgttttactgccagagctctgacaggacagagccacttccccccttcattcatggacgcccaggtagcagctcctgacctgtgcaagcttttcccttgacacacacaaagcgtcccgaggccagccctgcatgcagtattgctgcttatggcaccaggcagctctcctgcttgcaccagtaaattacgagtgcttcctgcattttttcccccagataataaagttgaaaggccaccttggcattctcgcatttgtaggggtggaggtctgcagcccggaaggggctcgagcctcaaggagctgctggggacaatgagctgttcaggttcggggtatctgccaaccccaccagacactggctctccagacagggtggtggctgttttccactttcccacacagcttcagggaagtgagaggaaagaaaagacacagacctctcccagctcaggttgccctcacaaaacagaggaaatgctcattttctgtgagaatttggaaattgtagtaagtttctagaaagcaccccaggatgttcaagaacatatactgattgcaaaaataatgtcccataacaaaagatgtttgacaatgagcttttcacgcctctctctgttctcttaaaaaaaaaaaaagctttctgataaatcattccctctcaagtttagaaatgccctattttcacagggcatggtggctcatgcctgtcattccagcactttaggaggccaaagtgggaggatcgcttgagcccaggagttcaagaccagcctgggcaacacgtgaagccccatctctataaaaagtgcaaaaaattagccaggtgtggtggtgtgtgcctgtagttccagctactcgggaggctgaggtgggaggatcactagagcctgggaagtcgaggctgcattgagctgtgattgcaccactgcactctaccctgggcaacgggagtgagaccctgtctcaataaaaaaaaaaaaaaaaaaaaagaaatgcactattttctttgggaggcccagaagttcaagatcagcctgggcaacaaagtgaagcactgtttctacttaaaaaatttttgtgtttgtttgtttttgaggcagagtcttggtcttgctctgttgcctaggctggagtgcagtggtgcaatctcagctcactgcaacctctgcttcccaggttcaagtgattctcctgcctcaacctcctgagtacctgggattacaggctcctgccaccacgccagctaatttttgtatttttagtagagacggggcttcaccatgttggtcaggctggtctcaaactcctggccttgtgatctgcccaccttggcctcccaaagtgctgggattacaggcgtgagccactgctcctggccaaaaaaaatttttttttaaataaatgccctattttgcatgataccattttaggaggatggggaatgctgtgctgtccatgtttagagccccccgatcctgacactgggctcatggtgctcctggttctcagtccacctctgtttgtcagtgaacaaagaggcctgggataaagtgtcttcacataatgctcatgtggtcagatcagtggtgctgctgcagtatttttcctccaccaaaaagcggatacaaacatttttaggcattaaagaaacaatttttggctgggtgtggtggctcatgcctgtaatcccagcactttgggaggctgaggcaggcagatcacttgaggccaggagtttcagaccagcttggccaacatggtgaaaccccatctctactaaaaatgcaaaaattagccgggcatggtggcaggcatctgtagtcccagctactcagtcagctgaggcaggagaattgcttgaacctgggcagcggaggttgtagtgagccaagattttgcgactgcactctagcctgggcaacagagggagaccttgtctcaaaaaaaaaaaaaaaaaaaaaaggaacaattatttttttcaaagtaatgccttttttcaagccagcaaaacttttaaaaagaaagccaacaaaagaggaacaattcctactagatattaaaacatatgataaagttttcacacttaaaacagtttggtagctgctacatgaatagtcaaggagcccagtggaccaaacagaagtagattctgttttggatggaaacttagtaagttttaaaggtgtcatctcaaatcagtgggggaaaatggagtatttaacaaatgatgctgagacaaaagggttaagcggaatctgtatctcagaatacgtcagcataagctccaaatggatcaaagattaaatataaaaaatgaaaataaaaacatgtatgctttttgctctgtcagctggaagagcctgcaagaaaggatacttcagtaccaatgggcacacatagtgcccagatcttgtttttttgttttgttttatacaaaatatatagagatgaggtttgcccaggctggtcttgaactcctgaactcaagagacccttctgccttggcctcccaaagtgttgggataatgggtgtaagccaccatgcccagccagatttttttttttttttttttgagacggagtcttgctttcttgcccaggctggagtgcagtggcacaatctcggctcattgcaagctccgcctcccgggttcatgccattcttctgcctcagcctcccaagtagctgggagtacaggcgcctgccaccacgcccagctaatttttttgtatttctttcttttttttttttttttttactagagacatggtttcatcgtgttagccaggatggtctcgatccgatattttggtttttaatatggttttccaataaaaggaatcagagctccttggagaaatcactgattccaggattggggcaggaaatatgcaagatgagcctggagtcttacagtgccagaaagcaaagaagcactaaaaaacaagaaacgaacaaacaaaaaccccaaacaccaatgaggtatggcaaaagagcacaggaaacaactgaaaaagctccaatggccaaagctagaacaatttgtacaacaaaatgaagaagtattgaatgatcatcaaagcataaaataaacagctatgagtctcgacttctataaatggctgaataaattaataagtgggggaggagaaacaaatctcctatgcataagcaatctaaataatttacgttgataattcaccctaaaaaaggcagaacatgactccccactcttcaggtgtgggctgcacacggtgccttccttcccaagtgcacagtgtggaaagagggaaaagtcacttgacaggagagaaacctgacaaccaatatctcaaccaggtgtgatcaaggccaatggcaacagtcctaaatcatgttgatattatggacccttaacaggatgtgatgaaaatgacactccatgtctgtggtcttcctcctaataacccataaccccggttttatatagagaaaaatgtcaaatttctaaatcctacaaaatacacaactagtactcttcgaaactgtcaaggttatcaaaaacaaggaaagtctgagaaactgtcaaagcccaaagaagactaaagggacatgacaattaaatggaattaaatgttacaatgaaaattaaatgttgtatcctggatgaaatcttggaacagaaaaggaaattaggtaaaagctaaaggaatctaaataaactgtagactttacttacaataatgtatcagtgtggttcattagtggtaacaaatgtatcaccttaatataagacattgataatacgggaaactgtgtgtcgaggagtgggcaatgtggatactctgtactatcttcccaatttttctgtaaagttaaaactgttctcaaaaatagtctatcaaaaaaaaaatgaaaacataaaaatactaaaagaaaacatgggggatggagtggagttagcctttttaagactcaaatgcagaagcgatttgaagaaaaaattgatacatctgagtacataaaaataaaaatgacaacacacacagcataggcaatatcaaaagagagagagctacggatggggaaaaggaggcaatgactaactctggggaatccgaagaaaggaaatgtaaggaaatgtaatcatagcatatgttaattgggtcagctatgagtaatatgcacacagtcataataatataaacaatgaatagcaatttatctaaatagagaggtatagatatgttgcaggatggaggaaggagaaataataagtgtatttatgagagggtgtaagagtgcaaatacttatttcctacagcaagaaattaacaacaacaaaagccccaattgaaaaatcaagaacttatagtataagcaggttattccaaaataggagttaaataccagaagagacagctaaaacataagaaagaaaagaggctgtccctagggagtagaaattgaagtggggaggctggggcagggtctgctatttttctatatgattttaaaaaatgtattctagaggccgggtgtggtggctcatgcctgtaatcccagcactttgggaggccgaggcaggcggatcacctgaggtcaggagttcaagatcagcctggccaacagggtgaaaccccgtctctactgaaagtacaaaaattagctgggtttggtggcaggcgcctgtaattccagttactcaggaggctgaggcaagagaaatgcctgaatccgggaggcggaggctgcagtgaggatcacgccactacactccagcctaggtgacggtgagactccatctcaaaaaaaaaaagtattctatctataaaaataaaaataatgcaggccgggtgtggtggctcacccctgtaatcccagcactttgggaagccgaggcgggtggatcacctgaggtcaggagttcgagaccagcctggccaacatggtgaaaccccgtctctactaaaaatacaaaaattagccgggagtggtggccggggcctgtaatcccagctactcgggaggctgaggcaggagaatctcttgaacttgagagcagaggttgcaacgagccgagatcacatcattgcactccagcctgggcagcaagagcaaaactccatctcaaaataaaaaataaacataaaaaataaataaatgcaaagaaatcaaaacaagttaaaaaagggtaaagggccacccagaagtgatttctgtaggtgagctgccctgggattgcggtggaaggtctgggggcacaaggtagaagctcacagcggcttctccaactgtatgtcctctcacagcagaaatgctccaaggattgtcctctgcctagagaaatcccaacagcagccttggtcaaggacagtatttcagctgcttttgttttcttgctgcagcataaaccttccacagggccagaaatttactgagacaggatgaaggtttgggctatagattctcagatactgaaaatgtggtcgatggcatttcaggcctttcccgtgctctcatggtggcaggttaggcccctgcagctcagctacacaacaagaggaggtaatagatggagcaaaggaaagaagccagaagcggacaagcaaggctgggagtagtgaagacagttggtgggatgggtagaagctcgggaggctgggaactgagagggaagtggtggcctcagtgggagagccccatggggagagaatgaggcagactaaaatctaggcagccaaagcagcagaccccatatcctcacaaatgccacagggtctaccccacttattggtccatgcacattttcaggagcagacacagatgctcaaagtttgaacagtctagagaaatggctattccaagacagtagcaaaatctgcaaatggtgaaaagagagtggagacggcaaagatatgctgagagctagaaagattctgcctcttacagcaaagcttaacagccctcctcacctccccaatggcagacctccaaggtctggagtgtcactgggaaactgtctttgatcatcataaaatatcacactttgccctacttaatgctttttttttgccttgaacatttatttaacattaatagcactactccctcttttttaattttcctttttgtgtcattttgataaatgtcttttgtaaatacccaatgccatttaagaaggcccatctgagctttttatgatactgtgtaatgaaatttaacccattcacattttttatatttagtagtttggtgttgtttgtattatgttactttatgtaatttattatatacatttatcatattcctttatatttattttatatgtatacataaatctcttttttgtggtttcttcgtttagtccccatgtaatcactcttgctggactgattaagttttctgtgtttcttttattcactctactggtttagaagttctacattctatttctagtccatggagattactctttaactttaaagaaacatctcagaggccgggcgtggtggctcacgcctgtaatcccagcactttgggaggctgaggtgggtagatcacgaggtcagtagatcgagaccatcctggctaacacagtgaaaccctgtctctaataaaaatacaaaaaattagccaggtgtcatggcgggcgcctgtagtcccagctactcgggaggctgaggcaggagaatggtgtgtacccaggagatggagcttgcagtgagccaagatcgtgccactgcactccagcctgggtgacagagtgagactccatcaaaaaaaaaaaaagaaagaaagaaagaaaaaaacatctcaaaacctctgcagctgcttttttttttttgactgagtcttgctctgtcgccaggctggagtgaagtggcatgatctctgctcactgcaacctctgcctcccaggttcaagtgattctcctgcctcagcctctgagtagctgggactacaagcacgtgccaccatgcccagctaatttttgtatttttagaaatggagtttcctcatgttggccaggatggtctcgatctcttgaccttgtgatacactcgcttcagcctcccaaagtgctgggattacaggcgtgagccactgcaccggccacctctgcttctttaagagaccatcaaaggtcacacacattgagccacagcaggagacaaggccatgtttccattctgctattactcctctgaactcccagttcacctgggctgcagggcagcctgaggaaggaaagaagggaatcatcactgctatcaggctcctaaacatggagcctaagtcagttagacttaaacaggttgtctaagtcagtactcttgggttctccatggtaagaaccccatgagtcagcactgtttgagtaagtgacagtctctcacagtaacccattaacactccttctcctttgtgtctgcccatattttgggggtctttctgggcaggggggagattgagagggttcataagaaagagaaaagataatgattaaaaagtaaatgtagttagccaaaaaagtggaaacaacccaaatgtccatgaacagataaatgcagtaaacaaaatgtggttaatacaaatacaataaacaaaatgtatggttaatacaatgaaatattattgtcataaaaaggaataaagttggtcaggcgcaatagcacacatgcctgtaatcccagcactttgggaggctgagatgggcagatcgcttgagttccagaccagcccagacaacatggcgaaaccacatctctacaaaaaaaaatacaaaaattagctagatgtggtggtgctcacctgtggtctcagatactcaggaggctgaggtgggcagattgagcccgggagggcaaggctgcagtgaactgtgatcgtgtcactgcactccagcctgggtgacagagtgagaccctgtctcaaaaaactaacaaaaaggaataaagttctgacacatgctaccacatggatgaaccttgaagacatgatgcacaaaaggacaaaaggacatctgattccactgacatgaggtgcctaaaagagccaactgcacagagagaaagcagaatagaggttaccagggctgggggaggggaggaaggggaattattgcttaatgggtacagagtttctgtttcgggtgatgaaaaaattttggaaatagatagttggtgatggttgtgcaacattgtgaatatactcaatgccactcaattatatacttaaacgtggttaaaatggcacattttaggttttatatatttatcacagttttcttaaaaaaatgaatgtggagagtttttcagggtgggcttgtttccttctccatttagggggatggaagcctgagaaagttcctgctggaaatctgaaccttgatccctagtgctgactgaggaagcgctctctcctgggcctggcttccaaggagggggcttcctcggagtcctggcctccttctcctctgttccccaaactggctccagcctcccctggccccaggtcctgctccagctgttacctctcagcttccctcacccaggccctctctgcttgcccaagccaggcattttaaaaataagccaggcccggcacggtggctcacacttgtaatcccagcactttgggaggccgaggagggcggatcacctgaggtcaggagttcaagaccagcctgaccaacatggagaaaccccatctctactaaaaatacaaaattagccgggcgtggtggtgcgtgcctgtaatctcagctattcaggaggctgaggcaggagcaccgcttgaacccaggaggcagaggttgcagtgagccgagatcgcgccattgcactccagcctgggcaacaagagcaaaactccatctccaaataaataaataaataagccagtgcctctgaacttcctggcactagccccttctgttttctgtcccaggtgacagctctgtggctgctgttttgtcccctctactaagaagagctcactgtctgtgaaggggtctgctcctcctcacctgccctccaggacccaaggaaaattctgggccaggacagaacagtagaggagagggaggcagaggttaatgggggcaagctagaacctccatcacgtgggctcagacaatggagctgcaccacttcacacactgctgtgaggaccattaaaaccattagcgggacattagctctgctccaggaactgcagagagggaggcaagggaggtgcccacagtcctccagaggtgagccctgagcctctctgggcctcggcttcctctgggtgggagaaggagcacagttgtctctctgcttccacagctaatttctacaaggggcctgaaatcttccttccctgccccttccaagaagatggctcagtcctctgtgcaactaaatacaatttccattttatatctttttaagagtattcccaaataaaaaaactctttgatcagaccacactccactattttctgctcagtgtggccactttgatgacagctcttggggtctgtgtcttaggctggaggtgccgagagggtggagtctaacccccatagcggtgccttgtacattgaggacactataaatattgggtgcactgaaccagacttcaagaagaatctttcttctttctgtgaatcttgttattgaattttcatattatctaataccctctgcagagaaggactcattttctagcatattaatctgatacaactggcctacaagtaacatgattctgtccagccctcaagaaaatcccaccacctgcattttgatcaaagcaaagtgagggaaaatgttctccttatcttaccatttgtctcttggatacgtgatgttggaaataaacagattattgagattttttcttacccaaagttttcagatatagagctttgttcagcattaataaaatatttatcctggccgggcacagtggctcatgcctgtaatcccagcactttgggaggctaaggcaggtggatcatgaggtcaggagttcgagatcagcctggccaacagagtgaaccatgtctctactaaaaatacaaaaaaaaagtagccaggcctagtggcggcctcctgtaatcccagctactcgggaggtagaggcaggagaaatgctcgaacctgggaagtggaggttgcagtgagccgagatcgcaccactgcattccagccagggtgacggtgtgagactacatctcaaaataaataaataaaataaaataaaacaaaatatttatcctggttaccggttactttagaattggatttattttccatgtaacctgcattagaaatttgcaaacactacagatgtcctcttttggcattttgtggtcagagtgatgaaatgaaaccactctcaaagccttgtcttgggacatcggatttgacagcagccgaacctgtcctgcggctgtgtttggatggtggggagtcattcgcccaccctggcctgcctttgctgcacaggaaataagctagtaattcaagtatatgtatttttagttctaactcaagctgaagaatcaaagactgctgggtccttggcccttccttgatgctgcagataaataatctggtgagccatgtgatttcatcttgcgccacgtgcccagccataaaacagggataacggcactgcctaagaggctgaggccttgagagctcattgctttgcatggagtgctgaagactgacagatgaagggctctaggcatgaggcgggaggctgcttcacctgccaggtggtgaaaggcaggcctgaacttccatctcctgccgcactcagaagaagctggctacattcagaggcccccacctggaaactactaatgaagctgaggaagtcacatccagccccactgtaagcagaggccacctcgatcttggccctgccccagctggactcccagaacaccctggagacaaatgccctccacagtcctttcttcctttgggagctaccagagcctcaccagggcaattcctgcatctcaggtcatgaacttcggttcatcccctgatactcatcaggtgcttatgcacacaacactgtgctttcccccttttgcttcggcaacagaactcctcacattctctgctgcagccacaccagcccctcaaatctcttgaaggcttggtcctcccttgagccacaaggcctttgcataagctgttcccttggcctggaactctcttcccctcagattccactctcagctgaagctccctttctgaggcacagcttccctgacccctgcctcagtccaccctccaagcccaccctaagtacccccagtgccacgtgtccttctgcaccatggcaatgccccactgatcacttcctccattgtttatcactgcctgctgtgagctgggcatttgtgtgggatcctctggctggtgtctgtctcccctagatcagaagaaaatacagggatgccagccggaatctcagcactttgggaggcctaggcaggcagattgcttgagcccaggagttcgagaccagcctggccaacatgaggaaaccctgtctctacaaaaaatacaaaaaattagcaggtgtggtggcaggtgcctgtaaccccagctactcgggaggctgaggcaggagaatcacttgaacccaggaggcagaagctacagtgagccgagattgggccactgcactccagcctgggtggcagagtgagactctgcctcaaaaaaaaaaaaaaaaaaaaaaagaaaagaaagaaaatctaggggtactgctgtttctgtaaatcctcagagcctggctcacagaacagagctccataaatatttgtggaatgactgaatcctcgttaaagcacctaacccatagtcttaactcccctccttccattgacgcaagtgaagatacagttaggatttttaaccagatcaaatatctgatttgttagtgagagatcgcaacttgcacgacactgaccactactggttctagtggtgacctggatttagtgccattctgtatgaaacaaaaccagggggctgtgcttccggctgtttgtgcggttttgtgcttcattcttcatgggcacagatgagcacggtgataacagtgtttacgaagccaggtgccggagacagtgaggatggctacaggaaagaaaggccacagattgctcttcagtggcagtgagaggagacctaatgcagaggctgcacagtggtgctgggattctataaccaacaacaaaagcaacaccctcattaccgacactcctgcagctcaaactactttgcctttgtgcgttggaaacccaacccaagcccattttccccactggaattatttgtgatgatgtgaagtttttggagatgcaaccatcccagaacaggcacgctcagatgagaagacgtgggagacacagttctagcaaacagttctaccgctcagagcaaagcctacgtcacacagcctctagggtctgggcacagtgtggggacaggagggctggccgccctgcctcttgaaaggaatacgcagctctgcaggttcaagccacccagctgaagtcctcaaactgggtaacacgggccaagatgccacctgcacgtgtcctgctacatcaccatggatctggccaaggagccaccaccccctcggagcacgcatgctggggttgtcaaggagaccagtgcacaggacggccgcacccagggctggagaccggcagcgcaggacagctgcatccagggctggaagacagactcgagttctgacccatctttcaatgggagagaaagaatccaatcccctgctagggccacaaggacatgatgggtttggatgccataagagatgagaacactccaagctgaaggcaagaagtgattaccctggttttaggcagtggttggggggtggaggtggaggggaactcacctagtccttctttgaaagacagtcaggctacgtgctttgcaaagggttaggaggtggactgtgtgggaaggcaggcgagagggagtttcttttcatagcctgtttccatggtgtctcacggcccttggcaaaccccagctggggaggcttggacggccaggaggccccaggtccaccctccaaggactatcccctagtcctctgggccccaagagtgacagaggccacaggcaggcggctactctctcttgcctccctgggggaaggtggcaagaggccagcgataaagggcagagcagagaaagaacaactccaggggccagggctgcggctccctcccttccacgtcccctcctccccctcctcccacgagcccacccaaggggaaagttttctccctgaagacctgcagggctgtctgcacaggagaccctctcacgagaaacacattcttgcctcccgcctctccgcctggacaacccagataaccagataagggcctctttgatttcccgtgtgtttacacaagctgtggccccaagtcttggaaagaatcaaccaccgccaggcaagtcaggacgcctccaggtggggtgaggggagacggccgccttacctgctcctgggaattcatcactcgaagcttcatctgcttcaggtaggtggaggtgaggggcatgttgtaatcaataatcccagagaccagtggagatggaggctcgttttctggcagaaagaacaaaaggaaagccctttcagtctgtgctgcgggcctgttgcccacatggagcatttaacagagcccgtggaagaggaagccaccttggaggagaagggacaggtcagaggtcgcagactctgtggctcacccacatctggcccagagatgtggactgcatggtgtcaaaaatattttttttttattaaatgccagtgttctatttagagatttcacacgttaaaaaacaatgaggccgggcgtgctggctcatgcctgtaattccagcactttgggaggccaaggcaggaggatcccttgagccccaggaggggacacaggccccaggagttcgagaccagcctgggcaacacagggagatctcgtctttacaaataataaaataaattagccagacgtggtggtgtgtgcctgtagtcctagctacataggaggctgaagtgggaggatcgcttgaggccaggtggtcaaggctgcagtctgcagtgagctgtgatggcaccactgcactccagcctcagcaacagagtgagaatctatctctaaaaaacaaacaaaaaaacccagcaaacccacccccacaacacacacacacgtttataggaatttttggcttctttgaagaacataaggtctggccacatggggcccccactcccgaaggcaagcaaccactgccacttcagcagccacttcttttagacagggtgtgtggctcccattttgccacagtccccaccactccttatcatattgcacagctttgctcatttgcaagtatcaattatgatacttgccagacccttgaaggcatctgtgtttccaaccactgtctaagtcagttatcttccaggtgaacacatgccactctcacctcacccaatcccgccaccccatagcatcccccaaaaacatcctcaggtgccttatgcctcccaggtctgagccaggccttcagtagcccccaaattctggttcctccttcatcatatgcagaggaacattctcctcccatttattcctttgttgtcctgaagatcaaagtgatgcatgttctttttgcagagaatttgcaaagtacagaaagatgtaaagaaaaaatttaaaaaccataattgcaccacgcagcttggcatatgcttctgtttattttttccctgtgatttttcttttttacacatgatctcataatgcatacagagaattccagtctgcttttaaaaagtttttttttccttaacattttgtcataggtattttccccaacatcaagaatcttattttgctttgtaagtagaatttttatggccatgtaatattttaccataatttgcttaagtcattctctaacgattggctatttaggttgttcccattggggctattataaacaacactgcaggggacatctttgtgcataaatattgctccgtatttctgatcttatttcttgcctttttggaacagattacaagaaattaaaaggtagggacataatttgataaccattaaaatctctgaccaagctgctgtaggaattgtttcaattacttgttacctggcctcctcctccttcttccaaggacttcaggccagattcattttgccccagccttttaatcaaaaggtgcccctggtacatagtcccactgatgggctgggatttccatagcgtgaggaaaagtgggagcaacttccagaccaagtgccctctaccatcacaaggaggcccaagagacaggctgcagggtgacagggccgaggtccaggaggaccagaggatatccgggggtgacttataatacctgcccctcaagagccatagcccaaaagggtccctgcaaccttgaaaacgcgataccaagggcaagaagccagacataaaacgacaaccactgtatgattctacttacacgaaatacttagaataggcaaattcaaagagacagaaagtaactcgaggttactggggactggtggctgagggaatgggacgttattgcttaatgggtacagagtttctgtttagggtgatgaaaaagttttggaaatagatagtggtgatgattgctcaacagtgtgaatataatatctttaaaatggaacgattaagccgggcacggtggctcacgcatgtaatcccagcactttgggaggcagaggcaggaggactgcttgaccccaggagttcaaggccagcctgggaaacatagtgagtccctcgtctctactaaaaggtaaaaatgttagctgggtgtggtggcacgtgcctgaagtcccagctactcgggaggctgaggtgggaggatcacctgagcccaggacgttgaggcagcactgcgatccagcctgggtgacagagactgtgtctcaacaacaacaacagaaacaaacaaacaaaattattaaaaaggcaagtttttgtgctgtaaatgttttaccataatttaaaaaggaaaaaaagtctgccaacaagcggtgaagttacccaaagaggacaagggaagttcctgcttggcaaggataggaacagccctgcagaaaaggtggggacccggaatagctggggcctagaggatgggggtcctctttgacgctgtgtacttctggtgactttatagatcaaataacattttgaataaagttttacaggaatgcagaacttagttttgctctttaaagctaccctgtcacatatagaatgtttcattctttgttctttgaggaagaagtagacgtcggctgggtgtggtggctcacacctgtaatcccagcacttagggaggctgaggcaggcggatcacccgaggtcaggagttgggagaccagcctgaccaacatgacaaacccccactctcctaaaaattcaagaattagctgggcatggtggcgcatgcctgtaatcccagctacttcagaggctgaggcaggagaatcactggaacccgggaggtggaggttgcagtgagccaaggtcatgtcattgcactccagcctggtgacagagcaagactccgtcccaaggaaaaaaaaaaagtaaatgtcactaatggaatggctaagaaactggcctgaaaggaaccaccccctcctcctcctttttttaagagagacttctgcttggttgggtggcagggatcctctgcaccgataccaaactcaaatgggtttccaccccaccgtcaacctagatttgactttcttaacctcagtggggttttaaaccctagccccatacattgaccgggtcggatgccacatgtcaggcaggcagtctagtgatgacactgagatggtatcgctcagaagagccgtgggtcctgttttcagaggtggatgtttggactgagaattctgccatttctgtttcctctaagaggaggctgtctggtgagaagctgttaagcaccatggtgagtgtgacatcatggtgagtgtgaagggcgcccagcactctcgcggccccggtcggcccttcgttgggtgttgcagggattgtctaggtttgggaggcacggaggcggggagctgtgttcttctactgatggtcgcccctgtcctgactgcagtgtcatgactgttcatgagaaagtatctttaataaagctagtgacagtgtggcttaggaaaaataaaacagtggccaggacagcacccttgggaggcgtgagaagaggtcttccttggcctgttcccaccccagtgtctccagagatgagaaaccacttcccgtgcctgcaggtaagccaagagagctcagaagaggaaggcaggatgtcctggtcttggggaagctggaacatcccgagcagacccctaaacccatcggagaacaccttacattgctgtaaggtgaaatgcttgattttgcagttccagaatgagagttctgtgggggagggaggacctccgcagggaggggacattctaggtgaggaaatgagccatggagccatgggtgggaggtcagagctcaaccacaccagggtgaggagaaaagcaggcaagcttttcagcagtgaggagccccaggtgttctggattcaataagtgggtgcacactgagaggatgggcttagtgggaaagagacggagcaggggccagtggaagccgcagagtcagatgctcaccagtgagaaaaacgccaggatgggggacaaggtcaggtggaaacgtgaacaaggaagaagtgggttccttggactctgagacacgccgcccccctccctgcccatggtcaacatgtggtgccacactcgagcctctacaaatgacctgatagtgcggcaccgctggactctgttgccatggagaagggtgagctaggagctagcaagggtcacggagcctaaatcatccagcaggttgctggcaagagaagcacaacaagagcccagagagatctttcaacatctctttgccaagaaaaatggaaaccagcccaggcactagacctagttttatgcagtctcgagaataatcaatgatgtgggtgcttgggccaagccaggttgtttgctggcctgtgcagctgggcgccaatggcactcatcaaccaatgcaaacctcaaccatgggagtgaccctcatttcctcgtgggaacaccaggtggtgatgctcacaagctttcacctacagcacgaagaactctcagtccagagacaggtatgaaagatcttccaggcaggggtgggcgtcgaaggatgtgtgcacgatgggggcctggcacagagaggccgtgagaccagccagcctcagggggttcaaatttggaaacagagatcccaggcctgagaccagctcaaaaggtggcaaaaaaaaaaaaatctccttcctggggaagtaaatcattgaattggcaagtcttcgaggagtgctgatgtgcatgctatccgggtggggaacgtgaggaaactgtgtgcggtgcagtccccaggctcaggaaacaagggtgaaggatgagcagggtgcgacagacgtgaggccattagggtcactggaggaagagctgagagggccccggagtcgctcaaggaagcttcgtagagagaatcggaatgggactcacgaactattgctcagctgacagctccttagcacctgcttagggctccacacacacactctggttagaggctcccaggaaccttgtgaggtgggtgctcatagtaataccctgactttacagatgaggcaacagcacacagagaagctatgcaaccttcccacagtcccacagcaagcaagtgtgagagccgggagaggccaggctggcaaggagggatgtggaggggccaggcatggagggccttggaaaccacgcagaggagtctgggcctggttgtgaaggggtggagacccaagtggacaacctgcctactgaggaagagtcagcattgctgcccattggctactcccagtttgcaaccatgcaacaatattttgtcacatcaaagaaaacagagacatgcctccaaaggtccctttccccaagagctgggctggtctaaagtcacacccactttgcatgctgtgtcctcaattcctcagggactggtggaagaggagtgtggagtcaggaggtcctggaatttcccgtcctcagacttcctgatcctctgccacctcctttgtttatgctcctggcactgggggagggcacggggctgtccaggtcccccccactctgctggggagagaccgctgagcaaaggaggccactctacttcctttctttctttttaacataaggccaggaagccaggcattctcccagcagccctcaaggagcctccatcctgtcccctgtccccgctccctcccaccttcctggggcaggaacactgggtctgcctctggggctggtgcaggctctgctttcccagcagctggagagggagaagggagggctggcaatgcaggggtgcctgggagacagcaggctatagctgcatccagtggccagcatggcgggcagagataggatctgcaggctttcagcgggggcaggaggaggggaacctggggacggtccaggaggcgaatgcctctggccacttagcagacagtggagcctttcagactcaaaactctccactggcagcttccagaaaccaggcctttcccttctaaccctgtccagggtgtggacccagcatgcttgcctggcagggctgggggccacatctgaccctacctgggtagaggcagaccttgtgtctctgttgggccacctggacgttggcagccttgtgtctgggcaccgtaggccacgacacgggctggaggcaggaggcagggtgatgctccccaggcacccgctgcgtcccaggtgccctccacaataggctcaccctcaccaccctgaaaggatggcattccttccactttgctgatgagaaaatatggtttcctgcctgcacttctatctcctgggagagcttggatgtatgatttcacctcaacacctctctgtgcctcagtttccttacctgtaagccaggactaacacctcataggatctttgtaactgtcatgatcaggaactgctcagagaggttccctgtcctgccgagggacacacagtggggaacagggctgcacaccagacctgcctgactccaagtccatgcccttccatgagccacttccccgggctcctgctccctcagcgtcttctcctctccctgcgaggagaagctccgctacctgggacagagatggcattgtgtctgaggatgggggaggatgggtgagaatgggcatggtgctagtcttctgtccagcctgaagaaagccccaggaaagatgggcttcagcgctggtttatattctagatggctcctggcctgtgtgctccctcgctccctggcctctttctcctccctgggggtggggtgtggtggtggcagccagcgaggagaggaagcaggccactgctgtgctccgcgttgccctcctggccacacagaagcccacagatgaggagtgcagcctgcagcatggggagacctcgcagccatcagtgaggagtgcggagggagctgaggaatgccctccatactgccgtgggatgtgtggcaggagaggggagcggatggcgcctcagacaccccagagcagcccacaaatggagcccctcttggcttcgcctctgttcctccaggcaagcaattctgtgtctgactccgccagttgctatggaaacaatgaggaaaggaacgggaggggacaggcggatgggtgggcaggaaccaggcagtcaccactaggacacacacccctggcccctgcggcctaaaccctggcagggtggagagtggggcagggaaagccctccagcccatctgcaggtaccaaatgctgtcttggcccaggggttgcagctgctgcctggccaggggcagcccacgtgggtggcagcattcaggatcactggctcaggcatgcatcgagggagtgtccagcattataacaggaaccgcaacagccacagctctctcttcctgcaccaatgccaggtacagggactaacccatatcttgtcagccttctgattaaccccatttcacagatgagggaactgaggctcagaaagatgaagtcccttgcccaggacacacagcagctgaatggtagtgcagccctggagccctgttcttaacatgggaaccagcatttatgagggattaactagatccattcctgcccctcgtgctttgaagttggcccatgtgcccaatgaaacagccgtggcctgatggctcccaagggcatggaagcctctggatttggtgagtcagctgctgtcagaagccgttcacgtgtgtcagggacaatgaacacaagcagaaagccccgcttgacgcccatgctcccaatcctttgttgtctgctcaggctttgctgtggatttttccttccccagattcaatggatgctacttgagtgccacccggataaacggcgcgcccttcattcgagtctgtttccatcctcgggcctgacttcagcaacttccacaggcccgatgcccgggagctggcatgatgcaccaggcagtcctggaaaccctgataaatcgcccacctgggcaccatttctcagggcagcattataattgtaccagccaaatgtgctgggccgtctcaatgtgccaaagccacctgcaaacagatgggcccccagatttcctggaggcctctgggatgttcagtttgagggggtgcgggggtgctgaagtgaggtccttgctggtctcactgggcaggacagagctggagggcatggacgtcagtccaagggatcacctttggtggtcacaagtgctctgggcattttattttattgttttttgagatggggtctaactctgtcacccaggctggagtgcagtggcatgatcatggctcactgcagcttccacctcccgggctcaagcaatcctcccacctcagcctcccaaactgctgagattacaggcatgagccactgtgcccagcctgccctggtcattttaaattctcatcagtcggccgggtgcagattacacacctgtaatcccagcactttgggaggccaaggcgggtagatcatgaggtcaggagatcgagaccatcctggctaacatggtgaaaccccatctctactaaaaatacaaaaaaaattagccaggcgtggcggtgggcacctgaagtcccagctacccgggaggctgaggcagaagaatggcatgaacccgggaggcggagcttgcagtgagccgagatcgcaccactgcactccagcctgggcgacagagcgagactttgtctcaaaaaaaaaaaaaaaaattatcatcagtactccgtgggtttacttatcagaggccacatgggtgtgcacagggtggaaacaagcaccagggaagatgtatcattaacaggtatgtgggtgggaggatgcatgcacacgtctcagggagggtacaggccagaccctcgtgcatggagaagcagtgggaggcatggatggaactttgagaacggggcaggctggccattcccaactggaatccggctgggaggaaaggggctggccggggccttgcaaggcaggggaaacatgttgttcacttttttgttttgtatggttggtttttaagtgaaatttgagatttaaaaaaagttaaacgaaacaaaacaaggcgctttgggcagcaccacggacccatactggcctctgggactagcaacaacagctgctggacacttttctgtgccagcaaaagctggcgtcttcagggacagtccactcttagatggcccccgccctagccctccagcacgccacccctgctacctttgggttccaggccattggagttaaagtgcatcctcttctgacactccgtacagctcatcaggaaccgggtcacggcctctctcgggaggaaggcataggtctctgcgatctggaggagagaagagcttcgcttgttatatggatctgtggggaggcaacttggccatggggtcaccaaggtctgagctttggtggcaggtgcttcggctcttgcaaggaaagtcagggatttgaggagcaagggacaggtgtcctggattctcagctgtggcaatgagacagtacttttgtggaaaaccatttgttttaaaaatcgcaataaaggaggttaaaaattgaaaaagcaaaccctttaaacattatctagtctttaacctatattctaataagtaacattcctcagaacattttattgctgctacaaaaaaatgggcttacaaacattgctctagcgtagggtgagcagttcccctcttagagatggatagactgagacccacagataaattcactgccccaggcccatacacagaaccaaaggtcctacaagccatctcctgtgatcactgacaggtcaagaaccttcttaggaagagctgtgaagggctagtaccaggcatcagacttttcaaactagacaggctctgcaggacccccatgttccaggcaactatggcttggagaggtgagctgactccccaaggtcacaaggaattttcaaggcagtgccagactaaaccccatgttccaggtcacaccactccacagttgcctccagaaggcctcccctagttgaggaggaggacagggatgcagagggctgggggagagacacaaagaagggagggaacatgaaaaaagggctgggtgggggagtggggaagaagtggctgtgggcctaggtgtccagccctttcctcttgctctgggttttggaaaagccactgaccctgatttagctgtctggtggggccaaagagtcccttcagtcccaggttccctgggctgagactgcccagttactggttttccatgtgcttcctggagcctgggtcctcccgcacctctccactaaggggcagcatcacccaagcgttccgctgtcctcgccgcagcccgcagccgggctgggaaagttggccaagggtgaggggctgctctgcgctgcgcttggccccgccttcccacagcaactgcaggggtttgctcctttagaaatgcacgaatgtccttctccatctctgtgatggctggagggtagaggtgggctagggcggggctggggagtggagttgtggggggatgcagaaggcttggggtgtcccaggctgtggctgggctcttggaggaccagctcaggcacagcttccagctcagcccactggcagagtccaggggccactcttgccagctgcaaatgcgaagttaattttggtgacacaattgttatttctcagctgatttgatgctctgtggagcaggcaggctccttgatgagttatctcccttccaaattccctgtctgattgccttcctctggaggtcagggacaagggcaaaccccagtgtctctgactggagcagcggatgggagagcaacatcagggatgcagctggtccttgtcaggtgtcaggtccgagggatggggcttttctgccatgcacacagagagcttcatccctagcccaggccaggataaatgtggccaccactctacccctggagagggagccattcctgtgccctcagtaggccaggcagcaagaagggccctgcccatcctgtgtgcagccctcagcagagcagcccagggctgcctggaagtctgggggcacgttcctctcaggccagctgggtctggagagagatgtctggctgaagggtggcagctgcaggagcaagtgtgcaggagggaagggcgtgtgctaggcagagcagagggctgtggctgacttgggccgacagatgcccctcggctcccctgagacgtggcaccctaggtcaggcctcaggagagctcagtggagggcccgggggagggttgcacagtcagctgggagaagagggccaggtccctaccatgagggcagccctactaagctacccaaagcttgcctgctcacctgccaatgggcagagaaatattttttaaagggctcagggggtcctcctggcctggctgctctgctgagggctgcacacaggatgggcagggcccttcttgctgcctggccagctgagggaataggaatggctccctctccaggggtagagtggtggccacatttatcctggccttggcagggaccccagcagtgtgcaaaggctggctggcgtgccacagggaggggagtgctgagcacacaccttctggccctgggtcccattgatgggtggaaggggaggatagaaggctgacaggtgagaagtccttggaactgcctgagggccagggagggaagccctgccccacaaggctggattgtctgcaagcctggcttagagctccctggggagtcaataaagcgcagagtccagcccagctctgcactgccgtagggacctgtatagaggatgacaaaccctccccctgcaaccttcagcaggcatcttctgattcatcttcctggcttgcctgggaccagaaatgggacctccatttctgattgagtgcacgaatgcccaaggccacaggaccacagaatgagtcgaaaccaggaggacaatcctagcagatgctctagttaataggatggtggttttcagatggttttagatttaagctgcagaccctgttctagaaatagactcatacactgaagcccaaaacatgaaacagataaagacagagctgctgtgtctaaggaggggaagttccaggacccttgtccctgcccaactgccctccgctgccctgggctgcctgctgccttgctccccgggcctcctgcctggacactgagtcccgtatgtgaatttgcctttcacatttttcctggtggtaaaaaacagggacttcactggcagagagagcaggagctatttgcagagtcgctgacttgcaaggccccatttcactccccaactcagaggccaacaaagacagatgaggccaattggggggatttgcaccactttacaagatcctccttctgccctgagggtggattagcacgtggtgggcctggagcagctgctgaccacatctggccccaactccaaagtggcctgggcagctagatccggactgtggaacccgatctgacctaccagcaccctgggagggaaaaaggaagcaaaagggcttgttccaacccagaagggtgcagaaatcagaaaagcaggaaggccccttggaaaaaggactagccctctgtgtgagttcaggaaactctgtagaaccagctggagccttcctcaaaccctggtgctggagagacctccgagatcctctgcacctcaggtcacactgagaagctaagtgagacagggacttcctactcgaaatgggaatccctgcattatccattgcacatggccatctaactccagctcgaatacctccagtttcagaaagctcattgcctgccctatctgatccacgggtggacagcagtagatgccagaaagctcttttccctaccaaataacacgcctcatttagtgcactgaaaaagtctgccaccgccctgccagtcctaactcctatagtaccctcctaggcctggaaaaatccagaggggccctgtgccctagagactgtcaggcagtctgaggattcagcgttggcaaaacacagagatagatccaaaaagtcctcagccaggagcttgatgcgtaccccgtgatgccaggctgtgcccctctgcagccatcagcaggggtttccttgggggctccttccacaggcatggatgggtgggggcctcgtgtctgcagagtggggctgaagagctaggtatgggtcgaggaaaatgggagcagatgaagaggggcacaaaggcatccaggcaccaccccctgcccccaaaaaaggaaaagggtggcatgagaagggtgacagatggggaggagaaggggaaaaggagaggaggcacgtaggggaggagggaggtgtgccagccccttcggcctcacacccacggcaggagggccctggcctgctcagctcagccttggccctgctgctgaaattccagctctgtgtgcagctcagctggctcagtgccagtcatgtgccagctccaggctgggcagcgggaagtggggcacgcggcaggcatatggacgagaagccaggaagtgcagagcaaagggctggatgtccgcttggcccagggatgcaagtgctggcagaaccagctcagccctgccctccccacagcatggaggccgcagacccctgccttcctaaaccgcccaaagagtgcctgtggacgaggcttgatgctggacaccgaaggggccagggaaaccacatgatccagctggctccagcccatccgcctggacaacagcaagtcatagggcttactagctgaccacaggagggttgcagagaggcaggatgtgtggtggtcagggcacaggctctggggtgggtggcctggctctgaatgtcagctgactgacctcaggcaggttatgtgtttctctgagtctcagttttctcatcttaaaatggaggtaacaacagcacctgcttcatgcatgcaaccttcatacatgtgtaggaagtgctggtgtagagcacatgctgactgctcagcacaatggtgaattttatttatttctttttgagacagggtcttgctctgtcacccaggctggagtgcagtagtacaatcatagctcactgcagcctcaagcaatcctcctgcctcagcctcccaatcagctaggactacaggcacacaccactaggcctgaattttttaatatattttttatttttatttttggagacagagtctcactctgtcaccctggctgaagtgcagtggcatgatcccagctcactgcaacctctgtttcctgggctcaagtgattctcatgcctcagcctcccaagtagctgggattataggcatgcgccaccatgcccagctaatttttgtatttttaatagaggtagggttttgccatgttggccaggctggtctcacactcctggcttcaagtgatctgcctgtctcggcctcccaaagtgctgggattacaagcatgagccaccacgcctggccccaatttttttttttaagagaaggggtcttgctatggtgcccaggttggtcttgaacttccagctcaaacaatcctcccatctcaaccttccaaagcgctgggattataggtgtcaaccaccatgccccacccacaatggtaaatttaatgctgagaaaatgtggtcttgtcagtgccaaggggcccatgtgggccccagcctgggtgcctcttccttcttctatgatcctctggtggaaataccctcagaactcccttcccacaagtcacttcccaaagcacacagaccgagaagcaggaggggcggggagaccatcaccatctcctgccttcctgggcagacaccttgcctctctgaggctcttggcacatgggtccatccttaaaatccatttagggcaaaagccattttctgaggacaaggactaaccggatggttgcattaaaaaaaaaaaaaaaaagatgggccataaggggaaattatagactttacagccacctccacggtagtccaaagctatttatacaaagaacttggggtgggaagtttcacatctgccttgggtggggaagcccagccacagaagggcatatctctagaagctccagagaaagtcggcatggaggacactggctgactgcaactcagctgccgtctgaccttggacaagtgacccaattctctgggtcccagtttccttaactgtgaaatgggtcctcagtgcctcggtcacaggactgcatcaaggcttgaatgagcatgaagggcttggctttactggcttccctgggcactggacaaatggttcagagctatgtatgagctgtggataggcccacatgtgggtcagcaggagatggatcagaacacaggcaggcccctctgcagggtgaggaggggcctctggtctggccagtcccatctatttccacctccctggcatttgtgatgcttcctgcccctaggttgccttttttgcccttatgcctccccaaagcgtagaatgccagtacaggtgtcaccttctccacacagtcccccgggctcatctgtgtctggcggtgcctgtgctaaatgcccctgagcctgggttcttgctctctcaaagcgagccttggagacatttctgcttctcatgtatcttgtttttgctctcagcctccccaccccaaatccaattgtgatctcctggagggtggggagcaggtccttcgacttcccctggggaactcccagtcctgacttcacaggatgagctcacacataggaagagctcaggacaggcctggcatgcagtaaatgccatgccatgaaggcatttgctcctctgattattatctgtccccagcaccccagccccagaacaggctgcaaggggctgggggtggtgtcgggtgggagcaagtgaagcagaaacggggaagaggagggcgcctcctgccctcatccctctccttccctccctctcacccccttcaacctgcttttcctttgtgctcagaccacagattccctcccctcgccctgtgagccatctctggctgccgtgcccttgccctgtgcccccctagatccccaaaggccgtttcatcacgcctcagctccctgccccgccccccaagcccaacatgtgcggagcccgtggcctcctgccaaggcctggggctgccagtggaggcaaagagacagaaatctcaccgctcggtaggttttcttctgcccagcgtgcttgggggctttgcctggctccgctgagctctccacatgcatcgagtagatgatgtcaaagaaatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccgacagtgggtcttggggtggggaggggagggagcctaccgagggggctccctggagggggacgccagagtcagggtggctgcagctatgaaatctaccagcaacaatgggcagagaacggcgacaacgaaaatacaaattaaaaaaccaagaggctccatgttcacaatttcagacagattgtgccagactcgggcggggagctcttgaatcacacgctgtgccaagaccatcctggaagtctctggggaggggggagtgctaaatagatgcggccccatcaggagctcgccaattagcagtaacctttcactgtgggcctgggctggggtcccgggggaacagctccgatcacctgggtgactcctgcctccgccctggcctttctgaaaagcttttcgcggctgcctgccctccccactccagcagctgagcgccagcaacggcacccgggccctttgtgtgtggagatgtacagaataacaggcacgaggccacgaggaggtggcagggccgtgtgaacggggcggccgtgggccccgagcctcttatcaggctggctgagtggtgtcagctggcccgactaggtgtgccaggagcaagacgggtccttcaatagcaaacagctgtggggctgacgcctgccctcccctccagcaggaaagggggctgcagggaaaccacagggcaggaggctgggggtgaggccagggcccggaagggaacggactgctggggaactgctccgtgcaggcagtcctcacaagggagatacacagacccagagacactaggctgtcagccaccagctccttcaggggagtctgtggggacgttagggggctttgaagatcaagagcaagccatatggagggaatttgaggggaaaggaagcaggcttttctctaaaagtgcccaaaagacacatctccaagagaattcttccccaaaggaccccaactcaaggatgtcagcaacaagaggatgtgggcttcgcctgctccttctcagctctctccagcacttacaacagtgcctgacacatagtaggtagtcagtaaataatgactgaatgactgagtggtcataagtggcagctgggcagggtcacttggacacactctgccatggtttgaatacggccccatcatggaagtggccctgtgaccccgagcacttactgtgcttcgagcttcaggccctttatctgtaaaatggggataacagaagcccctttcccatgaagaactgagttgtgtgtgcagcacttggcactgagcctggagtacagggattgctagatattgttattaagaagtgctttgcagttcaccatgtttcccccaggtatgagagagccgaacaccggggcaaccctcggaggttgttagggtcaggacctgcctgaggtacagtggctggtggatggcacagatggcttcagaccttggactctgtagtccaagtagaatacaggccacactgggaggtgacgctcgctcacaacacgttctggcacagacaggtcttggtttcacccagtagctttctcgacacaccatgatggccgaacagcagtgtctcttcaccagcagcccattcaagagcagagagcagatggggggcaaagggcatctgggatgtggggtcccgagccccacagctagcgggcagtgtccctaagtggtaaccctgggaggtgacctcactggccccaacaaggccctcttgccagtggcttccttcctggtcagaacccatttcagtgggacgtctcagatagcacatatctctctctctctgtgtgtacaggagaagccacttgctggtccagcttcctcgctgtgagattatgggcaaacccttcaacctccccgagcttcatttatgagatgagctgtaaagttccatgacttttctgctcttaacctctctcaggaatcaattttacctcttttggggagtatcccaccccctccgacatctcaggccatctgtacgggctgatcaatgactaacttgttcactattgacccgtaaatgcccagcattacagggctcttcatatactgccatgacagggttgggatgggacaaatattatgataggtcagttagacttttaaaaaattttttactcagcaaagatatggatttgggatgtacagttataatacacttctaaccagaggttcacattggtgaaaataaacaaaatgaaccttaagaatgaatatagctggttttggctgggcgcggtggctcacgcctgtaatcccagcactttgggaggccaaggcgggtggatcatgaggtcaggagatcgagaccatcctggctaacatggtgaaaccctgtctctactaaaaatacaaaaaattagccgggcatggtggcgggagcctgtagtcccggctactcgggaggctgaggcagaagaatggtgtgaacccgggaggcagagcttgcagtgagccgagatcgcgccaccgcactccagcctgggcaacagagcgagattccatctcaaaaaaaaaaaaatgaatatagctgggtttctatttgttgatctgggcagtagttatagaagtgtgttcaatttattaagtcattaaatcttaacacttggccgggaatggtggctcatgactgtaatcccaacactttgggaggcccaggcagccagatcacctgaggtcgggagtttgagaccagcctgaccaacatggagaaaccccgtctctactaaaaatagaaaattagctgggtgtggtggtgcatgcctgtaatcccagctcctcaggaggctgaggcaggagaatcacttgaatccaggagacagaggttgcagtgagctgagatcacgccattgcactctagcctgggcaacaagagtgaaactccatctcaaaaaaaaaacaaaaacaaaaaccttaacatttataatctgtgtatttctgtatgtctgataaactttaatttaaaaaacagtttttaaaaaggatatcatgggggtagttccactgaatttttaaattcaggtaaaatacccatgcagaatgtaccatctttaccatttttaagtatagagtgaagtcagccacatttggatcacctgaatccagaggcatagctctagaggcttagctgcttaaaggccaatagacctccctgttcaaaattgtttcagaccagaacacagatatttctggaaaaggaaggagataaaattttgtgggaaggaatggagaaagaaagcaatctgatgaggagacaatattttatgtaggtgagatggaaatttccccctaaccagcttgtgggggccttaggtgggttactttatttctataccttttttttttttcttttttttgaaacacagtctcactctgccatcaggctggagtgctcactgcaacctctggctcctgggttcaaacgattctcctgcctcggcctcccaagtaactgggattaaaggcgcctgccaccacacctggctaatttttgtatttttaggagagatggcgtttcaccatgttggccaggctgatctgaaactcctgacctcaggtgatccatccacctcagcctcccaaagtgctgggattacatgtgtgagccactgtgcccggcctatttttatacctcttgaaagtcagtttccgcacctataaaatgggcctaaaaagtgctagttggatgttccaaggatcaagaatgtatgtcaggcatccagcacatacagacttggttaatgttcatctcttcccttggacccctctgagtctggacattttgtgtttaggaatctcctcttatctctggtccctctgacgcgtccagaggggacccatgacaaaatgtgtccccctcagtaacacccaccatcagaagagatgcacagtcttatttaattcctaaataatatgctaaggctcccacaaacttggaataagctttccaaaagtcaaagtgtaattgaccaacccagataaaaaagcaaaacgtactgtcccatgtggcctgtctcttcccagcctcccacctgccctcttaggttgactctggtaaacaacagctttgcacctggtccaatgtgaccataaaattaatcccagcaaaattattcagggaagcagttttcagttagttccttctttaaaaattgatcactttctcccttaatgttcaaatttgggtcctgtaatccacctatctctacagcaaagatttacataggaaaggagagggcctggagcgaccagaactcaaaccacgcaagggctgcagagccataccttgaactgtcctctggtgagctagggccacctggattccatgtgtgctacaccctaggggaagaacgccaggatgtctacgtggccttcaaggagaaccctgagaagacagcaacaaagggatccgacagtagtcacgtgccgcagacatctctgctatcccttgcatccatggaggtaataaccttcatgctaaatgctgcaggggaggcaggccttccctagctaaggatccagacagtgctgcaagggaagagctgctaataaaggaagcagaaagcaccttccctgtagacttgggaagcccctgccatcccccttctgcctggtacccaaattagcttcatctaatccattgccctaagcaaactggacagtgaattgacaaaggaagttcactttatctataggctggatcaagaagggacttggagtctcctgcctatcccagcttcctggaaacacctagcaggagtaatggaatggaaccctgtatcaccccatgggaagaaccacgaaaaacacacagtcacttgtgtaggatcaacctctggggccttcctgcatggagaagaacattgccatggtaacacacaccatcctttcgaaccatccaacccccaaacagcctgccagagccaggccaacagaatcagacatggcaatagttttaaaaatttatggagaagctgggcatggtggcgcatgcctgtagtctcagctactcaggatgctgagatgggaagaccacttgagcccaggggtttgagtctagcctgggcaacacagcaagacccatctctaaaacaaaaacaaaaacaaaaaaaacctacacatttatggagctacattcttggacatcaccagctcccttaacaccagcccatttgggttctaaatgaaaagctaggtggcaagtcattgacaaaatcaccaaatgtctacttaaatacatctgatatttcaaaatattacagcaatggtccttagaccagcagcattggcatcacctgggaacttgttagaaatgcacattttcaggttccaccttaaacctaccaaatctgatgtgctgggggttttaacaggcccccccagatgattctgatgcaagacagattttgagaactgctgatcagaatgtctccatgattgagccagggaggtaactgtaggaaaacaggtattggctcattaaatatagacatgctctgtgcttcctggcctaatatattaatattttcatttccgatgaaggccaattttcctaatggtgagaacaaaagaatcttattgggcaacattagtataaattcaacacatctgcccagagacttaatgtggattatggatagaaagagcaggaacgccctgcatcctgacatcagatttttaagtcctccctggcaaagttaataaatacttaagcagggcatcccttggcaggtcctttctggcttcctcgttttcctcagatggatctgaatgctcagcatgctaattcccaggctgcagacctaagagggggatcggcatgtcttaccaggccattagacaggctcctgccggggcgacctcagggagctcctgaatcggactgaatcttgcctgtctccccacatgagccaattaaatggacccctgcccctgatggtgaagtgaggtccagttgctaatggattgcagttctgtcatctccattagagcttcgaagtcacttgctggtaataagttacatacttatcaaggtgggatcacagttttaggccaccagggtgccatttagtgtgccaccatcactatattagtagagtgtgccttccagcaacgacgaggccatggttgagaggatgcggctaaatagcggagacatttctcaactgggtttctccgatggtagaagaaaaaaccacagagaaaggccttaggataggccttctggtgcatttcggatccagctcttgacaaggaataaaaatcaacgagattgctattggacgagaaagtcagccagtagagcccaccccaaaggaagcaaatctttggctaccacgtgggagggagcccaggacttcagggggctgattgcacaggcaaatgtgaggatgccgctccatcccatccaggccatcaaagtggctgagatcacagacaaaaattaccctgcatattaattactagcatgctcttcccaacttctgcaatcatgccattcctcctgtccccaaaacccagccttaataaattcagtcagggctgggtgcaatggctcacgcctctaatcccagcactttgggagacagaggtgggaggatcgcttgagctcaggagttcaagaccagcctgggcaatacggtgacccccactccccccaccccccgccgccaggaggtctctacagaaaatgcaaaaaacctagctgggcgtggcggcattcgactgtagtcccaggtactcaggaagctgaggtgggaggatcacttgagcctggggaggtgtaggctgcagtgagtcatgaccgtaccactaaactccagcctgggtgacacagtgagaccccatctcaaaaaaaaaaaaaaaaaagtcagccagaactggagttttagaagcttctggggggattcctgtaaagtctcatttcagctcctggtggggctgaaaaaagaagcaagggggaggagtcagtctcctgcaaaggggccccacagggaaaggaaggaggaggtggagaggaaattgaaaaccacactaaactaagagaacaaaaagaaaagaaaaccagaatgaagaccatcacccaaacacccagaaaccctctcttcagcatccccaagagaagctgtcataatttgtaaagggcaatcaggtgattgaagagagggtattgcttcactgggacaaaggcagtattttaatttctctcggttctgaatactacctactggggactggaaattgaaaaaaaaaaaaaaaccctccaaaataggaatttaccccagaattttaggacccaaagttccattgagcttcgtaggcctggatggggcagagggatgggaccacactctccccataaataaataaatacataaacaaggcgctgaggactcaatatagcacctgcctcttctccacccttgtgcacaatctccaactgttagcgcgtagctgccgccgccaccgccaccaccgagtcgcacctgccatctggaacaggcctcacatattccaagacctcctttctgcttcgctgaacctccatcttctttcaaatcacgctggggaccaaaacgcacaccccaggccacagagaaaggtgcctgggaccagcccctcaaacaacggcgctacatttgaggatgtcatctcctccaagcagctctgagtcttttttctctttcttttgggttttgttaactctgggatgtctggaatgggtgtagggggaaggaatgggaagagaaaggggcacagtgggccacagtgccccccagttagaaggagaggggctggggaaatgcagatccgaatgacaatgacttatgagggctggagggaggagtactgtccagcatccccggacggacaggccagggtctgggcctggctgcaggactctggcctggcgggggcagggagagggtccacaggagggtgctgtagaggtgaagtcacaggcctaaggacaacccagcccccaccccaggcaaggggctgtcctgcctgggcctcagtttccccctgtgtgagcagacaccataggcataatggctttcgccacctcataggaagtgtgtgggaacccaaatgatgcacaaacagcacccgccctagaagacacccattaaagagctctgtctgctactctggcgacccgcctcccggggcaccgcagcctaggacagggaatcgggagtcaccgaagggggggtcctaggcggaaggaggtagccctgagccagccaggccccgcgggcgggtccctctcgggccgaggaggcgccctgggcgcgctaacgagcggagagccccaggtgcgggccccacccagggccgggggaagaggtggggctggagggggaggggagtgggccgcgctaatgactgttgacagcgcgcgctggggccgagctggccgcgcgcgccgctgacagctgctcgggcggggggcaggggcgggggcgaggcggccgcgctctcttcacggcgcaggcgcgtgcgccccggcggggaggggcgggaaggcgcgcgcgcgccgggctgggttcggagggcctgctggagcggctcgcgcgggctcctcgcgggcaggcaggtaatgagagtaaccatggcaacccaccagaggaagtgtattctgcaggagacgttaatcccctctccccggagctgggacagcctgactttccattctcacacagtaattagataccagctgtcagtgcaggggggacggctccgcggctgcagcccggctgggagtgggggggggggggcgcaccaacggggcgggggggggacacgcaggaacgggggcgttaaagacacagggacgctcggctgcggcgggccagggcggctggcctccccctgtctccagcctctaggcgcgcgcccgctcacctggagaccgcgcccgcgcgggccccgcccaccccacgcgcacctgctgcgcgcgcgcccgccggcctcgcgtcccccttccggccccgccaaccggctcccggcgcacctgccctgccccgcccccccgggacgctgcccacctgtcctttgtgcagggcggtaccattcgatcttgccagctctccttcagggagcgcccgctatgtgccaggcgccgtgccaagcctgatctcccgtagtcctcacagaccctccgcggtcagtgcctctgctgctccccgcccaaggcgcagcggggtgtggccatttgcccagggtcacgcagacttgaaccccccatccccgtgcccatttaacaaccaagatactgcgcctcccaccgcgtccacatccacatctgctgtggctccggggcctcctaaccgtcctgggagacaaaacagtcacactggtggctggcgtcgcggtgcacctactgtgtgccaagcactcacggcctcgtttcactttcgcaacagcaacgagagatctgttgtcccagggtgaggaagcaaaggcacagaagagctgaagcgatttgcccacagtcacaaggtacagagtgacagagctggggttcaaatccagggagtcagaccccaggataccaactactgggctccattagtcccacccctggattcgtggtggctgaaatccagcacacacctcttcttcctttcctcagttcagcccacgcaggttctgtcccagcatcgtgagtagctgcctctcctagccatacctgagaaatcgaagaagtttctaggcctaaagccactgccacaacccgcgtttctttttttttttttttggagacggaatcttgctctgtagcccaggagggagtgcaatggcaccatctcggctcactgcaacctccggctcctgggttcaagcgattctcctgctacagcctcccgagtagctgggattacagacacacaccaccatgcctggctaatttttgcagttttaatagagacagggtttccctatgttggccaggctggtctcgaactcctggcctcaagtgatcccactgcctcggcctccaaaagtgctgggatgacaggcatgagccaccacacccagcccacaaccctcatttctgtcaggcctcccaaaagctcctactgtcagtgcaggcagctgcttggaagtcattctaggccaccccttccatttcccaggtaggtgaaccaagaccattcaggtgcgaggctggcctgagtcagagatggcctgggagagcctttggggggcagggagggttcagtcccctcaggcctggctgtgtcccctgccccccacccacaatcaggcccagggttggggggtgcacaccaaggaggggcaggaagtgtccaagaagcagaaccggctctgtgtccccagtggcggcgggtgtctggggcaggaggaggctatctgatcccttccccactgccccggccatgacctcctccctccctccctcgctccctccctccctccctccctccctccctccctccctcctccttcatggctggggtagccagcaccctgggctgcagctgagaacccagcgttccccaaccccgccagcattccagtgagaggaggggtggggggagactgcacccagagctttagggacaggggcacccctggggctgctccactctgggagggccaaggccaggctgcctccaacctcaccgtttcctgcctccgctctccccatctctcagtagcagagctgcctaaatttggctccaggagggaatgggggaggcagcggcaggcgggtgccgtcagaggccagggcgtcgctcccgtctagccggctggcatttttgctgtctggaggagggcaggggggcccggcagccctctcccggaaagggagatgttcgtaccttctgacatacactgagtaatgtgcaaacgacatgcaaaccgagcttcaaatcagcatctcagccagggaacagcttgagagctgcttttgggatgagagcagaaggaccagagcccagtgcccaggggctccagtgggggtggggtggggtggggggcggcacagagtgtctagggctgggcgttgggagactcagtttcttgccagctgcagggctttgttccagtggctggaccctctgggtcccagcccaagggcagggccatggctttctctgcctgctccagcaaagcactgggcacaccctgtcacgtggttaagcacgtgagttctgcagccatcctgcctaggtttgaaccctggctctccatgggccagctgagtgaattcctcaatcgagcacccaggcaagcagctagtggaactgggtgtctgttttagaacagccacttcccttccctggaagttgggcacgggggcatgacgtgagagaacctgggctttggaatcagaactggattccaggcctcactcagccagtgaggctctctgagtctcactcccctcatttgggaaatgggttcaggatctcaaggtcagctgtgacgtccacgtgatgaccttgcacatggtgggcacacacaggccttcccatggtgcagcctcactgctgtctgcattcatgtgactcctagctccatcctgtcccatcgctcctcttctctttgttcttctgtcctggctttttcgtctctagatgtaaatttcttgcggtctttttcccttctgtctctcttcttaactggtgatcttggaaaagtcattgcctctcagagtctcagtctgcatatcttctaaatgggagtaaatgagaggtggacaatgagctctgtctggggcctgaggctcatctttacaagaccgcccacccatcattccaaagggccaccaggggtaggctgtgccctcaactctatcgggcatggtgtgttgggggctccacttctcagtaactctgtttaaccccagataactgctctcctgcccctcggccggggctgatatgagctgaatccagcttcctgccacccaaaagccacttcctgccaagctgataccagaagaacttgttttctgtgcacagagcagtctctggtggggcagccaccagcttgcctcgggtgtgaacatttttttccatttgccggtctgtctgctgggctgggcaggggaggctggggactctgaccccttcgcctctgcacgtgcctgtcctgccctgaggtagcctctgggcccaccagccatcccaggaagggtgccaagtgtcctctgggcccagacagatgtgtgtaggccgtgacacacagtctgacacagccacacacacacagtcagtctgacagagccactgtggccactgggcatttgggcaaggactcagggagacaatgtgtgactgtcacacacagttaaggtcacagagacatggacatagcctcacacatgcaaccatctgcagtccttggacagtctcacacacaattacacgcaggcccacagccatgctcagaatcccacagcactccacacagcttcacacatgtacacgggaatcttcctccccggcccccacacctgcccagcaccgaccttccagatgcattcactgattcaacaaatcctttttgagggtcttctctgtggaggccctgggctaacccataatcagaatgactggaacaggaacaaataattagctgccctgtgctgttgcctccgtttccccatctgtgagatggggatcctagccctgccacatgggactgtcaatgttaggagtgaatgtgtggaaagccctcggtccgtgtttggcccacagtgtcatctaagtaaggctatcctggttagccaaaagcatcccatgcccagctccacgcagaacacctggcacacattatctccctgagcccttgtccaagtccccagcagctggggtcatcgcccccattcctcagatgaggaaaccgaggctcagagaagaggcccacagtctgtaggttgccccaccgatctcatgtcatgccacagtgctgctccagcctgcctcgccaccccctacacacacacacacacacacacacacacacacacacacactattccctctggctagaaggcccttctcacttgcatatagcatgcccagctcctctgagctgcctacttacacttctgtgaaatggggatactagcccgtgtcagcccctgtttattttccccagggcactggactttaagggccaagagtgaagaccattttgtcctgttctctggcacacagtaggcactcgacaactatttcaaaactaaaggaataagcaagtggcctcatggctactgaggacagagtctggaactgaatgcagggcactctgaagctggagctcacttctacattattgcctttctcatgctactagcaggcactgaatgtgtcagtgagtgaatgaatgaaaccaagatctcaggatcccagtcaagtgctccctgagtttcatttcctggtagtgtggacatgagccaagctccagccaccttggatggtggtgggggtggcggggctgatgggccgcctgaagccggctgtcaggagctcgtctggccacagccgccagcaggagagaccagctggcggtgcagggtccatcggcccgggcctggaatctgagctgccctcagaggcccagcttctctctgggcccccacaaactggcctttgttcctgggccggccaagacccagcagcttgggctttctgtctgcccgcggcacccgcgctgagctggcggggtaaatgggccagcctcccctctgtccatgcccaggacgtcgctttaggactaaatggagatgtaattttctatacaaatccatgacaatttagatggagtgattgtaattggcttttcaatgggggttttgtccagagctggtggctagaactgggtggcctgtttgaggcaggctccatttaaatgacaataaagcaataatattgaggacttgtacagtgcccagcactcctcccagcccaagtagagcctcatgtttatggatctggtccttccctgaggctgtctggacaggcgggtggtggggggcgctaagcccaggagacaggtggccatatctttgggcttcaggacacagagcttcagaatggctggggcaaggtcccgcatccactggcttacctgtgtccttattcctgaaactgtcactaactagtgcctcctcgggctagctgctagtccaggtttcgggggcaccaagacaatgagagctgctcaggcaggtcagagggagaaggctacaatggccagtacagcatgacatttgagagcatgaccaagagatgaccaacagccagacagcctgagctcaaatcctactccacttctttttaaaaaaattttttttgagacagggtctcgctgtgtcacccagactggagtatagtggcaggatcacggctcactgcagcctcgacctccaaggcttaagcaatcctcccacctcagcctcccaagtaactggaccataggcatgtgtcactacacctggctaatctttttatttttttgcagagacagagtctcattgtgttgcccacgctggtctcgaactactgggctcaagagatcctcccgcctcagcctctgaaagtgctgggattacaggtgtgagccactgtgctcagcccctactctacttctgactcgtctcttgaaccttaccaagttacttaacctctccatgcctcagtttccccagccataacatgaagctgcagtgaaagtttttgtgaagatgaaacaccttaatagtgcctggcatgtggaaggtgctatatataagtcattgccgtgattcattccaagctctagctctggtgtcagggtgaccttgggcacgtgacttaacctctttaaacctccactggctcctctttaaagtggggcttttaggagaaccgacctcacggggttgtgaggattttagaggatgcaggaaagcgctgagcacacagccgttctcgataaacacgagctctcttgctgtggtgctcttgccttgaggagctcgccagctagtgatcattaccatgtcgagtgtggggaaaagggaaaagaataaagctcgcgggaagccaccacggagctcagctggctctgccatcaggggatgcaataggagagaatgatccagagggccctcaggaacagggcaaggagtggggctgcgtgaaggaaggcttcacagaggaggtgacatttgggctgggtcttgaaggatgcgtggcacttctgccaccagaaagggtgatacccagcctggccaacatggtgaaaccccgtgtctactaaaaatgcaaaaattagctggggctgggcacggtggctcatgcctgtaatcccagtactttgggaggcccaggtgggtggatcactgaagtcaggagttcgagaccagcctgaccaatatggtgaaaccctgtctctactaaaaatacaaaaattagctgggtgtggttgtgggcacctgtaatctcagcaactagggaggctgaggcaggagaatcgcttgaacccaggaggaggaggttgcagcgagctgagatcgtgccattgcactctagcctgaatgacagagcgagactctgtcacaaaaaaaaaaagaaaaaaaagattaactgggtgtggtggtgcacacctgtagtcccagcttcttgggaggctgaggcacaataaccacttgaacccaggaggtggaggttgcagtgagccgagatctcgccacggcactccagcctggatgacagagggagaccttgtctcagaaaaaaacaaaaaaaaaaagataccagggtcaggcactgtggttacaaagtcaacaggcagacctggctgcctcctgaatgagtgatttgtgcctgtgaaaagggtggtggacagggagcctctgctgaaggtgcgatgttaagtcacctctgaaggccaacagcctgtgcaaaggtcttcaggcaggcaggcggccggcatcgtgggcagtggtgtgtaggatggtggggaggctatgctgaacgtgctggagggacggatggggtggcggctgtattcacgtgaaacaggcagccatagagggattttaagcaggcgggtgacaccatccagaggatatttttaaatgatccctctgactgctcgtggaaaatgggctatggagaagaaggggtgagagagaggcagggaagccatggggaggcagttggatcactgggggagagaagtggttagacccaaggtatagcagggcccaggagctgctggaaggatgatgggaaggcagggggcgggtggagaaaggaagggggaaggggtacaaagaggcatggggcctttgaggcgtggtgaggggctgtgtgcagctggtacctgagcagggttggtggaaggagatagcagaagagaggtgagggccacctcccacctccctgcgccaggctaaggctctccagctttgtcctgaaggcagtggggtgccaacaaggatttttctccaggcaggaaaagaccatgctgagatttgtgcttttgaaggatcattttggctgcagggtaaaggggtgggaggtggcaggtgggcgaggctggaaggagagaggcagggagggagggtggtcagtggcggctcagaggcctcagcaggcatcctggccagctcccaactccaagagcaacaaaccactttctcagaggtctaaaaccagccccaggtcacacggcttgtcaatggcagagatagatcccaccccagggtgaactcaaaatccagtgcactgttcccctttgctatcaacagccttggtcactagtaaaatccatcacaaatagcttttcatcacgactctcagagaacccatactatgacacgaaaaggtgagtactattattattcctattttacagatcaggaaactgaggctaagtcacctgcctaaaagcacacagctgggaattgacagccaggttcagatctaggcagtgtgactccagacccacaccacaggtcctaagcaggaggtctcaggccaagtggggtctatggatgtatctgggggaacctacagaggtttattacaatttgagtttgttgctgatacttaaaagttggggctgggcatggtggtgcctgcctgtagtcccagctacccaggaggctgaagcaggaggattgcttgagcccaggagtttgaggctgcagtgagttataatagtgccactacactccagcctgggtgacagagcatgaccctgtctctaaagaataaaaatttttaaaaaatgggacatttcatgaaagaagaaaaacatgaactttggacaggacctcctaatgttgacaaccccaagccccagtccttgaacttcgtccaccttggggccactcacacgtgtgcgatgtcacgttgacatctccagcatgggcctctcctctgctgccggacagccgactggactgaaagcaagtgtgtgtctagggccccctggagagccagggcgacacatccatccactcatccagcaagcatttagacccccttcccccgacccgcccacagccctggccaccaccaccaaacttcctcccccagcaggcttctccatctcccttgcttaggccaaacaccctgaaggcatccttgactgctcactggttctcacagcccacatcccatccatcagcaagttctgttggctccacctttaaactatatccagaatgcagctgcattctccgctgtcccaggggctggaggtgcagggagaggcatgtgccgttattctagcgtgctgagtctcagttccattgtctgtaagaagggcgggctagagcaggatatttggattgccattattcttgtgtccagattttggagctaggaagagcctgtttacaagacacttaggttgtaattctttttttttctttcttttctttttttttttttttggagacagagtcttgctctgtcgcccaggctggaatgcagtggcatgatcttggctcactgcaacctccgcctccttggttcaggcgattctcctgcctcagcctcccagtagctgggattacaggcaggcaccaccatgcccggctaatttttgtatttttagtagagacggggtttcaccatgctggccaggctggtcttgaacacctgacctcatgacctgccggccttggcctcccaaagtgctgggattacaggcgtgagccagtgcgcccagcttttttttcctttttttggcgaggggatggagttttgctcgttactcaggctggagtgcaatggcgcgatctcagctcaccacaacctccgcctcctaggttcaagtgattctcctttctcagcctccttttacagtcatgcaccacgacgcccagctaattttgtatttttagtagagacagggtttctccatgtttttatttatttattttttgagatggagtttcattcttgttgcctaggctggaatgcaatggcatgatctcagctcacagcaacctccagctcctaggttcaagcaattctcctgcctcagcctcccaaggggattacaggcatttgccaccatccctggctaattttgtatttttagtagagacagagtttctccatgatcaggctggtctcaaactcccgaactcaggtgatccacccggctcagcctcccaaagtgctgggattacaggtgtgagccactgcgcccggcaaggctgtaattctaattcccttctggcctgggcaagacataggtgggacacaggagagagcatgggtgttggaggcaatggcagtcttgactttcaactccttgggtcaggagctccctgtgatggaggctgtcttgttcaccactgcatccccagtatctgccagagctgaccacaaagtaggtgcccaggaaacgtgtactgaaagaataagtgatgaatgagtcctcctggtcctccagagggaccttgggcattcactaactttcagaggggcttgattttcccatctgagaaacaggcaggacaatctgatgccactgccttccttctctgtaacaacaaacatttaccatgtgcttactgtgtgcctcaccctgctctaagtgctttacatatatcaactcactgactcttcactccagccccaggaggttgggacaactctcttttatgggggagaaaactgcggcccagagaagaaagtgacacacatgcccaatgtcacacagcacaaagcacctgagctagagaccagcccgggcagcctggccccagaactctcattcttttttgagagaggatcccattctgtcacccaggccagagggaagtggctcaatcatgactcactgcagcctcaaccttccacgctcaagggatcctcccacctcagcctcccaagtagctggactacaggcacaagccaccatgcccagctaatttttgtatttttttgtacagacaggttttcaccatgttgcccaggctggtcttgaactcctgggctcaagtcattctcccacctcagactcccatagttcagggattacaggcatgagccaccatgcctggctttctcattcttaaacactgtcctaggctgtccctcagtaagaaaggaggtttgggaagcctgccccaaggaagcacccaagttgcaggtggggacatgctgggcaggactgcaagctcaacaatccttctgtggctctgtactgcctgtcaaatgccatcccaaaactcatgcctggatttgaggcccctggaagcagctccagccatgtctcctcctcccagaggtcccagcacaaacctgacattccagcctccctggctgcttctcctcccatgagctctggggcaatcgtgcctctgtgcctggacacacactgtcccctctgcccacaactgggtgcccacaactgggtggtttcattcaaatgtcctctctctccccaggaatccttccctgaccttcccccaacccccaacccaacatgtctcttgccttcaatttcctgtaacactttgccaacaaggacaataatagccaatgtgtattaaacactcctgatgtaccagtaggtactattgtcaataccgttttacagatgaggaaacttaggcactgagaggagaagcaagttgcccaaagacaggtgggatggagtcaggattgaacctacatttgcctgacaaattgcaaagctagacctctaagcccctaaaccagaccacatctcactggcaggcatacaacagatgctcattcaagattccctagtaactgactgccttgggcttccacacttaattgccttttgcacacttaagtatgatctcagagattctccaggcatcacctgctgaatttgcatttttctggtagttatttcagaagtgggcggagacactctcaaggcatgggggccaaatcaaatggtgaaaaataaacaggatcagaagtcggatagatcatgtgaactgagatctctgtaaagtggggattttaattctgatcttcagggtcattacgaggggatgcacagtgccagcatacactgaatgctcaatatacagtaacctcggtcatcacacgaatggctcacgttctagacattattgccgggagtgaaaattggttccctgtctgtggagggcagtctgtatcatctccaaaagcacatgccctcagacgcagcaattcaactccttggtataaactcgcccatgcttgaaatggccatccatattcagggatgttcactgaagtcttgcgagagcagaatatcataaacaatccaaatgtccattaacaggggactggataagtaaattatggtacatccataaaattgaatactacacagctgtaaaaaagaaggagaaagttctttatgttctaacatacttatgcactgacagcatacagatttactgtttagtgggaaaaacaacctgaagaatgtaagagctaaaactataaaactcttagaagaaaacacagggataaatctttgtgaccccggattaggcaatgacttcttagatatgacaccaaaagttcaagcaacagaagaaaaattagacaaattgcacttaattaaaattaaaaacattaatgctacaatggacaccatcaagaaagcaaaaagacaactcacagactggggtaaaatatttgcaaaccatgtatctgataagggacttgtatctagaatacagaaaagattcttaaaactcaatggtaaaatgacaagtaatacaatttttttaacgggcaaggatctgaatagatatttcttcaatagagatatacaaatggccaataagcacatgaaaagatactcaacatcatcggccatcagggaaatgcaaatcaaaaccatggtgagatgtcacttcacacccactaggatggctctaatcaaaaagacagccaataacaagttctggccaggcatggtggctcatgcctgtgatcctagcactttgagaggccgaggcaggtgggcaacttgaggtcaggagttcaagaccagcctggccaacatggtgaaaccctgtctctactaaaaatacaaaaattagccgggagtgattgcccgctactgtaatcccagctactcaggaggctgaggcaggagaatcacttgaaccagggaggcagagattgcagtgagccgagatcgcgccattgcactctagcctggcgacagagcaagactcagtctcaaaaataaataaataaataaataacaagttttggcaaaaatgtagagaaattgcaaccctcatgcactgctggtgggaatgtaaaatgatgtactgatttggaaaacaggtagttcctcaaaaggttaaacatagagttaccatatgacttaccactcctacatggaagagaataaaaagcagaggtgaacacaaaaacttgtacatgactgttcatagcaacatgattcaaaatagccaaaatgtggaaacaacacaaatgtccatcaactgttgaataaataaataacatgtggtatgtccattcaatggaatattatcagcaataaaaaggaatgaagtacagtcaggtgtcaatgatgggacaggttctgagaaatgcatcattaggtgattgcatcgttgtgcgaacatcatagagtgtatctacacaatcctagatgacacagcctattattgtactgaatactgtagactattgtaacacaatgatatttgattttttgtttttttgaggcagagtctcactctgtcgcccaggctggagtgcaatggtgcgatctcagctcactgcaacctctgcctcccaggttcaagcgattctccggcctcggcctcccgagtagctgggccactgcacccggccaatatttgtatatctaaacatatctaagcatacaaaaggtacagtaaacaataatacagtattataggtcaggcgtggtggctcacgcctataatctcagaactttgggagggcgaggcgagctgatcacttgaggtcaggagttcaagaccagcctggtcaacatggtgaaacttcgtctctactaaaaatacaaaaaagtggccgggcgcagtggctcacgcctataatcccaacactttgggaggctgaggtgggcagatcatgaggtcaggagttggagaccagactgaccatcatggtgaaaccccgtctctactaaaaatacaaaaattagccaggtgtggtggcgtgtgcctgtaatcccagctactcaggaggctgaggcaggagaatcgcttgaacccaggaggcagaggttgcagtgagccaagatcatgccaccactgcactccagcctgggcgacagggtgagactccatctcaaaaaaaagaaaaaaaaatacaaaaaagttaggcgtggtggtgggtgcctgtaatcccagctactcgggaggctgagacagaagaattacttgaacacaggatgcagaggttgcagtgagaccagattgtgccactgcactctagcctgggagacagagcaagactccatctcaaaaaataataataataatacagtattataataatttaggctaggcacggtggctcatgcctgtaatctcggcactttgggaggccaaggtaggtggatcacctgcggtcacgagttcgagaccagcctggccaacatagtgaaaccccatttctactaaaaatacaaaaattagccgggcgtgatggtgggtgcctatagtcccagctactttggaggccaaggctggagaatcacttgaacccaggaggcggaggttgcagtgagccaagatcatgccactgcactccagcctggacgacagcgtgagactcggtctcaaaatcatcatcatcatcatcatcatcatcatcatcatcgtgagcatcatcctcatctcatgggaccactgtcatatatgtggtccattgttgaccaaaatgtctttaagtggtgcatgactgtactgatacatgctacaacatggatgaaccccgaaaacgtaagtaaaagaaatccattacaaaagaccacgtattgtatgattccacttataggaaatgtccagaaaaggccaatctaaagagacagaaagcacagtagtggttgtctccctacctgggggagggggtcaagaggaaatgaggagtgaggggtatggggggtttctggggatgacgcaaatgttctaaaattgattgtggcaatggttgcacatctctgaatatatgatactgaaagtcacttaactgtatttattattttttttttagggacaaggtctcactctgtttcccaggctggaatgcagtggtgtaatcataactccctgcagccttgaactcctgggctcaagtgatcctcccacctcagcctccagagtagctggggctgtgggtacacaccaccatgcccagctaattttttaaatgttttgtagagacagggtctggctatattgcacaggctggtcttgaactcctgggctcaagtgatcctcctgccttcgcctcccaaagtgctagattacaggtatgagctactatgctcagcctgaatcatattttaaatgggtgaattgtgtggcatgtgaattatatctcaaaaaaatgctattatattaaaaaaagcaacctatggaacaatgtacaacatattttgtgtaaaactagaaacaaaacccagaaatagatatgcatatgtgcatatatatgtataaaatatctctgaaaggatacccaagaaataacagtgatttcgcccggggagaggaacagggtgactggcaggcagggccagaaaggggactttttctttttaacagtctacgggtacttgattaatttttttttttttaataatgaaattctggcagtgcgcggtagctcatgcctataatcccaacactttgggaggccaaggcgggcggatgacctgaggtcaggggttcaagaccagcctagccaacatggcgaaactctgtctctactaaaagtacaacaattagccaggcatggtggtggacgcctgtaatcccagctacttgggaggctgaggcaggagaatcacttgaacctgggaggcggaggttgcagtgagccaagatcatgccactgcactccagcctgggcgacaagagagagactccgtctcaaaacaaaacaaaacaaaacaacacctttttctggctgggcacagtggctcacgcctgtaatcccagcactttgggaggccaagacgggcagattgcctgaggtcaggagttcgagaccagcctggccaacatggtgaaacccagtctctactgaaatatacaaaaattagccgggcatggtggcgcatgcctgtaatcccaactacttgggaggctgaggcaggggaatcgcttgaatctgggggcggaggctgcaggaagctaagattactcactggccctcagccagaggatgagcttggttggtggctctgagagcataggagatcccctgaggaatcctactttacagtgtgccaagcctgctcacaaccgtcctcagattcctcacacaggccctgccagaaggtttcagcaccgccccatttccaccagcaaatcctgtggcgcgcccttcaaaacaggcctagaatcggctcacttctcaccccaccatgggcaccattctggtccaggccaccagcctttctccctggttcacctggatcactgcagcagcctcctcccagcttccaccctcacccccaaccccagtctgtaacccacacagatctgtgctcacctctcaccactcacccccacacccagggctccagcccactccactggccttctcctggcgctactcaccaggcacttcctgccgcagggcctttgcacttgtccttttctcttcctggaatcctctcccaccagatccccacatggatgttctctcacctccagtgggtctctgctcccatgtctccttgggaacaggaggcctccccacacctatctcaagcagcagcccccagccctagccccattctctgctttatttttctatatatttaacatttacatttagggttcatggtctgtctccccacccccaaacatacaggctccgtggaagatgggattctgtttctttctctagcaccaagaacagatcaatgcacgttgtaggtgctcagaaatatttgtcaaaataaaactgggtcttatgaaactgtcacagaccagaggaggttaaggagacatgacagctaaatgtaacgtagtattgtggttggatcctgggacagaaaatttacattagggaaaaactagtgaaataaaaagaagtatgagttaatagtgacgtgcctggatgggttccttagtaacatcaaatgttaaccacaggggaaagtgggtaaggagtagacaggaactctctggactatctttgcaactttgtaactgtaaatctaaactgaccctacaataaaccatttgctgaaatgttaagaatgtattggatgtggccaggcgcggtggctcacacctgtaatcccagcactttgggaggccaaggcgggcggatcacaaggtcaggagatcgagaccatcctggctaacagggtgaaaccccgtctctactaaaaaatacaaaaaattagccgggcgtggtggcaggtgcctgtagtcccagctactcgggaggctgaggcaggagaatggcatgaacccggaaggcagagcttgcagtgagccgagatcgcgccactgcactccagcctgggcgacagagtgagactctgcctcaaaaaaaaaaaaaaaaaaaaaaggaatgtattggatgtaagtgcaaatgaacaaacaggctcagaggtgaaggcgcttgtcacaggctgcacagccaaacagaaagtggctcatgggcagagagacccagcaaacacctccccaagagaaggaggcccctgtcactgaagatccatttcttttgcaataaaggacaatgttgtgtggggggagggtggagctttccttcccaaatatcataggaggctcagatgcttcattgaggatccacccctggtcctgtatcactcagaagcaggcaccctctcctgggaaaccccccaggaaatcctccttttctccttgcctcccaggaggcccagagggccttgatgagtcacaatactgtttgtcaagagtcattggctctggagctcaggatttcaagccaggtcatccaaatcagggtaggggacaaggaaggggctagggagaccaaaggtggtccaggaagggaggagaaagggacaactaattcatcttgagcacctactaggagctggcatggggcaagacattttagaagtatgtgaccacattccagctcccagccccaaaaggctaactttgattactcctgtttccccaatgaggaaaccaaggactggaaatggatccagtaacaaagcaatggagcagccaaactgggatgtggcctccttggcctcctcttgaaccccactctgtggcctccctgtaccctgaccatgctggcttcccccagctacatctgcaccatgtgccccctctcagcacctggcctctgcccaggctgctccctctgcctgaaacaccctttctttcctggtgttacgttaacttctacttgatcttcaggcctcagctcgagtgttactgtctgttacggcctgaattgtgccccctccaattcatatgttgaagtcctgacccctgttaatgtgactgtatttgtggataggacctttttaaaaatttttaaatttcttctgagagcaagttttgctctattgcacaggctggagtgcagtgctcactgcagcctccattttctgagctcaggtgattctcctgcatcagtctcccaagtagctgggactacaggcatgtaacaccatgcctggctaatttttttttttcatagagatgaggtctcactatgttgcccaggatggtctcaaccccctgggttccagcaattctcctgcctcagagtcccaaagtgctaggatgtcacaggagtgataatgcacctggccaagacaggacctttcaagaggtgactaagttaaatgaggtccttagtgtgggccgcactctaataggaatgatgtcttcccaagaagagaagattaggatacagacgttcacagagagaccatgagaagacacggagagaagtgactgtccacaagccaagaagagaagccccagaagaaatcaaccctgctgacaccttgattttgaacttccagccgccagagctgtgagaatgtcagtggtttaagccaccagtctgttactctgtcacggcagccccagcagactcattaggtggcctccgagaagccctccctgaccctccagacccaagctgagaccctgtgaatgctctttccttcacggcgcctctcatgaccacagtattctgcgtatttctgtgatcatttggttaatggctgtgtcctccatagatggtgacaatcacaagggcacagacggggtctgccttggtctctgcacagtgccaggtgcatagtaggccccccctaaatacatgcggagtgagatgagaagggaagagccagagaggctctgcggcctcgggagctctcctgcctccctctgtgtctctattccccgaccaaaacagcaccaccaaggcttctggaacttttgaacttcaatcctcttcttcagcaaatatttcctttgtggggggggggggtttccctggagcccctcagctctgtcaggctcagttttgtccagcaactttaaatcaaatccttgctgaaaaatgtgaaactcattcctgaagtcagcaaaagacaaggtgcctcgtcctctgctacttgtctctgtccctccttgaaccctgttcttcctgatcccccattccagccctgcccaaatcctgccagctattaagggctacactccaaatttcccttctccaaaagctcatccccgggggcccagagactagaagcggaggctcagaaagggagagagagtggcccaaagtcacacagccgagcagaggctggtccatctgtgaatctcaactctggcctggtcccatctccaggcatatcagcgaaggcatctggtgacacaagtgtcctcagccccaggggaaactgctctacctcctccattcattccactgggcaggtcgggtctgagccgaggtgggcctggcagaggtcctgggcctctgccactgagagcacgtgacctgcccaaggccacacaaccggttaacagtggagccagagctggacgtgccggagccacagtgcctcgccacacggccaccttgctccttctgcaccagcgacgtgactatgcaggaggcagcttgtgtgatattgatcgagctcctgatgcaaagcagggtgggaaatcctaggaatcaggtagacccgattttaaatccagccatgtgattgtgatctcagccaaggaactccgtctccttaggacttttctgcagctgttacagggggttctacctggtggggatatgtgtgggttgaaacaacgtttgtgaaacccgtaacacagagcctatccactacataaagcagggtcaaactgctgagctcattgcataaagtggggtccaccctcacgcatccctgccctggccacgaagcagcctccccgctaccgtcctgcccttgcagtcccattgcccctggagtcccattgatttgagtcccagcaccaagcctccttatcacttgcattgtgatggtgctgcaagtgctcattgtagctaattagaactttctcaacatctccttggtccctatttactgcttatacagaagagacgctctgaaggcagaagcctccttggcctcctgtgcagcaaagtcagagcagccccagccagcctctccaagtctcctcggttgggcatgcccagtgctccagcaggcagaggatggcggagggctctacccactgccaagctctgcaacctcatgcaagccgttaatggtgggcagggggcaaactcagacaatgactagttcctcctagcgctaaaaatgaattttgcacaccagcttttgcctacacatgcatcaaatatctctgcaaggacaggcaagaaaccagtcacaggggaaccttctggaaaggaagctgaatggctgggggaaagaaaaagtttgtatttttaaacttttgcattttaaataatgtgaacacagccaggcgcggtggctcatgcctgtaatcccagcactttgggaagctgaggcaggtggatcacttgagctcaggagtttgagaccagcatgggcaacatagtgaaaccttgtttctacaaaaaatataaaaagtagccaggcatggtggcacccacctgtaatcccagctacttgggaggatcacttgagcctggggaggtggaggctgcagtgagctgtgatcatgccactgaaccccagcctgggtgacagaatgaaaccgtgtctcaatgtaacagtaataatgtgaatgcactgatatttaaacaaagttgaaattaaaaataataaaatctagatttcaagtgaagggattaaaatccccagcttcccgagtttgcacgacctctcctaagggattcccagtgccactgccctgtgtcattgctgctgacaactgacaactggccacagaggagcttggctaaaagtgggagcccaggaagggtcacttcaacttatgggcctcagttcctcctcacgatcaagagagctgctgaaatccgcatcgtaatctaaccctgatttgctggtctcttcttttgatcagatctggggagggcatgaaacattccgtcatgggagccccagggtgtgtgtaggggggcaagctcacaaaagtccaaggggccccagcaccctgaatgagactattgagggcatcaccgctgaagccctcttgttttaccaatgaagaaactgactcacggttctggaaagggactgtatgctgagatcacacagccggctgggtacacggccgccccaccaccccacaccactcatcccctgacagccgtaacggaggattccagctgcaccagcaggtggaggatctggcctggctgtggccctttcctctgactggtggggccagagggtcagcggtgctgggcctggccgggccttgcaggctgtggtatggagtctggtctttgtcctaagagcccctggggagcccctgaagggttttaggctaggaactgatgatgtgtgatttacgtttcggaagatcgctctggctgctggatggagagagggagccagcaggccaaagcaagagccactgcagcctggaccggagcaggggcagcggaggggccgccgagaaccagtgcaagggaaggtgagccgattgcagatggaaaaagtatattcctccttggatagtgtgtcccgtatctccagatgtgtaaactgaggccagatcacatgatggggctgttgtagaagagagctgtagtgtggccgcaatgcccaagattccagatcacctcctccaggaagccttccctggcccccaggcatcccccacgggactaccctgggtcataatcatcgggttctggatttctgtccttccctatcatgaaggcaggggccactgctttcctctctggactcccagtgctcagcaaacagcctggcacgtagtaggacctcatacctcacctcccttccctttccttttccttctatccccacacccctgcctcaggtcttgcatccaggtatccccaaagcccagcctagatgctggcacatagtaggtactcagcagatatttcttgaattggattctcttcaggtcagagtctaacacacagtaggaactcgataaacattcagccctttctcctcaagggcagagtcaatgacaaattgcccagagttactgggagctctctttgttcccggcactgctcggagcacttgaggtaggaatgttattacgttcattttgcagatcagcaaatggaggcctacacaggggagggaatttgcttgggccacacagctgtcaaatagcggagcagggattggaacccaggcccccaggcgccaggactggaatgcatggcctagttctgagggcccagtggctgccactgttcctggcacttagtaggtactgaggtttgtctgtaacgggccccagaaggacacagtcacctccgagctggctgccgccctcctcccaggcgtgggcatccctctcgcctgagtgggccaagctgtcccaagggaccacggccagcccaggcctgcccaggccctgccgcccacgcggcctccctgagccgccagcaggccagcagtgtggcctgccctgggagaccaagcctccctctgcctccagggtggcccagacaaaggcggcggtgtgcccggccccctggcactcgggctgccttcttgtcctcctcctcctcttgctccagggcactcgcagaggttcttttcacaaaggagctggaggatggggggcagggctgggcagccccaaggcaggggaagggagcactggtgaggccacgccctgccaggcctgactcctctcccagccccgtcacacaggcacccagtgggcaccaatcgtggcctgctgaataatgaccattctgagtactgagtgtggccagggtggggccctggcacacgtggacaccactaatcctcccgacaagagatggggtttcacacttaggctgaggaggggagcgtgtcaagggagctattatttccccagtgtagtcaagaggaaactgaggctcagagaggccgagccacctgtctaaggtcatacggttcaaagtgggacaaactcacccccgacccaggtctacctgattgccacagatggcatgctacccgctgccccaactgtcacctaacaaacaattaataataaaaagagaaacaatgaacatttagcaagcatttaatatgtggcaggcactgtgcctaaggcattacctatattaagtgatttaatcctcccaacaaccctatgaggtaagaactgttattatatccatttcatagatgaagaaactgaggctggcaaggtggggcaatgcaccaaaggacaaacagcaaggatttggtggagtgggtttcaacccagccctccagaacctgtgcgccaaaccacagttctatcctggacggctggatgggggacggacagactgacggatgggactgatgattgacagctctgtcccacctgcaccaggcctgaggctgggcacccagtaggagcttagccagcatcggccacaagaacactgggcattctcacgcagtgcctgccggaggggcctcatgtccccagcagggccggagcttgggggcggtgggcagtgtgcctgggctgctgggggggcccaactccctcccgagcagagccacggcggcatgacggatgtgcccgccaccgcggggagcccagggtatagcagttgcctggaaacaggctgctctcgcggcccacactcagacctttgtcaccatctcaaggacctttttttccctcttcctcctttcacgatggagccagaccctgcacgcaggtgagaaaccgcagccaaccccaccagcagccccctgtcaccagggaccatgggggcccttggggcctggttgcgggtggggaggtaggtgggtgccgggaggatgaggggaacctgcagcgggaagtcagcgctccacgggcggcccagccgaggcttggaaaaatcccgacgctggaatgcttctctcactggctttattttccccaagcttccctgacaaaaaacgaggctgagtcctttttcttaatggcgcaatacaagaagcatcagcttccagagccgagggtgtgcccaaaggatctgggcagggctgggcctctggggggcccagagcaggggacaggtgtggtgcccccagcacagcaggcactaattggctctcatgccggtggccctgagaggggattaactgggccctggggaactggctggggatggggccacgccccagccagggttgggcttggggacaggagtgtggaggagcaacagtgaggactctggggtcaccccagcatgggcccaaatcccagctttgtctcttgggcaagttatttgtctcccctgtgactcagttttctcctcaatgaatggggaggacctaaaagggtggttatgagaatcaaacaatataattcgtgtaaagtacctagcacattagctgggcatggcggcacgtgcctgtagtcccagctattcgggaggctgaggtgggaggatcgcttgagcttgggaggttgaggctgcaatgagccgtggtcatgccactgcactccagcctgggtgacagagtgagactctgcctcaaaaaaataaacaaataaataaataaaatatctagcatatagcaagtgctcaatgaaagaccacaggcgcgcttactccgagggccatggggtgcctggctccaggcatgccgtcaggactatttcattctcaccctaagcactcagggaggcaggaagtccacagtccactcactggccataggcagaactgaggctccaggaggaatggcatttgcctagtgacactggggagcatgagatgtcagattgacttccaccccccacccgcccatcaggcttccggcttcactgtctcagccactatctcaacctccccgattagcagtgctgaacgctgaccctgaaaatcagacctcaacgccgcctgccccaaacattcctgggctccccagtgcccagataaaatccaggctgatttgctgggcactagaggcctgtgtgctatggctccgcccacctcaggtttaaatgacacttccatgcctctgcacaggctgtctcctctacctgggacacccaccctctgcttagccccttggtgagcctcagccctagggtatactctgccagaaaatctccccagcccagactccaggccaagccagggactcctctgctccctaccctctgggtagccctgggagatctcctccccggagtcaccagccagcagggagaatgctcccggcctggtatcctatctctggaatctctgccctcccttgacctccacagcttcccggctggcactccttttctcactcagcatccacagccctcggccctccccattctgctcctgcaggaggggcctttccctgatcaccccaagccacaggctgacagcccttccaccacgctgttgctccagaagctactgtgttcctaaggagggcagggagggtggaggggagggagagtagaggggagagagagtggagaaggagggtggaggggagggagggtggggagggagagtggaggggtggagagtggagggcagagagtggaggggagggacagtggaggggaaggagggtagagggagggagagtggaaggagggagagtggaggggaaggagggtgaaggggaaggagggtggagggagggtggaggcagggagagtggagggcagggaggctggagggagggagagtggagtgcagggagggtggagggagggagagtggggaggggtggagggcaggtagggtggagggagggagagtgaggagggagagtggggagggagggtggaggtcagggagggtggggagggagactcgggagggagagtggggagggagggtagagaacagggagggtgaaggggagggagggagcgagcctcacctttactgaatacctgccctgggtcaggccctattctaggcacatggccaaccagtatctcgatgactccatttcatagaggaccgaaaggagattagggttggagagatgaaggctccctcttgcctaagggcctgaggcctagctaggcttttccactgcctgcgctgctcaggtgacgttctggggtccccaagggccatcacagggcttgcatattcctcatgttctctcacctgagccagccagcccaggcccaaggcaatggcagtggtgacaacggcagtaatcctaacactggctgataacgggcaccatttaggcactgggctccaaaacccacataatcctaaacatggagaaactgttgcccagagaggccaagtgacttatgtaaggtcacacagctgacaagccatagcgctaggacttacaccccatgatggaaaagccacgacgtcctagagcctgggacattgcctggtctcccggccaaggtggcagcagcccccaggcagctgtggccccaattctggtcactgggccctaagcgtatcctcggcagccacctgctaattagccaggcggctcctgcctgctcagtggctgctttggagcaattctcccaggaaaggccgagcttgcaggagcaggaaaggtaattgctaatttgcacgagaggagacaaagggacaaaggcgcccttggctgcccggtgcagcctgagccagcttcacatccagagctccctgccacttgccatccaccacggcgggccccaggatgtctgtctgtccccatgacacatccacacagtctctgttcggtgtaggccacccggccgcgccccaggaaggccagaagagaccattaacgtggccctgtcatccttcagagcactgcaggggaggtgtacagggagctaacgattgaaaaagcggatgattcccacgaacgttccagcatcttctggacgctctgcgtgtgttgcttacagaacctcacagccgctcatgggttgataccgctctcagccccatttacaggggagaaaactgaggtacagggatgaagcaactgcccaaggccacctggtaggacatgaaggagccaggattagaactcagcccatctcgctgctgagcttgtactattctatgatctaaattgagactgtctagtttaaggctcccattttgcagcagaagaaactgagggcagaaagctacagaatggaagaagctgggctttggagtcccagctctgcctcgtatgtcctgtgtgcttcaggacacaatcttccctctttgtgcctcagtttcttcatctgtaaaatgggctaggaatctccgagttgtgtgggcactggggaaagtatgtctggcccttcaaggtgctgcacaaaggtgggctccctgattgctccttcgaggggtccagcagcccagtgcctcggggggctgaagcaggtgcggctagagcctggggccaggagccctgtgagatgaggctcaggctgcaggaaccaaggagcagagacttgtgggcagggcccactgtcaagggctgggaggctgggccgtggccaggaaggctggcccagggaggagggggcccgcctgcacgaagcccacctgccagtatctgcctgagctgtgactagcgccctggggcttgggattaggcaggcccgggtccaagccccaccaggcgtgcccctctctcaacctcagcttcctcatgtgcagcccctcacagagctgtcctgaggctcagagaagctgacaggggcgtgcatctggatgacaaggcactgggggccaggctgttgagggaacagtctggagaccccgccctcccagcccagccaggccagacaccggatggacacacaggccgagtggacggtcacgtgaggtacctcttcctcttctcgccgagacctgccccagactctgcctgcctgcggcctgagcttccccaggctctgggcctttcaatatccttacaacagacctcctgtcccaccaagctgtgccttacaaaacctggtcggggaccacaaatctgcaaggcgctattattgcatagcacacatgtgcaggaggtgcatgcatggggctgcttatggtagggggtgtaagggcactggacgatctctcctgccccgcaccccctgggctctctgaaccaggacagcctggtcttagccctccatcagccctgcctcactgtcagcctgggcaagtcacacatcctctccaggcctcaacttaccctctctgtaaactggggctattacttcttgttccatcttcctcatggggttcttagaagactcaagtgataggacaaatttccaacagctttgaaaacaattcagagtcataccagaatgttaagttgttaggttctggttttaaacgttaggcacagtggctcacgcctgtaatctgagcattttgggaggctgaggtgttggagaccagactgggcaacatggcaagaccccgtctctaaaaacaaacaaacaaacaaaaacagaagaagaaaaaaattagttgggtgtggtgatgtgccctgtagtgccagccactcgggaggctgaggtgggatgcttgagcccaggtcaaggctgcagtgagctgtgatcgcaccactgcactccagcctgggcaacagagcaaggccctgtcttaaaaagtaagcaaataaaaataaacatttactgagaagctcctataagccaggcctcaggctgggcacttacacacatgcttcccagagtggtctctgtaagtcccattgcaactcggttctatgggctgcaaaactcctgtccctgttttgcagttgaggacactgaagctcagagagtgatttgcctaagatcacatggctggaaagcagtggacccaggattcgaatccagggccatctgcgaatccgtcactcagggtgaggagctggatgatagtagcctcttttccaagtccccatgggtcttcaaacccactcagcacttttaagatatgggcagcaaggcacctgccccagccccacctacaaggttggcatcactgactcccgtggggacaggctacgagggctcagaaatcattttgttctgaggctcaaggtcctgcagagtaaaatgtggtcttttgattcccaaatacagggggtgggaggagctggggacactggcctccttgcagttcctcaaaccaaccagacacactcctgcctcggggcctttgcacttgctgttccctctacttggaatgtttttccacccaattcccgtataatttgctcctacggggctctgctcaaaatgtcacattttatagctgaaggcctctcactgaggccctccctgacaccctgtttaaaattctaacacctcctgctccaaccccttgagttcccctggttctgctttacttttctccacgcatttaccagcgtctgacacagtgggcctgttccttgtttattgggtactgtcagcctgccctagaacgtcagctctatgaggacagggattttgtttatgcctccagagtagagtgtctaggacagagcagatgcttggcaaatatttgaacaagtgaatcaaactgaggcccagagaggaaagctggtgggccccaggctgcacaggaagtgaaggggcagcatttgtgtcctggccttctgcccagccctgggcatctgtcccctctctttactggcatggaatcagcttggctttgctagaatcaggggtgcaggagcctgggtccttgcctccttcccctcctgagagatctgggagccaacaatgggtgggagaacagcctccgccctggggctgcgtcagggaaacagcaatgtgggtgtgtagaatgtgtccttccaagagaccctggcttcccacctgccccactctccatcccggttcccagaggcaaggctgagaacagagccttcttttctttcttcctcctgatttagggaacgggatctgccccagacacactagctgccatggcgaggtggcagttccttgccttcctggtggcctccatggaggattgttctcccttttcacagacaaggtgctgagggcagaggagccagggcaccatttgtccaaacttacttgggcaaaaccagacctcaaactctgctctggcaagtcagactcatacacttcccctgtgctgagtcccccacagagggaggaaactgcctgctggaagtggcaggtggccatagctgggagcagctgctggtcagccgcctgcctgagcgcacatctgggtgctgccctttgctcacaggggcccttgggcaagtggcataagatctcagtgcctctcagtgttgctgcaggagcccaatgtgcaaacacacacagagcacttagaacagactggcacccactgagtactcaataaacatgagctgacacactaccatcatcaccatcattggtgtgtgccatcacacacaccaccatcaccatcacaccaccattgtcatcaccaccaccaccaccatcatcttcatcaccatcattaccaccaccatcatcatcatcatcaccatcaccatcatcttcatcaccaccatcatcgtcaccatcatcgtcaccatcatcaccatattcatcaccatcatcatcaccaccatcatcaccacatcaacattatcgtcaccatcatcaccatcatcaccattaataccactattgttaccattaccatcaccactataatcatcatcatgacggccatcaccatcctcaccaccatccccaccatccccaacaccatcaccaccatcagcaccaccaccataactgtgtcatgtagcatccgttccccacaatatgccctgaactctgccagggcaagaaccacatctatgggtctcaacagtgcaccccaggaggccctctccaggttgctaaatggataaatgagtgaatgaatgatgaacagttctttgtgcagggcaaagcagctgatgaggaggagactcagattcacccctccagcccctccccctcattcctaaatgggagtaaatctgctcccatttagggcactgccccctagagcctacagcctccctggacctcagactccagtctctgctctgcacacactggaccagactcactccctaaacacctccctccccatgttcttcctgctctacaacactcaatggctcccaatccctgagatctggctttctggggccccactatggggccatccagccatatctccccagccctgcacctcccttcaagccagtttccttccctcctttccaccgcctgtgcccctgcccgacctgggcttcccaacatggccagagaaagtggaaatcctcttgatggggcttgaggcccatgatgacccagccctgctgaccctgccaggctcctgagtctctccgtcctggaactggaggagcctgcttgttgggtaggtcggaccccccttgatgggactgcaggctgcttgtgtgggggaccctggccatctcaccagccctcatgttggccccacaacagctctgcttctccattttgcaaaggagaaaactgaggcacaaaatggataaagacaaggcttgaggcattcatttaaaaaatatacactgagtgctaggaactcagcagtgaaccagacagcaaatattcctgtccttatggagcccaagaggaacacgcacaaaaacacagctttgtcagatgttcataagggctccaaagttagtgtaaggggcttgagagtgataggaaccaacgacattttgaaaagacaatcagggagggcctccctgaggaggtgacatttcagcagagctcagtgacgtccaggggaacagccaggaggccagtgtggctgaaggaaagtgagcaggggccaaggaactggaaagagggaccagagctgggccttgcaggtcatggtgacttttgctcagagagtgatgagaagccacaggagagttttgaacagagaaggaacatggtcaggtttacatttttaacacagcactttggccacagtgtgaagcggggcggaagtaacagggaggacaatgagtgctacagctggggaggaggtgacaagagctggggtaggaggtagtgatggaaaaggccttgcactcccgcactccctagagcactacttcctgggaaaggggggctcagaggagccagacactagggcagcagggctggcatgggggactccaggcagaagccacctcctggagctcagcaagcctggcacaaccaggacaggggctggcttcctgagccaaccagctggagagcacaccagcccctaggctgcccctgacctccagccaggggggtacctggtactcccagctctgagagggcagagatcaagtcctgttcaccaccacagaggcggtacctagcacagctcctagcaaagagtaggtgctctggcaatctttatggaatgaatgacaggacctggtacatagcaggcaccaatcaaaatgtgctgaacaaatcaatgaatgaatggattgcctgcagccctgtatcatttgccggtagtttcttgtgttagtctgagttccttaaaataattacaactgctgtggatcggatcgcagagccttgccaggagccaggccctgagctaagtctcttaccagcatgaaacaaccccaaacagcaggttctattgctaggcccattgtacagaggaggaaactgaggccaagggaggttaattaatttccccaaggtcactctgttactaggcagcacagccaggattcgaacccagggctgggttcttctcagctacatgttaatacctcctgaatcaggatcttatcaatgacaccgtcattcccaactcaactgtaaatcctcctgagggcagggatccctggggtccctgatgaacaaccccaatcctccatcacatcttaggcgctgcgttggctgtccacagcagctcagagaatggcactgccttcccaataaggaacccaaaggcttggagcttgggaacctttccaagaatggtaccccaaaggggcagcggaggaaggccttgagcccccatcttctggggcctggccaagggctctttccatagtacccttccccctcctgtccccacagtcaccctgtgtacccagcacaggcgcagggattgagttcccaaaccacgagccctgtaagcagcagcagctacttcctggggcccagcgggtgtccagaaaacccgcccacaccagaggcccgtctcaaggtctggggccactgggttgaccctgggctgacttcttacctctgcctctctttttcctgaatagacaaaaactgagctttaggacctgcacagggagctgggcatttaaaactgcaagcagggcatgcttagctatatatgcacaataataattaataacaataatgataacaacagcagccacagtgatgatggccaacactcaccgagcactcaaccacgacccttaagaagccctcaatgctcactacagcctccagggaagcaggtcccattagcactcccacttttttggatgtagaaactgaagcacagagaacttcagcaagttgtccaagccacacagcgactatgcagtgaattcaggattcaaactgaggaaccccactccagagccaagtatgttgggcacagaagggagtggactcctccaggcaggggaaccagcgggcagggaatgggatgggatggccacttatcaggtcctagggaactgctggtttgctttttgttattgtgggggtttttttgtttgtttgtttgttttagttggagtctcgctctgtcgcccaggctggagtgcagtggcgcgatcttggctcattgcaacctccgcctcccaggttcaagagattctcctgcttcagtctcccaagtagctgggattataggcgtgtgccacaacgcctggctaatttttgtatttttagtagagatggtttgttttttgtttcaccaggtttcaccatgttggccaggctggtctcaaactcttgacctcaagtgatccactcacctcggcctcccagagtgctaggattacaggtgtgagccaccatgtccggccaactgccggttttggtttgggttttaaatcatgtgcgtgtactgccataaaacaaacctctttcgtgcaccttcacccaccttgcccctcctaggaggcctatctcctcctctccccatggcaccgtttccttcctcacaagaggctttccgtgcttcctccccagccaccaaggcactctctccctgtcctaacccctcaggaggctgcccaagatcatgcactggccacacgtctgctcttggggcagctggtagctggcctgggctgggtgtggggctgcacctccccatttaggccccacccgctgagggcagaggcctggtctcacaggagccggcaggaggctctcccagcctcggctgatgtggagtggccagcggttggctgtgggtctccatgctactcggtactctccctgaactgcagaatctttgggggatccctgagggtgaaccctaccaacagaccctgcttgtgcctaatatcccaaggttggcaccctctgccaggcagattcacacccaactccccagcctgggatgaaccaccatccaagaccaggtaacaccacagaggatcccagaatctaagccttgctgtcagaaggatggcgatttaaggagctgaggacacaacccttccctgtgctagctggagtctgtagtctgcctcttcccagctttgtgctcttgggcatcttacttaacgtatctgagcctccgaatctccattggcgagataaggatcccagcggccaccaaatttggacaatcacatggggtcgtgtgcataaagtgtttagcacagggcctggcacttcctaagcactgggcaatactggctgtgtcatgactgccattgttctcactccacagcagacacggactgaggacttcatgtattccagattctccccacagcaactggaagaagtagctgacgttgctctccccattttacagatgtgagaatggaagaagttaagatggatccaagccagttggtgagtcaggattcgaacccagggctcttgttcccgctctcagtcctgtaatgcacagcctgaactccgtggagcccactgcccctcgcccctcctccccgatgaccagcctctgattggagcagcaggactcccggcctccacttcccaccacctttggcttggcgccgtccctctgacctctggcttccatcaaggccccctctcctccagatctgggggctggggccctgtcaatcctggaggcaaacccagctgactactaccctcctggaagccccccagcccagtttccctgcacaggctctggcttcccttctacctctgcccactgccccttctgcagctctctgctccagtatcccctgccccggactccatgtccgtaaggtctcactgccactggccacgccacaggcataagcagagagcagttcttgtttccgatgctgagcacttgacatggagtctctcttcagctccccaaggcagctctgagagataggtcatactatcgcatccttttcttttttttttttttttagacagggtctcgctgtcacccaggctggatggagtgcagtggcacaaccacggctcactgcagccttaacctcccaggctcaagtgtagctgggaccacaggcatggcgccaccatgcccagctaagtttttttagttattatagagacacagtctcactatattgccagggctggtctcaaactcctgggctcaagtaatcctcacacttcggcctcccaaaatgctgggattacaggcatgaaatactgtgcctggcctgggtccattttacagatgagaaaactgtggctcagagaggggcagcaacttgcttcaaggtcattcagctcatgagtcacagagatccactgaaaccccggccagtctgagctccagagacccactcggtggcactgcttcacctggcttcatcacagcttctagggttactgattccatctcagtcacaatcccgatcacagcttcctttcattgagggcttgactgtccacaccttggtatagatacttctatacaatagcatagaaggaggatataactgaatccatagctattgtcatcccattttacagatgaggaaactgaggctcagagaggggaagtaacttacccaagactgcacagcagtaagcggcagaacctggacccagcccctggctccagacccccactgctctgctgacctgcaggggcctcgaatcaacataaagcctttcacccctagcctgctcctgtctcaacctcaacctccagagaacatccatcctccatggagcctcccagcctgagccctctgagctgcctcccttcttctctcccctcagcccaggcttccctatcaccccacagagagcctcggagccacccttgggagcttcacagctgcctggctttgggatctttgctctgagagaccccaagatggagcagcagcccctatgctgtggcccaccgggcaggcttggttttatgccatcttcccagctaccccttggggtacgggttttatcacccccttatacagaaggggtcagggatcaaagcaggcaagccatttgcccagaaccacacagctgttgccagagttgggatccaaatgcaggactgtccttggccataccgccttctggatgtccctacagtggctctgcccagtcaagagcccctgttgcccggggagacccctcttcacatcctcatgacaatgacaatcccacgagttaaacatttcacatggattcttgcctttagtttttcccaacaacctgcaggggaggggcaatcatcacacccattttacagacgaagaaactgaggcacccagtggttgcttagctgggggcccagcagagcctgtgccttggtttgctaacctgtagaatggggtcataacacagccttgcagggtgcttgaggactgtgcaaggctgtggaagccaggggctctcggaaacacccctgagggctgtcctcagacaaggccggaggcccgattgtgtttttctcgactcgccagcatccagtcagggcctggcctgctgaaggaagggccccatgtctccttgaacatttcctcagcccggggatgccgagaaaacgatgagtcatccacccaagcagaggcctcccaggagcttgtgtcgggtcccagccgggaggggagggctccaagctggagagggggcccgggtaacacgatgactcccgcgctggccccgaggcctaagtcacggggtcccctccacggcctcccaccgccacaggctgccagcctaccggacacccttggatgctgtgccccagatcctgcccctgcgccttcaccccagatctgcaccccggtttcctaaaccactcttcccacccacgaatcccagggttgcctgcgaccctctagcctccctcaccccactcccacctcacctagccccagccactcaaccgctggtccgtcgaggaaacccgtcacgcctttctcccctcacctcactatgcctctgcctggttttccttctccatcgccctcttgcctctcaccacagaatctgagcgttccttctaaaaccccaacgtgaccttagctccctccacgtgagaaccctcctgtgagctccctgctgtgcctgatgcgatgggctcttcagatctctctcctccatctggccccaaccaatcttgccagctcaccccttcaggaccccactgtggttctcaagctgacttggccatttactcatctccactccatctagaatgttcttccaaacatgcttctctaagaaaattggccctgggatccgtcgtacaacgcccacgctgaccccgccaaaaccagtcccaccccccggaatgagcttccctatgctctgctcttgctgaaaagttctttttggacttcaaggtccaggtgaaatgtcactttcccaaggacttctcaggccctgtcccgtgggagggtgggtctgcgccctggggctgctcagggcctctgtgtagaactaggcagttctcagaacccggctctgagacatctgctgaaccaccctgcccagtggggagccccttaagggcaggggctggtctgggtcctggggacacggcagcaaaaaaacacagacgcagtccgccctgctagtgctcatggccttggaggagacagatcctaagcacagaaagtagtgaaatacacataatgtcaggcagggataagggccccagaggaaaaatcaagtagaaaagagagatgggagatggtccaagggatctaaggtgggcctcactgggtgatcaaggaggccctctctgagcaggtgacatttgaccaaagacctgaagagggagaagagctggccatgcagagatctgaagaaagagtattccaagctagaggaaggccagtgcaaggggcctggggcaggactgtatttggcgtgtttggagaatagcaaacaggccagtgtggctgaggccaaatgaacgaggcgagagggaattgagagcagtgggcagccagggccagatcgcgcagggctctgcaggctactgggaaggccttggctcttgctttgagtgagacaggagtcttggagggttctggacagaggagggagagaacctgacttggggtttccaaggtttcctctggctgtttgtgggaagaaggggttatgtgggcagggaacagggtagacacagggggccccggggagaggcagccacctctccaggcttggaccaggctagaggcagtggaggccatgagacatggtagaatttgagatgtgctttgaaggtagaaccaacaggatttgcaaatgggttggattgggagggagaggaggtcagagaaaggggtcggaagtgactctcaggtgtggccgaggaaggggaaggctgcagctgctgtacaggaagggcagcgaggaagtgaataaatgaatgacctgggcttgggaaccagtggctcacactcagctctggagctcattgggaccttgagtgagttccctccactctgccttagtttccccatctgcaggggaggagctccatgtccagggtggccaagaggactagtgctccgggatccacaaccacgtgggtgagaggatgggcccagcctcccacctgctctgccgtctccccactccccacgactcccgtctgctagcccagcagcccgcccaggccaggcctgcagctgcagttgaaatcggaggggaagagcatggacgagaggcagcaggggcatccgtctcccacaaggctgggtctggccaggtgggagggcagccttgaggtctagaaagcttacgtggggtgccctcactaaaggcgagagggcaccatgagccaggggtgggtggagagctagggcacccctgctgccttcactcccgggggtcctcccgtgcccctgcctccaggctctggggtttggagggtcagacagagccctggagctccagcccagctgtgtgttcactgtgggccttgaggaggttccctggcctgtctggtaccaagttctcatctacttcacagaacccaggggagattaaatggaataatgtatctggcacatggcaggggcttgaaaaattgggagatgggctcagacccctgccggagggaggcagtcattacgccagccattgtgtgttctcctcacaaatccagaccccaggaactcaggttcccagccagggggccgggcgggggtggcgtccatacaggagaagggcgagaggcttgtccctcttctcagcaggtgcctgccaggccttgggaaagccctccagcgcccttccttgacctctgggatctgacacctgggaagaattcagaggcagggagatcactggagccttctgtatgtcataactaaacataatgaggctcactgcagggcaggaaccagtcagggcagcaagagaccctgagtctgcaagttcccagctctgggggctcatgccacatctccatccctcaccatgacttctggtgccaggtgcagtgcccactgcctgtaagcccaactacttgggaggctgaggcaggaggatcacttgagctcaggagtttaagaccagcctgggcaacaaagcgataatctgtctcaaaaaaaagaaaagaaaaagccttctctgttcaattcaatgcaacatttctcaggcccctgatagtactggagacacagaaatgactcagatacaacctctagggaactcatagttgctgcctacctactctatgccggggacttggctgggtgcctcgtctccactgtaccatttaatattcacaacatccttcatcaccattcccattttccagatgaggaatattgaggctcagtgagatcacatagcagctaacatttcctaagatttgctacatttgggggccctacgtgcatgaaagcattaatttccacatcactcctagaagaggaatatgattacagttccattttactgatgagaaaattaaggccatgggaggcggaggttgcagtaagccaatattgcgtcaaaaaagaaagagagaaaggaaggaaggaaggaaggaaggaaggaaggagggagggagggagggagggagggagggagggagggaaggaaggaaaattaaggccaaactgataaaagggcagagatgggatttgaacccagggtcctgtagcattaaagcccaggccctttacctgttctctacatcaaagtggactcaagagttcttgttctaataagccactggccctggtgggtgctgtcaccaacttccagctgcttctttacctgctttggggcccatgggcctagcctcgttctctgttttttttgagacagagtctccctctgtcacccaggctggagtgcagtggcatgatcacagctcactgcagcctctaactcctgagctgaagtgatcctcctgcctcagccttctgagtagctgggactacgggtgcgtgccaacatgcctgagttttttaaaattttgcatacagacggggtctcaccatgtccccaggctggtaggcctggctttgacatgagtgagcagggtggcctcaagcacattccttagccaccatcctcaaatgacagcagagccttttccagtttgccaagaagtggagttttagagcccattttccagaaaaggaaactgagactgagagaggccaggcaggctacttgcccgtggtcatgtgggaattaaacagttgagttaggaccccataggccctggccccctcacttcaagttcagagccttttctcccaggaccttcccgccccatgcttggctttgggctttgttataggaccatagcaagaggcgggtagggggtggcagtgggaagctggaacaaggagatgccttggctgcagtcatggggacgggggtatggcaccacctcttatggccacctcttggcttcagccagctgctgagactccggggatggcaggggccagggcagcagctcaggtgacttggtgatgatggaggacatcccaacagcaccacactggcagacagacagggtgagtccaatccagatctcacatgagtgcaagcacacgcagtcacacccgcagctgccaaggcccacagcccaggtgctcacatagatgccgacaaacacgcagaggagcctctccacctgtgccctgcacacactccacgcacacacacacaagcatttccagcctgcacatagataggaacagcacactcacacccacacagttgcacttttacacacacacacatgcacgcacatgcgtgttctagcccgtgagcacacacatgttcaggattcagtcgcacaacctctgagctaagatctggcttgaagaagcccaggtatgcctgaggccctccacttggtccccagacacccccagccacaggctccccaccccccaatcctcccagcagcatttctgaggtcccagatgggccttccagcctcccagacgtgcagggacgacaaagcagcctgcaggggccataaagcagagggttttcctaccagctcctacccagggaagaagggtgcacggtgtccccacccctcagcagacagtgacccaggacttagaggggaggccccaggaaggcagagcctgacctgtctgcatcaccctggcaccgaaatgcagccccccagagttacccaggaccatgccacccaaatcacaacgtgtaactgacaaaaacgcacgctctgccactcacaaaaaatgcaaatggagcctgtgccaggcatcactgtcaaccttcttccaaaagcccccccaggacccaggacaacagaggcatcctccctcctccccaccccacacccatcttcatgagccctaggaaagcccacagactttatgttgtgccagtcctgcctcaggcagcagcctgtgaatacagacctcttgaccagagggatgctttgaaactaattcagactaaagtgtaatggactgaaagcttgacatgaaggacctgtgctttcaaattggatcaggttgcaagacccttcaaagtcagaatggagatgtatgcaaggccctggcattggtgtggactaggggaagttctgaacctccctaagcctcagtttactcatgtgaaggtagcagtaatcacagcactggcctctaggctgctgtgagaattccacaagctgatgcgtatcagcgcctcagcccagtgacaggcacacagtaggtgacccccgaaacagccgctatactgataattcagagaaaaccaggaaatattgagggactcaaccaaaggtcacagcacatattacgcggtgctaagtcagaggccatttcccgcccagaccagcggccgcaggtgccaaaggtttacacaaaagctctggggagaaagacttaggcctcaaaatgctttccactaaatgaacgttgttgcaaactgggaaaagaccaccattagtcaatttgggtagtggaacacctggggtccagcttgcaaaagcctggttttgagagtggagtttggcaatctcgaagtttcccttggggaatggggctctaacggtgggattcctggcatgtggcaggtccacggagaagctacagcagtgcacagagaaccctgttccagtcctggctctcaacaaatggaaacttcctctctctaggcctcagttttcccatctggaagatggtacagttgggctgagaacctctatctctccacggagacttggggctctctgatcctaggaactgacagacagcccagggccccacctcagccgtaacctgtggccctcgcaggctctggggacggctccacgcgctccactcagagaggccagaggaaaaggaaaggggttgttttactttgtggccaatgccggaacggaattggagggtcttgtctccaaggggtttgcttcccccgcttggcagcccacaggcctggagcaggccaaacgtaagaaataataaatcctcaccaggcttcacccggccaggaggcccccagctggctcttgtcataaagagatcttatccccaccagcacccctagctgcccgtggaggactccgccctcctctcctccataccctgcttccaccttctacttcctgtgacaacctgcaaactggaggccaacttgcctctcccccacgcccaggcttctcctcgacccccgccctgccccacccccacttgggccccagctgcaggaggccctgtggagtgtaattcccctcgccctctctctgccctgggcccgtccggacagattaagcctttgtcacacacacccagaaaagctcagggccagatgggacaggacaagtggtgtcagatcatcgacccgaggctggccgggactaggagagggccctgaccacagcaccgcatatggctgtgggaggaggaagggaggcccagggtgggggcagccagagagcaatggggaagagaggtgacacaccatggccaccctggggacagaggctatatggggcctgtctgctggatgacccaactcccacctcccttcttccttggaatctttctacctgctctctcttgaagcccccatgggcttctttatcctgtcctcagctatgcccaccacccccgacagctgggtgacctgggagcaggcacacagccccacccacccgagcaccccagtgcccgcacaaggactgtgggtactaaacaaatgcttttgacaaaggtttatggcccaatgaccttcacaaaaacccaccgaggaccaaactacaggctctctcccaaatgacaccaggggtgagggggtgtgtgtgtgtgtgtgtgtaggccagggagacgtcctttgcacctttcaaaggaggtcccattcagcccctcccaggaagaggccaatggctgccccagaattcccagcaggatttgttcctcttggatcagtgaaaaggaaaatggaaatataaaaataataactgggccccaggaaagaacttggagatgggggtggcatctcctgcctggctccggctggctgggcgagtggcaggtaactgacgggctctcgggaccagcaggccaggcaggcgggcgtggggagcccgaggggcgggctgtcgagggagggcacgtctgttgtgtttgtcgatctcctggcagcctggactgggaggcctgggtcccctttctctgcctcccaggcaggtggtcccttggggagggctcattattggtctgagagccagggtggagactggggacggtcgcgctgccaggggcaggcagagcgggtcagcgtgggtctcaaggagcatctgaagccagcagctgggccggcaggacctggggtccaggcccagcacccagtttctgcatgtggcctggatagggggagggggtgctcagcctctacagctgtgtggataaagagtggacgactgctccagatgcccactccctagggagaagtcgagccacacagaaagccagtgagccagctgccaggtctggggggtcaccccccaactccaggagagggtggactcagggctcctgcctcagactaagaaggttgggccaaggcttccagctcttcagggaggtgtaaccaggatgggggggtggggtggggcaccgacccgggaagccctgatggcagagggcactgacctagggtagggggcaagacccagccaaccatctcgtgggtcactgacctcagaaaaaccgccctccggcggggggcagtgacccaagatgggagaaccgaggaggggaccgacctggcagggtggggagggctgacccatactccccatctgggaaagtggcactgatttgggctgggggaggggtcctggactcgatcgggggaggggacaatgacccagactcgccgggtttgagcgagagtgctgatttaggctgggagggtcccagccttgcgcgggctgggtcactgccccagcttccccctcggggagcccggtcccggcgcgcccctctgcccggccccctgttcccggtccggccggaggcggcagcggcgcagatgggctgctggcggccgcagcgcggttatcagcgctcctcgcagatgggccgcccgccctccgcgctcgcggctcccactccccgcggcctgcagccccgtcccctgggcgcggggggaggcgcctccggatctgctccccggctcccgcctccctccctcgcggccccctcaccccgcgggcccggcccgggcggccgcggagggggagggggaggggacaagtgcacttttcgtaacgaccgaatcaattgtgtgtgaagagcccgctccggccggggacggggctgagcgcggggcgggcgggccggccgggggaggagcgcggaggggggagcgggggagcgggggagggagggaggccggcgcggggcggcccggctctcgcgctccggccggggagggagcaaggagggcggggggaggccggcgcggcccgaccgggccgggggcggaacgcactaatggagggtctcggcgacggaaagttcaaagctcagcagcgccccgggagcggccgccccccccccagcccccaccctctgcagaacaatgaggtcccggcgggggagccgcggggcccgcgccgcacgccctctccagggcgccccgggccagaggggacgcccccgcccggccgcccgcctcctccctttaggcggctgcggttccccgccccctcccccacgccaccccgcccggaccgggccggcccgggggacgggggaggggaggggatggataggtcaggcctcccccgtcccatgaagggggaacgaggggcccggggggctgagggggcgccccacccacccgcgggaggctgctcctgcgccaggctgcggctccggccgcccctccccgggccagccccgggtggggtcggggcgacagtgcccgggcgggccccctcccctggcgctgggaggcccggcggactccccgtcccgcggctgcccctgcctccctcccccccccccaccccgcggcaccaccctccgcgcgcgcacacacacacacacacacacacacacacacacacaccgcccagccggcccgggggcgggagcgcgaggcgcccgggacaggcagccccggggcgggcggggggaggctcgggctccagagcagccgcctgctggcggggggaggggacaagaggacggaacatgctggggtgagcagcccgggacagcctgcccggcacggccacggcccgggcagcggcgcggaggggggcagggacgccccgaacccggagcgctgcccaggcgagccgggaagggccggtgagcagggacgcgtgcgcctccggcgggcccgacacacggacaacctcagggacacacgttcggacacacatccacacccccaccccgcccccgcccgcctgccccaagccccgcggcgggacccgcccgcggccgccgcgcgcgcactcaccgagcccgtcttgaccggcacatacaccacttggcccatcttgggttcccggccgctgcccaggcggaagcccttggagcgcacccagaactggaacttgcctttctcgccggctgcggggccgctgcccgcgccagtcccgccgccgccctgcaggacctcggcgatccgctggtatttgctgcgtgtcaccgtcttggttttggccgagtcgccgtaggtgcgcaagcaccagtcccggaactggcggcccagctccgagtccccggggctgcgctcgcgctcccagcccccgcgcagcagcagcgtcggcttcggcatcctcccgccgcgcccggcgccctcgggggcgggccggccgccgggccgcccggtgccgggactgggctgggctgggctggaccgggccgggacgcgccgcggccgcgtctgtcccgcggtgtggctccggcgaggctgctggatgggcgcgggcggcggccggacgcgcggggctgcggcgcgctctgtcctgctcgggcggcggcggcggcgttggcggcggcggctccggctcgcctcctgctccgcctcctcctccccccggccgggatgcaggagcgatggaggcagctccgggcccggaggtgcagagggggcgggccgccccgcgggcggccgggggaggcgggaggcggggagcggccccgagcgctgggagcgagaccgagcctgggcgcgggcggcagcagtggctgtcagcttgcgcggctcatcctgctcttgctcaggctcccgctgccgcggctcttcctcctcctcctcctcctcctcccgcgcccgcctccaccacgccgcgggatcccacctgttagagcggcgcagccttcgccgccgcccgccccccccttcctcctgcgcccgcccgccgggcccagcccccgcccggcccggcccctgggggcgcgggggcagccgcgcccgcagccgccgggagggcaggaaccacaggcgcgcagtgcccagcccaggaaccgcgttccgtctggccgggccgggcccggagcttcgcaggccccgctcctcccggacgcggcggtcccgcggggagtagggcgcagaccccagcccagacgccgacctcccggccgccccgccccacttagccaggccgggaaggtgtagggcaggctccccctccctcgctcccgcaagtgacttgacctctcccgtgagccgaagccagaagagcagtgttcccctgggggaaccccacatcgccgcccttcggggcccccaaacttcctctccttttgcctcaccctgaattccccgaagtttggccagctttgcctctgcttgcctgccccactgctctgggacaggcccaggccccctgggaagtcgcctgtggcctcagcccaatcccacctccgcttcagaaaactctcaacacatccacaaactcatcctgagacaccctgccttcctgagtgcgccttgacctagaatctcttgctgagtaaactcaggtagccccaccgcccccctcctacctgggcagatctgaccttgggtagagctagctggtcccctcccccttaatgaaattaccaacataaataaaggcacaggccaattccccaggatttctgtgcccctaccccccacttccttaacaggtcatgaggaattgctgcacttctctcccagctgtccccgggggtccaccccatgtccccatgacactcctgcaggcaagtcaccatccaagtcctgaggcccagactttgtctagtgcaggaccgtttcctgcgtaggaactactgtctactcccatcccaaagtcccccaccccaggacctactacgtgccatgtcctggcaactctgagaggcagagggaatggctccattttacagacgaagacctggggcttggagaggtggcctgacctgctcaaggtcatgcaggaaggaggggtgggtttcagctcatgtgcatctggctgctgctgccatatcacacacaaactcttcccctttcaccgcgctcggagagagccccacgctgtgtatacctggctcacttcccccagtagacagggagctccagatgctcagggccatatctgacccatcctcatatgcacaggccctagcacaacacctggcacacagtaggtgccagtaaatgctgaaagaaccctagaggtctcccaagccccaacctctctctgcatttcacatgggagattatttttagataatttacatttcatgttactttatatacaccaacaactccacagtcatttttcctctttatcttctcaagagctctttttggatctatgctggtatgcatgcccgtttttaagaggtgaccactcagagcggggaaggcactacccaaaggccagccccaggggcgcaggggcttctgtgattaagaagctcagaccctgactttttccatgtgtcccttgacggttatccttccagcacactcttcctgagagcagagatgctctagcctggcaatggtaatgataactgtggcaaatatgccctgtgcctgggtggtggggtccttgtgtgagccctggtctctctgtccagttccaggacccacttcaataaccactaagccggaccacctctccacccaggctgggtctttgcctgcctttcagaagctaaaaacctggttgtcaatcttgggctgagttctggcacagcagaatgtatagtataatgaaaagaacatgggcttcgggtggagtcagatttggaagtgaatcctgatgattatttggcgtggcattcttcatgctcacaggtcccacttggctacttcacaatggaatgaagccatcattccaccctttgctgggtaacctcaggcaggtcactgagcccctacttcatcatctgtatagcgggacaggatgtcacagatgtagagattcaacaggatgagagtgcctgagctgtgacgggtgcccagtaagtgccattttctccctcatggggcctcgaagtattcaaggaggaagacaggcattgttggcactttttgtgcttcattcattcaacaaacatttgtttagcagccattgtgcagcaggggcttgggatatggtcatgggatccccaaggtccctgccctacgggagtgcaccaatgggtatggaagatggctattgaacaaaccagctattgatcacaacagcccggggaatgggccacgaaggaaagagagagctgtgatagcaaataatgcaaagaaggggctgcttttcttagggggatcagggaaggcccctctaaggaggtagcatctgagcagtgacttaaatgacaggtgccaaggcatgctgttcctgcattccaggatgagggaagagcaagggcaaaagccccaaggtggaaggagattggcattttctagaagctggaaggtgtccagtgtggtgagactgaagtgagggaggaggggttggagggcaggagtcttgaagaccctgggaaatactttggatggcattccagctgctatgggagctactggcgagttttaaacgagcaggactgtggggtagagaagaagtgaggagaggagggcagctgcaggggtccagaggtctgtggtcttggaggtcagaggcctggaggtgtccctactgtgtgacagctcactgcaccaggcacgtcccagcctcttgccccaagggctcctgggagagtggaacagccaaggagtgagaacagcctactgcggcccatccccacttttgcagaaacagaccctgggtcttcagcctatccgtgtcactggggtcctttaggaggggcatgctgggtggggtgtggggtaagtctcccacaatgcccaactcctggggggatgcaatcacggtcccagggggcagctgctcttttttgatttccattccagacacctgccaaaggaaaaagtaggctgccccatgaatcaaaggccaggagatcctctgcatttttaaaaattttgagacagggtctcgctctgtctcccaggctgagtgctgtggtgcaattgctgctcactggagtctctacctcccaggctcaagtgatcctcccacctcagcctcctcagtagctgggaccacaggcatgcaccaccacacgcagctattttttttttaattattttttgtagagacagagtctctctttgttgcccaggctggactcaagtgattctcccgccttgggctcccaaagtgctgggattacaggcatgagccactatgcccggcctctggatttttttttttttttccacacttcgtccaggtgtccaagggagactggagttgaagcacagggagtccaagcccccagggctcacgtcctctctgaatacagatagtaacgtaatcactcctgggctcaagtgattctcccgccttggactcccaaagtgctgggattacaggcatgagccaccatgcccggcctctggatttttttttttttccacacttcgtccaggtgtccaagggagactggagttgaagcacagggagtccaagcccccagggctcacgtccactctgaatacagatagtaatgtaatgggtcacaagagcttggtgatgaagggttctcagagtatacagtccaaaccctgcctctgatagatgggtaaactgagtcccacaggagcaaagaggctcagggccgcaggacagaaccaggtacctggcctttgcctgatttggcccagatcacctgcctttcactgagctctgaccctgggcccagatgagcggggatgcctgcaacttgacagtgaggtggccctgactgtgccacaggaagttccaggcctggggtggggcagagtgactcaggctcccacagaggcctgtccacgcaagggccaggaagagcagagaggccccagagccttggggagaggtagttaccaccactgggtgctggtgccccttctatcaagggcttgtgccaccacctgccatccccctattctatagcatccccctgcagtctgccagccatgctgagccgctgctgtacgcccacctctctagaaaggcctcctgacctctcaggttgggtcaggggctttctctggtcactcatagagccttgggctttccccctcccagctctgaccacagcatttcacgatggcctcattacctgtgtcgaccagtgcccagcacaggagctaaggcttaaacgttattgaataaatggataaataagcaaccaaccaaccaaatgaatgaatgaatgaatgaatgggcttatcctcaaaaagcaggtgctagactgaagtctacagcattttccaccatgctactatgcttcctccataatcaatccatccatcagcatttattgtgcttctcctaacaggctctgctgttgagtgactgagtcccttaatctctctaagcctcagtgttcaatgccgataaaatgggaatattaataattatccctaactcacagggctgtcgtgagaataagcactcaacaaatgctagctcctattgtcattatgcccatccatcattcagacgtttatttgggcatcttctgtatgtcagccaccatgcttggtgtttggaatacagtaataaacaagagggacctgacccatgaagctcagggactagctgactttcaaaagatcatgacaggccaggcacagtggctcacccctgtaatcccagcactttgggagaccaaggtgggtggattgcttgagcccaggaattcaagaccagcctggacaaaatgtccaaaccccgtgtctacaaaaaagtacaaaaaaattagccagcggtggtggtgtgcacctgtagtcccagctacttgggaggctgaggtggaaggattgcctgagccctggaggtagaggctacagtgagctatgattgtgccactgcactccagcctgggagacaaagtgagactgtctcaaaaaagaaaaaaaaaatcataacaaatgggtttagaattaaaaacaaaaagttgccatgaggctgggtgtggtggctcacgcctgtaatcccaacattttgagaggccaaggtgggcagatcacctgaggtcaggagttcgagaccagcctggcccatatggtgaaacccgcccccgcccactaaaaatacaaaaattagccaggtgtggtggtgggcaccggtaatcccagctactccgcaggctgaggcaggagaattgcttgaacccagcgggcagaggttgcagtgatccgagatcataccacttcactccaacctgggcaacagagtgagactctgtctcagaaaaaaaaagttgccatgagaacacatggcaggggagcggggcgcccagatcagcaccttcgagaagtcccactctaagtgccctaagggtcctttggaccagaagatggagcactgggcaaagtggaggggaggagaaaagtgtctctactcctgcagtggcccgcgccacactgcctgtggaattacgactgagtgggaaaaaattctgtccaccttgcagagtttgagacccgctcgagtccagcatccccttttttccagaaactaaagcataaagagataagagaactaatttgtcgagggatttcattcaaatgtcacctcccctgaggagccttccttgactgcccttcttaaaagtcccccagtggccctccattcccgttccttacttgattcatcctcatggactcagtgccaccttcctttataatacatatgtatttgtttcctgtctctgttcatctcacctactggaatgtacattcctagagggcagagctctgtcctgttcactgcagtatctccaacatccagaacaatacctgacacgtagtaggtgtcccatatgtgtttactgaataaatgaatgaatgaaaatccctgagagagagagagagagagagagagtgtgtgtgtgtgtgtgtgtgtgtgtgtgtgtgtgtgtgtgtgtgtgtattttgactatacactgcaatgagatccaggaagatttctgctgaattggagaggcaggggccttttttgcttatattcattttgtctttggcaagtcacttcccttcattaagcctcggtttcctcatctgtaaaacggagctagtgcctgctttgcagaatctttgtgaagcgtcaatcaaatacggtgcaaagtgcctaggtggggcctggcacacagtaggtgggcaactctgtcattttgatggagcccttgttgggggaggcctgtgaagggggatcccagggcctgagcctctctgcaggacacaaaggaagctgacactggatctgtcccgtcacctgaactcaccagtaatttattgatgctggatgctggcacccagcagcctgctgggtcagtctcagggagcaggtgtagggccctcgggcctaccccagcctcacccaggcagggaggggaggggagcctgggtctgcccagcccaggaaaattgataggtcagcccttacaagtcagtccccttctgtgtgccaggcagtgcaggcagaaaaaaaaacaagtgtggttcctgcctggcctgagctcatagagggttgaagtggacatatttcaaataaccaaaatggtgagagctgcatgagggcctactatgtgccaagaacttcgtacctataaccacatttaagcctcatacagggcttaaatgtgctgaggtcgcacagctagtggtggggcaagaggagggtttgcacccagatttgcctggctctaaagccagggcacattactgccatcccgccccactcaggctggctgggccaatgggcattaaaaaaaaaaaaaaaaaaaaaacgggcctggcacggtggctcacacctgtaatcccagcactttgggaggctgaggtgggtggatcatttcaggtcaggagttaagaccagcctggccaacatggtgaaaccccatctctactaaaaatacaaaaattagccaggtgtggtggtgcacgcctgtaatcccagctactcgggaggctgaggcaggagaatcgcttgagcctgggaaacagaggttgcagcgagctgagatcatgccattgcactccagtcttgtctcaaaaaaaaagaaaaaagaaaaaaaaaaacactaaaaaaaagctcttggctgggcaccgtggctcatacctataatctcatggctttgggaggccaaggtaggaggtttactttaggccaggagcttgagaccagcctgggcaacatagtgagaccccatctctacaaaaaattttaaaaattagtggggtgtggtggtgtgcacctgtagttccagctactcaagaggctgaggcaggaagattgcttgagcccaggagttggaggctgcagtgagctacgattgtcagaaatctggtcacaatcatagtggtcaggggggcatggagtgctttcagtggccactgcattccagcctgggtgacagagtgagatcccatctcaaaaataaataaataaataaataataaataaaaataaaaaggaagagctctgggagttgaaaactgagagtaggtgctttccatgggaggcttccttaaggctgagacctttaaccggccttcagcgggtagatggagataccaaagggtgagtgtgttttaggccagagaagcagccgagtggaggtctggagggaaaagggagcgatctgtttgcactgtggtgggcatgcccacctgggagagcaccagggcccagcagtgggcatgctggggctctgaatgcttggctaagccttgggcctccctggtgggacatggggagggagccatgggaggctgctgagcaatgaagccactgtttccccctgacctatatattgtaagaggcctgctagtcaggccagagtgtgcctggccttcgagaacctctaacatctagcttcagcctcacctccctctaccagctctctggacctggcatgtcacaggcagccaaacacttacggctcattctcacctctgcacctctgttctcttggccccttctcctgcaatgcccgctctgtctacccagaccctacctaattgctcaggtcttccttccaggccatttcctccatgaagcctgccctgaccacaccagccctgagttacatgcctcagcctcagaaccgccgggggcctgggctgggaaagtgcccatcctcctctcaagtccgcggcactcgccatccaccaagatgggctgctgcttttacctgcatagcaactttcttctcctggtaacagcatcttgaaatccctttgagaaaccgcctccttcatattcagagcatgttgctggagccatactgacctgaccactgaaagcattgaatgactaggccactgaaaccatcccatgccccaaccaccgtgagtgtgaccagatttctgagaacaccggccgggtgcggtggctcacgcctgtaatcccagcactttgggaggccgaggcaggcggatcacctgaggtcaggagttcgagaccagcctggccaatatggcaaaaccccgtctctactaaaaatacaaaaattagccgggtgtggtggagcatgcctgtaatcccagccactcgggaggctgaggcaggcgaatcacctgaacctgggaggcagaggttgcagtgagccaagatcacgccattgtactccaggctgggtgacagagcgagactccatctcaaaaaaaaagatttctgacaacaccctttgagcccctggattcaaccacacctaaaggcccttttcttcttcacttaggtctctcagtgctggatttcctgcaaccccatgagccctgacggatgtaccatttgttcagtgcagtcagaccccctctggtctggcccagatggctgtaccagcctcctctctgcactcctggcctctaggttttcccttctggtacaccagaataaagttcaaactccttggtgtggcattcaaggcctttcactatcttgttccagcctctacttctctctgtgccaaccacactgaaccttccattcccctgaacagcaagactgcgttcagacttgttcggatgctccttgacttacaatgtggctaagtcctgataaacccattgtaagttgaaaatatcattgtaagtcagtcaaaagtgcatttttttgtttgtttgttcagttggttggttttgtttgttttgttttgttttttgagatagggtctcactctgttgcccaggctgaagtgcagtggtgagatcacggctcactacagcctccacctcctgagctcaagcgatactcctgcctcagcctcccaagtagctgtgaccacaggtgtgcgccatcatgcctggctaatttttgtattttttgtagagatagggttttgccatgttgcccaggctggtctcaaattcctgggcccaagcgatccacccacattggcctcccaaagtgctatgattacaagtgtgagccacagcacccagcaaaaatacgcttttaacttaccgcatttccaacttattctaacagtgggtttacctggatgtaactcctttgtagtcaaggagtatgctgaatgcatatcactttggcaccatcgtaaagtcgaaaaattgtgagttgatcccttgttaagttggggatcacctgtatatgcagttcccctcaatcactgggactgcccttccccaccaattctcttcctgaaaaactcctactcatccttcaagatcccatttgattgtcactccgtctgccatgtttcccttgacccctaggcagggtaagatatctgttctctcctggcacctcaagctccctggctggtctccttcatgcagtgaccacctgatgtggttattctcttccacctggctaccttcttccctgacaaggagctactcgaagacagggtcatgtcttgttcatttttcatctcccaaagggcctattaataaatagttgtcaactgactgacttaccgacagggcactcaatccaagttcatattcctgaaatccttgcaaaccattaggtaactatttttgctggtcaccttttccagttaaccactcactgggttttctttactgcaggacttctcagaggcattcacgtgctaataatagcacttcaaccctccctgaaagggagagaatgccaaagctggcctaggcaacggtttgaggtcatctggtccattttaggaatggggaaactgaggcccagaaagggacagagactcatccaggcacttgatggcagatctgggccctcagtccagccttgtgtcccccagtgccctcctgtctacatcccactgcctcaggcccaaaacgttaagagtgagggctctggagccagactgcctgcatttgagtcttgtgcccgctctcaccagctgtgtgaccttgactgagtgacttagcccctctgagtttcaatgtcctcatccataaggtgttgacaataacagcacctcctttatggggttgttgtcagggtttaagtgaagtggtccacataaaagcacttagcacaggctggggacggcagctcatttctgtaatcccagcactttgggaggccgatgtgggaagatcacttgaggccaggagttcgaaaccagcctggccaacatggtgaacccccatctctactaaaaatacaaaaattagccaggcatggtggtgggcacctgtaatcccagctacttgggaggctaaggcaggagaatcgcttgaacccaggaggcgcagggtgcagtgagccaagagccactgtactccagcctgggcaacagagcgagactccgtctcaaaaaaaaaaaaaagcacttagcacagtgcccggcacatagtaggcccccggtaaattgccaccagcatctctataaccttagatttctcaggaaatagcagacacactgagccttgacatcttggagagctgtggttctctctggagaaagatgccaattaaataccaggtccaggctgggctgacctcccacatggggcctgctcctgtggaagcccagatgttgggccttcctcctccctgacttgaaaaaaaggtggtttttgtttagaggaattttccctgcattttcatattggctctataagttggattttgttgagtggtttctgacaagcaagttgtacaggcatgtatgtggaggagacgcaaggctgcctgtagccatgggggtggatctgaggccttgagttctgccagccactggccatgagctcagcccctggacagctgcatcccagggagagtgtctgtccttggggtgatccagaagggcttcacccctggggaattcttctagaggtttcccagaaccttccctcagaggaaaggctcactggcaaatggcctgccaccttccccaccccaccccagcaaactcacaccctgggttcaggtttgtggtgttgtggtgggggaagtccctgagtctcctacccccagctcagtccccttcaagatggatagtcagggaccaagaggtggaacacggagcttctccatatcttcagcaagccaaataagaagctaacatatgaaagcaagagagatttcagttagacagcaggagagacttctgccctgccagatggctaaaacctgggctgtgcttggcctaggaaagagcactaagctaggagtcaagacagctttgactgacagatcccttgggactttgggtcactgcctcattttttccctccctcggtttgctcgtccacaaaatggggattataattcctatttgctacagagcatttcaaaggcaacaatggggtgaggccttgagtcagtggcagggggctgcatcagatcacctctgcaggttccctgtcctctctttttagaagggattctagggccaaggccttagtctcaggtgcaggggcccagcggtgaagtgtgtgcatgtgcaggtacacgcagcactccagccacactgcaggcactaagtcatgttggttttctccccctcttctcaggccactacccagatgcaaaaaatggcctgggcagaagttaggaagcctgggtcctagccctgggtctgcccccgactttctctgactttggccatgtcccttacccaacggggcctcggtttccccatctgtgccatgaggagtttggatggttttgagattcttctctcttggctctgtgaaatccacaaccggcccagtgaggtctgacccctgctcgcctccctggccatcactgggcagttcagatacactgaccttcctttgcttcctggaattttccagctccctcccaccccaggacctttgcacaagcccttgccccgcttaccacaaattcacctatttttttttagatggagtcttgctctgttgcccaggctggagtgcagtggtgtaatcttgactcactgcaacctccacctcctgggttcaaccgattctcctgcctcagcctcccaggtagctgggactacaggcgcccaccaccacctcgcctggctaatttttgtatttttagtagaaacggggtttcacatgttggccagtctggtgtcgaattcctgagctcaagtgatccacccgcttcaacctcccaaattgctgggatcacaggtgtgagccactgcgcccggccaaattcacctgattagctccaactcatccttaacagcactcagctccatcatcacctcctgaacacccccagacccctcctccaggacgcactctcacagagtcctatgcccctcctttgtaatacttaaccacccctgcatttcacatttatgttgttccttgattgagaactgtccaccgcacccctggctgtgaattctatgaggtcagagactggatctgtctttgtccctgtggtgcccctgacacccagcactgggcctggcacagaggagatgctcagccgttgaatggatgggcagacgacctccccattctttgggaccagtatagggctgtctctgctcacaaaagctcctccctccaggcacctatgcagagcagacctggtggtgaggaagaggggaggccgctgaggacctgaggggctccacccttccctgggagctgaggtgatgagaggccctgccttcagaagttgggctgggagacacggggagccccgaggggtgcgtgctgtttacagtgcacacccacgtctgcgctctctctcgggggctctcccagccagctgagggctccacaggggcaggtagtgtcagctccatttgccagacaaggaaaacagccccagagggatgctggctggaggaaggctcacatggcaggcacaggacagggctgaggtatgaccccaggggtgatgaagctggaagggctttctgctctccatctgacaaaggcaggaacaggcacagagggcagggatcagcctagggtgttctcagccagtcaatagcaaggtggggacaataggaatctataattcttttttctttttaaattgatggttttggccaggcacagtggctcatgcctgtaatcctaacactttgggaggctgaggcgggcggatcacgaggtcaggagatcgagaccatcctggctaacacggtgaaattccgtctctactaaaaatacaaaaaattaggcgggcgtggtggcgggcgcctgtagtcccagctactcgggagggtgaggcaggagaatggcgtgaacccgggaggtggagcttgtagtaagccgagatcgtgccactgcactccagcctgggcgacagagcgagactccgtctcaaaaatagtaataataataaataaaataaaataaatggatggtttctggctctgttgcccagggtggtgtgatcgcagctcactgcaacctccaacttccaggttcaagcgatcctcctgcctcagcctcccatgtagctggggctataggcatgcaccaccatgcctggataattttttaaatttttttgtaaagacagggccttgctatgttgcccaggctggtcttgaactcctaagctcaagcgatcctcccgccttggcctcctgagtagctgtaatcacaggcgggaacgaccgcactcggctgggaatctgtagtttttgaactctgatacctttctcctgctaggctgaggcagaggattcctggccttgaccctggatgaccctgaggcttcagatgatggatcacaccacagggcaacccgtgggagtggataatgttggcagaagcactctaaggatttgggtagcaggatagtgccaggcagtctgggttagaaccccagctctgccactcaccagctgtgtgaccttgctcgggtgcttttaacctctctgtacctcagtttcctcatctgtgaaatgggggaattctgggttaactagtcaatagaacaaagtacccagagcagggaaggtctgagacagtttctaataaacatgaactctggagctgacctggccaggaacaaggggagtgactaagtcctctctctgtaccaaggctctggcgtaagaagtaccagctctcagctttgtgccctcagggccactggagaaaatgtcagagaagggcttcaaagatcacagcgactgttctttgagcccactgctactccacaacccactgaatcctcacaagtgccctataaaaatcaggttcaaggccgggcatggcggttcatgcctgtaattccagcactttgggaggtcgaggtgggcagatcacttgaggtcaggagttaagaccagtttggccaacgtagagaaaccccttgtctactaaaaatacaaaaattagttggacgtggtggcgggtgcctgtaatcccagctacgtgggaggctgagataggagaattgcttgaacccaggaggcggaggttacagtgagccaagatcacaccagtgcactctagcctgggcgacagaacgagactccgtcaaaaaaaaaaaaaaaaaaaaaaaaaagcaggctctattattctcccactttacaagtgtgaaaaccaaggctaaggccagtgtcttgtctaagtcccacaggctgtgacttgcagaaacagggcgcatgcccgagcctgctcttggggtcacttgctctgaagagcccaggaaccaaagggtgaagacagagttgagttggccctggggagtggagtcctggagagaggtcctgggctggggctggcgggctggggagaacttggacagcaggcataggtgggaagtgcaggtacagccctgtctccccaggaaaccaggcctgaggtgtgccctgttagtcaatcacatcatttgcctggtgcctgtaggggctagctccgtgacggcaaggctgaatctttggtccccactgtatgcagcacccagcccaggccctgcccactggcaggcactcagtggatgcttgttgaatgactgagtggaccaggcatcctactctgtggtcaccagactgctcagtgatcatgagcaccatgctacaaacgaggaaactgaggctcagggtggggaagggaactttcccagcccacccaggtctgtctgaatcttttgtttttgttttgaggtggagtttcgctcttgttgcccaggctggagtgcaatggtgcaatctcagctcactaaaacctctgcctcccgggttcaagtgattctcctgtttcagcctcccaagtagctgggattacaggcatgcgccacaacgcccagctaatttttttgtatttagtagaggtggggtttcaccatgttggccaggctggtgttgaactcctgacgtcaggtgatccacccacctcagcctcccgagtggctgggattacgggcatgagccactgtgcccagcctgtctgaatctttctttaccctcctccaggaacatgatctcaggaacacatatctccttttccagccggaagtacctgagagagaccccagaaggtggataagactgcagagagcagggagcatgaagcaccttgcccaaggtctcaccaggcaagagaagggcggagaagggcggcttcttcatggattgtaaatccccaaagcgtgcaaacgtaaggactctctttagggctcaaggggtctaaacttacccttttacatacggagaaactgagggcgccccaaaagatgtgtcatctccagggccaccgagtggttgagcaacagactggaacccagcgtagcaaatggaaaggccccgaggctggcacacagtatgagctgaggccagtgggcttaagagcgactggggaggtgggctggggccaggccaagcaaggagcgtggactccagaccacagccatggggagccactggattggaaaggtctagacaccatctggcttgggttctcaagagacccctctggctactggggactgactggcctgcaggagcgtgggatgggagtcaggagacttgggagggtcaggccaaaagccgtggagtcatctctgcccctggcccttttctctcaccccttacatctgatccatcagcaaatccctttggctccaccttcaaaatataaccggaatctgaccacatctcaccgccccattgctgacacccctagcaacctctccctgcacctgacttccaacctggccctgccacccaccctccataacacagccagagggaaacggctgaaacaagagtcagatcgcacccctcccctactccaaagcccctgtggctccccacctcactcagaataaagtcctgagcctggccctggagggcctcatgctctggtcgccctgcccattctggccatgtgtccccaaggctctcgcccaacccctggctgcggcacactcacaacttcttggcattcctgcctccgggcgggcgtctgtacatgctgggccccctgcctggagtgcccttcctcagatgtctgcagggccagctccatcttctccttcctgttgtcagatgccaccttcccaggaggcctccctaaccaccccgtttaacatggccccacatctccttccgtcacacacacatgctttctcggctccattttctccaaaatgtgcgtcactttccaatgtaccatttaatgaacttattcatagtgtttattccagctctgtcccccattaggatttcagcttcctgaggacaaggttctttgagtggcccatgcccaaaacaggcctggagcatggtagatgcttggtaatgacatgctgttgaacttgagtggttttcctaacaattctaggtgggagatcaccctcatctcctgtcacagagaaggaaactgaggctcatggaggaaaataaattgctcgaggtcacaaggccaggacactctggggctggggtttggacagagcctcctgctctgtccggctcaggctggcatgggctgggagcaggacctctgagctggcgtgtggcaggggccctgccaggtgccctgcggttggtaccctccctgaggggccatggcgggctgggccgggagaaggcggtggcagccctggcagttccacccgttccagggtggtgtaagagcaggttgggaaaggcccaggggcaccagatccatcctacagttgcccagtcctcagagcctgaacggccacgggtgagaaaggaagtcagcaggatccaaaataggcctgtgtttcgggaagtgaaactgggcatcggggacgccaggccggaggaaggcctgggcctcctgggttgggggcccccggggcgggggtctttccttgcctccttggcctggggacagttggtcttgggactgatccctgccaggaccttgggaatgagctcaggcccctctcgcaagccaagtgaccctggacacatcacttcagctctctgatcttcagtcttctcatctgtaaagtggggctaagggtaggacttgcctcactggggactgggaaggtgagactgtgccctgaagcccaggatggtcacagttacccttggcgttgcagagccatcgtgggtgctcctcgtccaggaagcacccccagatccttagatcagaatgaatcactccctccccagtgtccccagcccctctcaatttctttctattttatttatttatttatttttgagacagggtttcaccctgttgctaaggctggagtgcagtggtgcaatcatagcttactgaggccccgacctcccaggctcaagtgatcctcccaccttagcctcctgaatagctggaactacaggagtgtgccaccatgccgagctaattttttttttttgtattttttgtaaaaatggggttttgccatgtttcccaggctggtctcaaactcctgggctcaagccatctgcccaccttggccttccaaagtgctgggattactggcgtgagccaccttcccatcctgccccctctcaattgcttttggtttctgttcacatatgtcttttccactagaggaggccaggagtccacctgagtcttcttggtgtccccagtgcccaggatagagcctggcggatgggaggtgccacccatgggccaaatgaattagtgaaggagccagggtcggaggcctgtggatgcccttgaggggtctgatccctgcctcccgacagccagctcctcaggggtggcctggagttttggcaagaggaggctctgagggcaggtgagtcatgtttcccctgaatctcagtttgctcatctgtaagatggatgagaaatgggacccacagcttctctgtcccagatcaatgaatggatcacccaagatgccactctaggaacctcagaatgtgcctggggcagggctgccccagagtggaacccttcaggcccaggtgacctgcattctactttctccagcccctctcctgccctggcaagaagcaggactttgtagcagaaaaactcaggtgtagcggggcgggcagggaaggtgttaccacctaatagaatcaggaagctctaaataacgatgaagtgcacatgctgcagggggccttacaccatccaggctttacagctaaatcccagagaggttaggctacgtgtccaagttcacacagcaaattagggcagagcagggagtgtgcccagccctcctgactttcagtcccagggttcattcagcccatctaccctgagcaattgctggacacctgtgagcacatttcatagtcaccgcatctccacaaaagcgagaatcagaacacccatcctacagatgaagacctcaggctttgagaagggaaggctctcccaggacctttctcacccacctgaggccccacctttggacctacttaagggctcctgaaggtcccctgaaggctgggcctccaagcccaggactaaactcagagctgtgtggctcctccaggaaggacctccgaaggtccatgtcttcctgaacttcccatcaaccttctcattctaccagtctcacccaggagtcagctgcttgtgcacactggtgcctggaagtcccactgtgcactcaactagctagactgagaaatgagaacaaacacgcgctgcccggcatttgctgtgtgctgggactgaccacagctctcccgagtctcacaggatctccgtgaggtcagctctgcgatcggcctcatctcacagttggggaatgtcatgcacacccgtgactgagctcagctctgaaaacctgttcctctctcagttcccagcccggggagaggcaccactgtgctgagcaccaggagtcactcctggctcctcccacagcctctccccctacagcctgttaaatcgacctcctaacttagccactaacctgctctgtgaactgagactagtaactagtaatctgtcaaacaggataacagcccaggcccgggaagagttgcagggactcgccaccactgcccagctgtgtgaccttgggcaggagaacccacctcgctgggctgaggtttccatatctataaagtggggatgataatatggctcactgtccagggacgtggtaaggattcagtgaccccctccctcttgtcatgcctgagactttgctccagaaactctccccatacaaagtgctagtttttcttgaattttaaaagaacccttctctgagcacccctcccttctctgctgtcccgtttttctccagctgtccggtttttctccagcccttcgctggaacgccctgaaaacacacctattctcgctgtctccagagtctctctcccctcttctcccttcaatccactccccacagggtctcccctccccctcccgaggaaatgaagaaacttcgcgtttctaaacctgcccaatgccatctctcagacctccctatctggacctgtcagtagcatcagatgcagctaacacctgctgctccttcaaacgctgtcctcccctggttgtgagaagaaccctccctgccagttccctggctgccccttctcagtccattttctgcctcttcgccaatctctccctcacctctcaggctgggggccgtgggctcaatccctgggctgctgtccctttccatctgccttcctccctggctgactttaaagaccgattctctgctgccctccacactgatatcaacaacctggacatgccccctgagctccaaagccacacatccacttcctcctgcacagctcctccgggcttctccaggatctcctgatatttgcacatagatcggttccaccctcaaccctcctcatcccagagaatggcgactgcattctcccctggcccaggccggaacactggctgtcatcctcaaccctttaccccgtccatctctaactctctctcatctgtctctaattctttctctctgcgtctgtctccctctctgcctctgtctttctgactttgtctctctgtctctctccctctgactctgtcactctgactctgcctctgtcttatctctgtctctctctctgtctctgactctgactctctgtctctgtctctgactctctctctctgtctctgactctctgtctctgtctctgactctgtctctgagtctctgtctttgtctctgactctctgtgtccctgtctctgactctctgtgtctgtctctgaatctctgtctccctctgtctctctctgtctctgactttgactctctgtctcctccgtctctgacactctgactctctgtctctaactctctgtctccctctgtctctgattctgtctgactctctgtctctgattctctgtccctctgtctctgtctccctctgtctctgactctctatctccctctgtctctgactgtctttggttcagacactctgtgtccctctgtctctgactctctgtctctgtctttgactctctgtctcccccgtctctaacactctgtctctgactctgtctccctctgtctctgattctgtctgactctctgtctctgactgtgtccctctctgtctccttctgtctctgactctatgtccctctgtctccttctgtctctgtctctgactctctgtctctgattctctgtctctgtctctgactctctgtctctctctgtttctgactctctgtctctgtctctgactctctgtgtctctctctgtcttacatcccacatcactgcatcagtgaatcccatggactctgaccccaaacacatctcagtccccagagctgctcacaacccctcagcctcccctgggccagcctccaccatctcacctgcatcttcactccactgcctccctgttctgggggcttctgcccatgccgcctgcagtctactctccacccggcggccagaggggccccgtcccaggagagtcaggcccgtccctctgctcaggcccagcagtggctcctgtgtcactcggagaagcccagtcctcatagagatcttctttgagcctgcacacccccgaccatggcttctcctgcccagtctccctcccctgccaggctgaccccactgtagctcctgccaggggtgtttgcctcctggaaagttcttcccctagcagcaacagcagaaacatcctaccttctttcagggcctggagtaggagtctccttctggggaggcccagcccgtgccctgtctaccatcctgaccactgcctggcccttccccacctgtccccttctctcttctgtgctgtcctcacacaccacctatttcatctgtttaccatgtttgtcgtaggttctcccaggagggcagggctttgggcctgtgttcacgccgccttgcccgggcctagaatagggcctggcctgcagccgggagccaggctgctcgctcttggtgaaagagtgcccaggaggggcacagtgagggcatgcagggtgagagctctcagggcctgggcgcggctatggcaacgcagcctatgcctgccagtcccttggcggggcctgtggcctccctgccttcactgctgtccacggctctcactggccctgccttcctccggcctgtggccccactcagacccaccccattccccacaatggatgtcagaaaggcctttaaaaacctggatctaattatgtcaccccctcccctgagccctgcagtggctgccggtggccctcgggatcatgtccagagtccctgcgtggcgtgaaggcccctggagacccggcctcagccccctcccctgtctcttcctcccctgcagatctgcccccatctccctggaggtggcctgttctccacgccaccctcacaggctgcctggcggactctcctcacagcactgtgcttcccggggcccacttgtacaggccccatgcgagaaggacctcgggcagtgtataatcctccaagggcccacaggaacagcagtgacaactgtgttatgaagcacctactatgtgctggggacaagaatggaacaagaagacatgctttgccctcacccctggagggcagcttccagccagggaggcaaatacctcctccccagactccttccacagatccccaaactctgcctctctccttcagatccctgctcagatgtcaccagctctgtgcagcctccctgccaccaagtctaaaattgccatagtcccctcagttcctcacccctctccctgctttctttgtctgtctcatccatgaggatgtgccctctgggaagggcaggcaggagctggctattctgttccttgccctgtccccagcaccgaggacagtgccaggcatggaggaaataattgctgaataaagaaataaaatcgacattctatgagacataaagcacagttcagacacatggagtgaggggtggttccattctgactgcggtgatcccggtggtctctctgagtaggtggcattgagctgagacccagtgatgtgaaggactgagcgtgtgtggaggaagagtattccaggtggaggaagcagtaaatggcaaaggccccgagacagggctgagctctgtgtgtaagtgaggccagagttgagtgaaccaggggagagcggggtgggtggggctgagctagggagaagttttcctaaaccctttcccaggagagtaaactgaggctcggggaagctaagtgctaagtccaaggccacaaaacaaggagaggcagaaacaggctagacctgggtctgctggtctgaggggccctctctgtgcaccctgggactcagccacgctctacttattaatagctaagccaggtggggccccgctgggtcaggagccccaggtttaggctcagcccagtgacctccagggcaaagcccagtgagtgagcccatgaatggggccggctggggaacaactggaaccctggtctccctagagctgggccattggcatctgggggaagcccgatttgctggggtcggggctgactggctgggccattacccgccgggggcctagagcccacggggaagttgggccaggttgcccctgctagaaccttcccagagtctagagcaggtggccgtgatgccctgctctctgcggctgggactccaactactcctgtcccctccccggctcactgcctgtgggtcactcccgctgctcccagatggccatgctcattccctccctccacaggccttttgccctggctggtgcctctgccagggactcttcccctaatccttgtgtggctggctcccgctcctactcgcgccccagctcaagggtcacctcctcagaggccccccgaccacctgtctcaagcagccctgctctcacccccctcactctccatctgagggccctttaaggtctttcatggtatttaacaaaaatatcaggcatcacatgtattgtgggcttgtctattgtcaatgccctctcccttcactggggtgtaagcaccccatggatcttgttccctgaagtctcctcagggcccagcacagggcctgacactcagtagatgattaataaatatctgtggaatgagaacatgagcgtctaccccgcttattgtataaaagcagcagttgaggttcagagagggtaagtcacttgcccaaggtcacacaacaaaccagaggcagaaccacagcaggagcctggctcagctcacttgactctgcgtccagtgctcttcagcctacaccataactagcactcagagttcaaccagcctcaccccagcctttcaaatacaacctttatccctcatccccatctttcggtcctgggaagaaagaaaatctaagtagaagaggtggaagggggcaaacaagggagactaagtatcacaggtgaacaggtgctcaggattcctgtagtcccatgtaacagattccagcaaggttgggttcctggcctggggcctctgggcctctgggcccatggtccagtctcatccttgcctgcttgagctggaaagggttaaattttgtgcttggctcctgccttgctgtggaccgtggctgggacagaacatctgtctgttgctatggttgccatacacttgaaggggatggctggataattatggcaaacgccgccgagcgagtgagcgggtgcccggaagtggctcgggacccttgcccgcccagtgcagtggcaggctgtgggccccttacccactggctcactgtggagcccctggccctggacttgagttcctgagctagcagaggagtcagctggggccactttggcctttgcttcatgagtgagcctggctacagagccccccgtgaatcctggagcagggcagacaccagcagcactgggcaccggagcctgtgggctgtaggcctgctggcacaggtggtgggctcagataatgccctggtgccactgtgtcctcccccaggggagaagccctgtcatctgtccctgccatgaatgccccagagcccaggaggcagcaggtggagaccgactgcccacgtcctgtcctctcggctctgcctgctcgcagggatgcttcagcttcctcgtctgctcatggaggatgagagggcctccctggcagagctgaaggaggtctgtctggatagggcctggggaagaggtggctctgggacaggaaatggttgccccaaccttgctcagcagggggtggggaaccttaagctgccgtggatttagactgtggtcccgtggaaaggctggagattgcttggcacagtaaccagctacatgatttgtgcttggatccaacccttgcccagccaagctgtgggcaggcagaggggcttgcacccgggagggccagcccttccaccccacctcctccagcctcgccatggtaggcagctgagcttcctgaaagctcagtacagactcgcaagctggcagaccccagaggcccgagagatgctggcttccaactccttctgtaaccaccagtgagacagaggccgggcaccctccccaaggtcaccctcacaggttcctggctcttccccatgctgctgccccctctcctggcaacttccctcctcccatctgcctccctcacataacaattgcagtcataataactgacaccatgccgggcactgagctgtgtgcacacggcttactcctttaacaacctacagggagggtgccatttttaatgctgttttcactgggagattattgaggcatgcagcagtaaagagagctccccaagttctcctggctgggaagtagtacagcccagaagctccaaacagggccactctggacactgactccttttctttccccctcccactaaagatgaccccttgagagccaagatggtcttattcttctgtttctccagctctgttcacagaggaggcatggatgcacatttaactttccacgcatgcattcattcaatatgcactgagcacaggcgccgggccctgtgctgagtgaatcagtgaaccctcttccccacattgggctatccagaggctcaaaagacatttgccccagggcacagagattcaaacgaaggatgaagttactctggcagccattacctcccagcatctcccattggcctgaaaggggcagggcagtgaccacaccctcatgttacagcagaagaaatgaaagctcagagatatgaggagccctgtcgaaggtcatacagccatgtctcaggtggggcagcctctggaacccaggaattctgcaccccacagagctcggtcagcagagaagactgcctgcccaggcatggggatgacttcgctcttgatggaatcccagtttgcctgggaccatcacagtttatacccctcagtctcaggcaagctggacagctggtcatcctaactcaggacctcccaagtgccacaagcccaggctttcgggtccagctacctggtctgggatccaatttccctcccttccaaagactaggatcttggataagggagggctcctctgagcccctggtcctccctcccccacccaaggacctgtgggccccgcctcaggctgccttaacaagttgaagtcagtaggcctatgccagaggagccaccaggcctgcccagttccttagggaatgttggctgagcaaggaggcccaaggcctccttaaagagacaggcacaggctatagccaagctccacatatttaacaggcagctcctgtgagccatgaatcagcatcccagggccctttggacaacacagaagcattttcccagccaggtctctcttgcagctattggggtgagggtgggggtgggacaaggaggcctgcgagaaggggcctgggcacaggaaggctgctcctctgccagctgcagggcttccttggggatctataggtgccaggcacagttaccaagacacatggagaaagggctgcagtgggaggcatgaggcctctctggctccaggcttgatcctcctgctgcctagtcatgtaatctcagatgggcccctgagctttcccaggccttactgtccctggaacaatggcatctggcctctgcaactgctaagcccccttctagccttgctaagatccactgactgaaaccagtcttccagattcccagtgttagctggctgaatcctaggccttctggtccctgggtctcaacactcagcctgatagagtagatgctgaggaatgcacagtagaaagatggatggatggatgaatgggagggtggatgggaggatggatggatagatgaatggatgggtgggtggatgaatcaatggatggatggatgaatgaataaatggacagatagatgcatgcatggatggatggatggatggatggatggatggatggatgggaggatgggtgggtggatggatggatggatggatggatggatggatggatggatgagaggctggctggatggatgggtggatgaatgaatgaatggatggacaggagggtgggtggatggatggatgaatggatagatggatggatgggaggctggatgaatggatagatggatggatagatggatggatgggaggctggatgaatggatggatggatagatggatggatggacagatgggagtctggatggatgaatcggtggaaagatgaaaggatgggaagctggatggatgaatggctggctggatgaatggacaaatgcatggatggatgagaggctgactggctggccatttggctggatggataggagggtgcataggaggctggctggatgaatggataggaggctgggatggataggtgggtggacggatggatggatgaatggatgaattaatgaatgaatgagtgaatgaatgaataaataagtggatggatggatggacaggaggctggctgatgaatggatgggaggatggatggatggatggatggatggatggatggatgaatgggcagatgggtggatgggcagatggatggattaatggatggatggacggatgaatggatgggaggctagatggattaatgggggaatggctggatgaatggacaaatggatggatgagaggctgactggctggccagctggtgggctggctggataggaggctggatgggaaggtggatgggtgaatggatggatgggagggtggatgggtgaatggatggataggaggctggatgggagggtggatgggtgaatggatggatgggaggctgaatgggagggtggatgggtgaatggatggatgggaggctggatgggagggtggatggctgaatggatggatgggaggctggatgggagggtggatgggtggctgcatgggagggtggatgggtgaatggatggatgggagggtggatgggtgaatggatggatgggaggatggatgggagggtggatgggtgaatggatggatggagagaagggtccctgaactggtagactccttagtgcccagcatgagctctgcctgattccacttaggtaaagggaaattcaatgggcaaatgagtccttcactccttccttgctctcagttctcatatccactctactcccagagcccatctattttacctctaactctctctccaactcccctaccacctcccaacaaaggccactaccccctctagcctggacaccgcagcacccatctcactaggctccctgctgccttccaaaccctacttcaggtcattctctgagggcagtaggaggagttatgatgtaaattagcacctacttcccaccgcctcaaatctcccactggctctcctggagctcctaactgggactgagttacctctggacctcatcttccactgccttcacgcaatctccgatccctctgtgctctgctattaagtggtctccttgctgtctccaacaggcaccatgctctcacccactccaagacttagaacactcctctgccacccatccccagcctcagagccaacatacccacatttcacccacctacttcctactccccttcagatctcaagtcagcagccacttccacaaagaagccctccttgacccccagcctggacttttattttacagctcttcttacagctgcaggcatgtgcttgcatggttagtaacatctgtcccccaggacacaaaccagcatgggcctggggctctgtctgtcccattccccgctaggcccctgtacctagcatagcatctggcactaagtcaagctcattgagtattagtttatttattttaaatataaaggttttaaataaactgcacacaggctggagtgcaatagtgtgatcatagctcactgtagcctcaaacttctgggctcaagaaattctcctgtctcagccccccaagtagctggaactactggcatatgccatcatacctggctaatttttttacttttttttttttttttttttttttttgtagagacagggtctcactacgttgctcagactggccttgaactcgtgggctcaagagatcctcccttggctgggtgcagtggctcatgcctgtaatcccagcactttgtgaggtcaaggcaggcagatcacctgaggtcaggagttcaagaccagcctggtcaacatggcgaaaccccatctctactaaaaatacaaaaattagccaggcacagtggcacacgcctgtaatcccagctactcgggaggctgaggcaggagaatcacttgaacttgggaggcaggggttgcagtgagccaagatcgtaccgctggacttcagcctgggtgacagagccagattcttgtctcaaaaaaaagaaaaaagatagagatcctccctcttcggcttcccaaagtgctgggattacaggtgtgagccactgtatttgttgagtgaatgaatgaacaaatgaatagatggaagcctgcatgaatgggagggtgaaggatggatggagagaagcagagtaaggagccaggagggagagggtgagggaaaagctgttttcacagggtggctgaaggtggaggagccattctcaaaggaggtaacatctgagaagaatcgggggccatgggctatggctcacgcctgtaatcccagcactttgggaggctgaggcaggaggattgtgggaggccagtagttagagaccagctggacaacatagtgagaccctgcctctacaaaacatgaaaaagttagctggtcgtactggtgcacacccgtagtcccagatactcaggaggctgaggcaagaggatcacttgagcccaggagttcaaggctgcagtgaaccatgattgtgccactgcaccccagcctgggccacagagcaataccctgtctgaaagagagagagagagagagaaagcatcaagggggaggagggaggggccttgtgagcgctggggcagaggacacggcattgcaaggatctgccccacctggggccagcacacatctggtacaaccaaaggacgcaggagtaagcaaggaggagcagggtactggagaggccagcaaggggtcagcagagcccctgggccctggggctggtcccaagggtgataggaggagccaatcaagggcctgggacagagcaagactttgtctgactttctcccctgagtagaacataagttcagggagggcaggccctggtgtcttgtttgtggttgtgtatgcacctagtgctgagttcagtgagtggcagagtggattctacaccggcgtcggaggacacatctgccacccctgctccccaatacaacccatttcctgcccagcagtcacaggggttcttctaaaacaggtggtgtctttcctctgcttcaagccctctcctggcttctggatcactcagaggaaaagctcaaggccttgtgatggttcacaggccctacctcagggattctcagccccagcactagtgacacttgggccgatgactctgttgtgcagcctgtcccgggcactgtaggacgtttagcagcatctctggcctctacccactagatgccagtagcacccactcccagtggtgacaccaaaatcttcagatactaccaaaggtctcctgggcgacaaagtcttccctactgcagggagaggagggatggaggagacctctgtcctagacccctactgaaaatagcacccccaacacttcccaccctggctcccagctttattttctccatagctcctaacagcatctgccatttctttgatttatttgtgtgttcagttggtctgactctcaacctagaatgagctccctgagggcaagtcctagcttggatctcccctggggcagcacaaggtgatctccctctgtttgcagagatgatgccttaatctcctgaatttggatcctatctctttgaattcggattgtcactccctgtttgacggaagaaaaaactgaataagaaaaaaaaatggaggctgggcatggtggctcatccctgtaaccccagcactttgggaggccaaggtggtcagattgcctgaggtcaggaattcaaaaccagcctggccaacatggtgaaactccgtctctactaaaattacaaaaattagctggctatggtggcgggcacctgtaatcccagctactcgggaggctgaggcaggagaatcgcttgaacccgggaggcagaggttgcagtgagccgaggtcgtgccactgcacttcagcctgggtgacacagcgagactccatctcaaaacaaacaaacaaacaaaccaacaggatcagagaggttgggtgacttagcccaaggatgatcggcttagcctgtgatgctgacaggactgaaacctagggcctctgcctctaaatctcagttcatttgactctgtctgtgtccctgacaggcctcagcctgggacagggtgggcaacgaagaggccagagcagctgggtcccaggaaatgagcactccattggggctcgaacccaggaccacctggatatgaagcagatgagagatctccccaccaggcatgagagttgggggagcgggggggcggttattgctggggatgcaggtgaaattattccagtgattcattcatcctaattgacaaggttctattgaattccttaaaagccccaggctgtgcattttggaaaacatggctgcagtgcactgggaaatgtcctctgatatcatgcaggacagcagacactctttaaagacaaaagttgggccagggacagtggctcaagcctataatcccagcgcattgggaggctgaggcagtaggatcacttgagcccaggagttcaagactagcctgggcaacacagcgagacctcatctctaaagaaaacaataaaataaaataaatcaaccaggtgtggtggcgcatacctgtagtcccagctacctgggaggctgaggcaggaggatcactcgaacacaggaggttgagcctgcagtgaaccatgattacgccactgcactccagcctgggcaaccaagtgagatcttgtctcttaaaaaaataataataaaataaaaaaatgaaaaataaataaaaaggataaaagtttgttgaatttacccagtatacattccaattggggtgggatgctcaggagaatggggtgcaatttcctgaagaagagaatgagcttttcataaattaccaggaggaaaatagtgcatgtcagaataaactctgtcaagaaatacagcagggcagccggacagttaataattcagagctgttccatagcactcctcgggatttaaaaaatatttccttgggattgttgcttaaaaatactgttaatggccgggaaccttctcattgtcattaatgggccagctgggtggggctcctggtggtcccccaggaaaacaccagggacacccatctcattttcctcgcagagcccaggatgggcggtgaggactggcaggctcagagggggcaaaagtccagccccagaccacacagctaggaaatggtggctggagctccaatgggaacccaggttgactttcaatgactccaccctgactccgggcaagggtttccccttctctgcacttccagtttcctcatctgtaaaatggggacccatgtattagctcagagaacaaatatttatggagtacttgattttttgtttgttttttgagatggagtctcgctctgtggcccaggctggagtgcagtggcacatctcggctcactgcaacctccgcctcccaggttcaagcaattctcctgcctcagcctcccgagtggctgggattacaggcgcccgccaccacgcccggttaatttttgtattttttagtagtgacagggtttcgccatattggccaggctggtcttgaactcctggcctcaggtgatccacctgcctcggtctcccaaagagctggaattacaggcatgagccactgtgcccagccggagtatttgtcaaaatccaggtgttaggatggacggtaaccgaaacagacccagtcctctcacttcatggaactcggtctggtggaagagtcagacagtgaccaaatatatctcctcaaaaatggtaatcggtatatctagaaaacaaagacgagtaaagggacaggggggaggggggagatttcagttaggataatcaaggagagcctccctgggcaggtggcaattgatgacagacctggaaaaacagagagggagctgagaggctttcagaagaagagggcggtgagaaccgcaagtgcaggggccctgggaggggctttgcctgcagtattggaggaacagagaggggccagcgtggctggagcacagcgagccagcgggagagaggtgggaggagaggtcagagaggacggcagcggccagctcctgggagaccctgtagacgtttgaattttattctaagaatgatgaagatctgccacagggctggtttgcaggggatggattggttatctattttattggtttatctatttattggattggttatctattttaaaaagatcccctgaatgccagacacagtgggttgtgcctgtaatcctagtgctttgagtggctgagatgggaggatcacttgagggtaagagtttgagaccaacatggacaaaatagcaagaccctgtctctctatatatatgttttttaatttagaccgggcacagtggctcaagcctgtaatcccagcactttgggaggccaaggcgggtggatcacctgaggtcaggagttcgagaccagcctggccaacatggcgagagctcatctctactaaaaatacaaaaaaaaaaagacttagccaggcttggtggtgcatgcctgaactcccagctactactcaggaggctgaggcaggagaattgcttgaacccaggaggtggaggttgcagtgagccgagattgcaccattgcactcctgcctgggtgacagaaggagacaccgtctcaaattaaaaaaaaaaaaaactatgtgtgatggtgcacacctgcggtcccagctattcaagaggctgagtgggaaggatcacttgagcccagaaggttgaggctgcagtgaagtatggtcacaccactgcactccagcctgggcgacagagcaagaccctgtctctacaaaaaaaataaaaaataaaagaccctctgaaaagtctccagattaaattgtcaaatgaaaaatgaacaggacagaaccacatgcacagtatgctactgtcggctttaaaaaaaaaaaaggtatgcattgtatatacataaaattatctctggcatgatagatgaaaataggagaagctgcctgcctgtgaggaggagtcctggctggctggactgggtgggagggatcatttctacattttttcttgcaccttttgaattttgaaccatgcaaatttgttacctagtcaaaaataaataaataaatactttttggaagtaaagaaaaaaagaaaaaagaaaatgaaaaagaaaggcccctctggctgccgtgtggataatggattatagattcaccagggtggctggggtgggaaggaggcttgagtgagttggtggggatgaggctgggggtgggatagtggggagggggctgaggtggggaggaggctggggtaggttggtggggaggctggggtggggaggaggctgggggtgggatggtggggaggaggctagagtggggaggaagctggagtgcagaggaggctggtgtgggttggtgggaaggaggctggggtggggaggaggctggattggtggggaggaggctggggtagggaggagactagggtggggaggaggctggggtggggaggtggggagatattttcagttccactgtgtagatgaggactgtgaggctcagacaggccaaatgccaagctgcagacctttcggctggaaaatggaggatgggcttggatgagaacccaggcccatcagggtcctcattacctcccttctgttctctgctatgtgttcccttgaggccccggtatgagggatttggttccctgggtcccgtacctacagcaagatcttgaccacaataggtgctcataaatgtttgctgagtgatgaatttgctcatttgatcattcattcattcaacaaatgtatcagtgactcctctgtgccaggcatggtgctagggccctgggattcagccttgaacaagagaaagctcccaccgttttggagctcacattctcagggggcaggggtgtgacaggcaatcaagatatgtataatatgagcactaagaagaagagagcagaccaattgagaggggaggtgccttcagatggtcagggagggctcggaggaggagggcatgtgacagtagagacttgaagaagtgtgggttgggtgcctgtaatcccagcactttgagaggttgaggtgggaggatccgttgaggccaggagttcaagaccttcctgggtaacagagagagactccgtatctaccaaaaagccgggtgtggtagtgcacgctgtgatcccagctactcttggaggctgagatgggaggatcacttgaacccaggaaggtggaggctgcagtgagccatggttgtgccactgcacttcagcctgggcaacagagtgagatcttgtctcaaaaaaagaagaaaaaaaaagcggtgtggagtttgccccggggacactgggggaaggccattgtaggcagagggaacagcaggtgcaaaggcatgaggtgggctcgtgcttgaaatgtctgagcaacagcaaagaggggcagtagagtgagccagggggacaggcagccaggctaggccatgcctcgtgggtgctggattcctccggggatggcagaaggctatggagggctctgagcaggggcttaacaggctccgaacgaggtttaaagcgaatgaagctgcgccctgtaccatctgtggcgtggggaccgtggcggcctaagctgcacaggctgccttgcaagattctgggagaagaaaatctcagagtgctgaggccagagggactgccccaccctgcaaggatcttgggtgttctggaggggacctggcagtgcagacagagcctggggttcatgtcctgactctaccacctcccaggcgcagagctcaagactgctcctgggacctccgctgtctgccttgtcacagggggacagggtcagggagggagaaggattcctgaaggctggcgatgcttggtgtcccgcagtgcaactgccagtggcagagcccgacccgggcagctgaggcccaccaggaggaagcaacggcctggaggccgaggggccaccgccacctccactgcccgtcgctgcagtcctggctctggctccggaggcctggctgtggcctcctgtgctttcaccatctgtgcactgcgctggccaggcgtgccctgctctagggtgcccatctggacgccaagctgacagcacatccggctcgagcagggcatcttacaaaccatcgttagacctgtcaggcttccagcaattttgtttggttttggtttggtttggccccactcctctcctagggaagggagaggtcagggaagggagaggagaaaggagctcaagcttcctgtctactctttctgggctggccaacactcaccatctcattctgtcttctcagtccccattgacaggtggggaaactgaggctgaaaatggtgactgtccaaggccacttgagggttaagtagcaaagccagaagttaaatccagggctactcttggaggctgaggtgggaggatcgcttgagcccaggggaaggtcaaggctgcagtgagccatggctgtgccactgcacttcagcctgggcaacagagtgagatcctgtctcaaaaaaagaaaaaaagaaaaaagcagtgtggagtttgccctggggacaccgaggcaagggcattgtaggcagagggaacagcaggtgcaaaggcatgaagtgggctcgtacttgaaatgtctgagcaacagcaaaggagggcagtagagtgagccaggctggaccacgcctcataggtgctggaccttctccccagtcccagttcccactggcacctgactcctggtaggggcttgggtgtgggtggggtagagaaaacagcatcctcattccagattctgggccaggaaaggctcctggccatggttcctctgtggcggtggggaagagggccggcgggcaggctgtgctgtgagcctggctccctcctccctgtggaggggccatgaccccggctcaggtgacacagcacctgcagcacgagccgccacctgcctggcctgctggtgacaatattccccgagcagcgggcaggctagggggcctcggttcaccggcccagcctcgggaagcccagagagagaggtcaagtgtgctgctgccaggcttccagaagcttctccaatttctgcggtcccagcaacttttggtacggatctagggcagtctgacccctgctggacccctcacaaatgccgggtcccgtatgcacacttgaaggtcgctgccaccacgagcaaggccttctgcccttggcctgttaggggccttggagactctggagaaaacccccagtggcaccactgggcccaagagccaccagcagccagcgccattgtcgccactgtgggttaagaactaccctccctctactgtgggttaagaactaccctccctctcccacttaccttttaaaaaatgcctataattttacaaaggagaaaatgtgaagtcttttttttttttgagaccgagtcttcctctctcccctaggctggagggcagtttggacgatcttagctcactacacccccacctcccgggttcaagcgattctcctgcctcagcctcctgggtacctgggattacaggcacccgccaccatgctcgaccagaaaatgtggtcttttacatatcaaggaaatagtaactggctggaaagcaggaaagagcatcaactccctattagactcatcggagccgaactccctgttagacttatcggacccgaactctgatcttgatctgcacttcaaccagtggcctcagcccactcccctggtcttgcatttgtctcactgtctcccctaaagacatcccttcctccccttcaccaagcatgtcccccttggggtcagccctcgcctggactattgcagtagcctccaggctagtctcagctaccctgtacaccctccaaataggccacagagtctttgtctcaaacacaggccagacctcctgcccttactcaaaaccctaccatgggcctctggtggccccaggattaggtcttgacaccctagtctggccttcaggatccttcctgttccagcttggcctgtctctccaacccaccccttaccaccccctgggtcattaagagcataggctttgtagttgctgtgtgaccttgggcaagttacttaacttatctgaaccttgatttctcatccatgaaagtgaaataggtctctgccacaaggggagcagggtttcaattgtgcgattccaataatctcatgtgtgtagcactggactaggatatacagtgggtgctcaataaatgtagctatccttatttgtcactaccccatgaaacgactaaaaatctcccacagcatactctgcggagcctatgcagatgctgcgtcctctgcctcggcagcctagtgaactcctattaatccttcaacacccctctcaggcaatgccctgactggcctggtgtcagctgtcctttctcagaaccctcctccatattggccagattgctgcactagaattcttccctttacttgtcagtcttccaccatatgactgtgggttcctaggggcagtggctataaatgacaaaactgagccagccagggagggctggggtgatgagggaaggggtatgagacaggaaggagggaaaggtggagggagagaggctctgtggttggccaaggcagaataaagctttcattcaatcatttgttcattcacccattcattcaacacatgcatactgacctactctatttaaagccccttgctagctttccccagcttctagaatcactccaaaatctctcggccaggtgcagtcaagtattttgggaggtcgaggtgggaggatcgcttgagtccgggagttcgagaccagcctgagcaacatggcaaaaccccatttcaaaaaaaaatacaaaaattagccaggtgtggtggcgcacacctgtagtcccagctatctgagaggctgaggcgggaggatcacttgagcccagaaagttgaggttgcagtgagccgagatcgtgccactgcactgcagcctaagtgacagaggaagactgtctcaaaaacaaccctgtcctccatgggtggccctcgaagccccaggaacccagtcctccccagtggaccgctccaccctcagtctccctgtccctttctgtccctccctgtgctccaggactctggctcccctttggttcctcaagcaagaccaccttctagaacgcccttcttctgacctttccaggacgacccccaggacaggcccctatcactctgtataaacagggtctcacccccacagcgcgggttccgcctcagtcctgtgtctcctacctcattctcacccagcccacgcccagacgcacttgtgggatcaggggattaacacccaccttctcagtaggctgcgagcttcccacttcccagcatgcctgtggtgactagcgcccacccggagcgccccaggagaccagagccaaaagggaccttggtgagcatcgaggtccgcccccacgtgttgtaacaacaataataaaaaataatatttccaacaacaacagcagcagctaacactgcccacgtgccaggcgtttcgccttccgtgcagtttcctcgaatccacgcaacaaccccatacagagagctccagttccatccccatcttacagaggagaaaactgaagctgggcaaggctggccaggcccctgggttgcaggccctgcactcttcggtcaccactaggctgtgctgccagatgaccatggtggcaacactggacggggttggggctccacagacttgagctctgtgatcccaaacaagtcctagacctttctggcctcagtctccccatctggaaaatggagctaaccacagtctcttcatcagactgaatgttcacaggagggagggactgtcagggcttccaagtacagagagaggggacgggtaccatgagggcaggattatgggggtccccagggcctcccccacaggtaaagccccacccaaagccagttctgcccaaggcctgctccaagaggacccctgcaaggcagggtgagtggagtcctccctggggagtgcccagtgcccacacactcccttctagagaaagaagacagcactgtgcacaatgagaccaggggacccggggtgtgtgggggccaccaggtggggcacagcacaccctccactgaaccctgagccatggggaccctgagcgctcccagccctcctgacacctgcttccccttgccacatgggccctggcagtgggaatggggcgtctgccggagcctctcctgggctgtgccaacctccctatgcccagacaaagcccccctcccccggcctccggggaaggggtgggccagtgagggagctgacaaagggagccagtggggctgtgcctggggctcgtgccaccccactccccgacctgcccacagtgcccacatccccctcctgccacttggccggctggggcgcccggcaccgttgctatggcggcagctctggggaagctgcagctgggtaattattgcgaacatccatcctgcctccagcccgccccaagagccgggcagcgagcagcggggccagggcagcccctcctcacccgccgggcagccgcaccctggcctggcacgatgcctgcccgaggtacagtggggaggacagccatgcaggctgctgcagcagacaggagccagcccaggggctggccaggaaacccccactttcgccctggccccccagccctgggccacccttggagctgaccggccggcccagaacttattttttccagctataatacacacaccaaaccagccagagaacctcctttgttcaaacagaatccttcctctgccgttttgggggcagtggaagccaaagcagccagaatgggctctggcctgtcacctagggacggtcccctcgatgaggcggttcccctggggccccactgtgggccccgccacctcctcagcctcagaagctcgccttggccctggtgtctaaatatagctctgccgggccaagcctgaggtctcacactcccaactgccccgggtggccgggggaggagattcattcaggcctcgagagagcatttcaggagccacttagggctgagctcagggcccccactgtgacgcaggtgtgcctctgcctgtggggcttgcggaccccctcaggagacacacagatatgattttgagtagctaactcgatcgagaaaacacagaccaggactcccctcgcccagcctggaagcaggatgcgtcagggcgggagggaaaggaaggggtctaggctggggaggggaggcaccaaggggagagagaggaagtgtggtctggcgctggaacagatttgtgtggtagaatgtggggtgcgccccagcaggacatgggctagggagcagtggccgggggtcagcagggtgcagagcacagggatgccgtctcttctccttttggctccactgcccctcagggccctgcacaggctggcactcggcaggagataccgctcagatgttattttccaaagaatcccgaggccgggcacgctgactcacgcctgtaatcccaacactttgggaggccgaggcgggtggatcgcttgaggtcagttcgagaccagcctggccaacatggcaaaaccccatctctactaaaatacaaaattagttgggcgtggcagtatgtgcctgtaatcccagctactcgggaggctgaggcaggagaatcgcttgaacacgggagagtctcccggtgagctgggatcacaccactacactccagcctgggcaacagagcaagactccatctcaaacacacacacacacacacacacacacacacacacacacacacacacacacacacagagagaatcctggtggccagagtggaagtggaggcagcacaaaggagggggacaaggtggcgggagcagcaaggggccacgggcgaggcaagggtcccctggagctgcaggtgagagaggaaaatgaaggagaatccacaggacatgggggatgagagcaagggaaggattcaggctgcctgtgcccctccccagaccttggtcatcgagccgctgaccagggccctgcttgggggacagacactctaaaataaaagggtaaatatctgttgaaagagagcccggcccctgctcaccaccagacattagggcctcggggagaaggccttctgctcagctagtgcgggtggagggagagcagcctggtccctggcacagccttctgggtagggactgtctcagcctcaatggcctttggacctcccactttcagtcccagcaataaatcttcccaacagcacacggttttctacctgaaaagctctttccatccagcatcctctgctagcttcaaacagccctggcactgggccaggcagggaggcacagccattgcagaggtgaggaaactgaggctcagagaagtgaggctcagagatctgcccaggcatggaaaggggagggaccatgactaagcacccactaagttacaggggcctttgcaaacatcacctggggctgcagctagaaggcggagagtagaacttgaagtcaggagtagaacttgaacttccgactgattccctggtcctgggctcccctgtcctcctgagacagaggctaataggagccaagacggggccattccttttagcaccatgttttctgagaatataagctggagagggtggggcaggaggtctgagacaaacaaaactgcactttggaattatccagtctgactgcaaccacctctatcttacagatggggaaactgaggctctggcctggcccaggcccaaagaacccactgtttcccagatcttggagtagctgagactgggtaagtaagtcccactgatcccagagctctttttggatccagctgtccacacagcatctggggttttaattgggtattttggggaaggattctgaatgcaaatttggaagagagctctgggccagccctgcagctaatgtcagccatgggaactcacaggccactgggttagagtgatgtggatcaggtgtgatgcagaggagcatgtgagaaccagcaccagccactggtaggactcgcattagtgcaagtgaccacaatggtgggtgccaggcaccataagggagaagatggtggtggggccttcaaagagtgcctggagcgtggcgaagcttccgggcggcgtggcgaggcttccggacgtcgcactacgactgttattgtccttgtccctctgcaccagatctccatcctggctgtttttcacagcgtccccagaaagactctgtgagggaaggtctattattatctccattttcaggtcggggggcatttagatgggagagaaatttggggactgggggagttcttccccttctccctgaaattgccccaggccggggaccctgtctcccacccaccaacagggcaagccaagatggttgaaaagttctccttggcccagctttaaaagccaacccaacagagtgattggaagtccaagagtaaggagagcttagtttggacttcccagaaggcaagtttttatataataccgatcacaaatttggtacccgtcctcttcagtagtgccaggggttcagctgggtacctatcttggagaaactgctggagtgcacagtgaggcctgttcagggctgtgtgtgggagtgaaataatggaaatgtccatttataggccagagggcaaataaaggatggaccagctcacacacagaacactgcacagcacggaggaggaggcaggtctgtatgcactgactcagaaatgtccatgacacgttgttcagtgaaaaagaaggcattggccgggcgcggtggctcacgcctgtaatcccagcactttgggaggccgagacgggcagatcacttgagcccaggagtttgaggccagcctggacaacacggtgagaccccccatctctacaaaaaaaaaaaaatacaaaaattagccaggcctggtggtgtgtgcctgtagtcccagctacctggaggctgtggtaaaaagattacttgggcctgggaaagcaagggtgcagtgagccgagatcacaccactgcactccagcctggggaacagagtgagaccctgtttgaaaaaaagaaaagaggaaaggaaggaaggaagggaggaaggaagggaggaagggagggaggggaaaaaaaaatagcccgggtgcggtggctcacacctgtaatcccagcactttgggaggccaaggcagaaggatcatttgagctcaggagttcatgaccagcctggccaacatggtgaaaccccgcctctactaaaaatacaaaaattagctgggtgtggtggtgtgcacctgtaatcccagcgacttgggaggctgaggcatgagaatcgcttgaacctgggaggcaggggttgcagtgagccaagattgagccactgcactccagcctgggcaacagaatgagtctctatctaaaaaaaaaaaaaaaaaaaaaaaaagaaaaaaagaaaaagaaaaagaaagcatcttgcagaacaaaacatacagaatgttactactcacgtgagacgcatacctaaacacaatatgcacatctaaacagatataaatatagatagtctaggtataggtgttggtacaggcacgacacaggcataggtagtggcataggtatagttacagatattggtataggtattggtataggcatggcataggtataggtatatacactgaccagctgacaacaatggtttaaacagaatggggctcaggaggtaaagaggaattacatggccttttattcactacattttattaatgtttgagattttacaatgagaatattttcctgaaatattcgtctgatgctaaaaattaaagaagaaaagcagctggccacatggctgggagcctgaagcagggctcagtctgggcgctcataagaggcagggtctgtgggggtcaggcctgtttggtagtctcaagctacatctggagactcttcctaaatccactgtggctccctctccccaaggccagagccagagagagctggtttccacagcagcagtagcatacgcaggtccctgcaatctggaggtatgtgacaccgggacatttaccctgtgcggtgggcccacctctgccacctctgctccttgaggcagggcaggacttcagaattggccagagggcgacctgagacatgcaggcagagaagggagccagtgacctctaggacccccagggcttaggcaggatgccgcgtggaacccagagcagtctccccagcctgggcttgcatttgagcctcacaaataccgcactgggggaggcaacagcccgtctgtgcccctgcactcccagcagtcagcaaggtcaggagtgggagaggggagaaggcctttcatggagcactccttagatgctgggccctgagctagacacatttcctactccctaactttggcctttaaatctcgttcagtgagttctttttgacacatggaagcttgggaagtttttcggccagctactgaaaacaaaggggtaaaataattcaaacaaagcaaagggatgtacagtgaaaaacaagtcttttctcctcagcccccagtccccgcccgggagaacccatgtgcgcactggagcacatgcacgtgtgttcctgccccctccttggtactaacagaagcgctccccacaaagtgcgctgtatctggcctttttcacaaaaaaaacatgtatctcagagcttcttccacagcagtacacgggaccgcctcgttctttttcatgcctagaattccatggcatgcaaaagtctttagtattcatgtaaccagatctagaattctggctccatggttttctgccttttccataggcttatttctgttctgcacaacagccctgggaggcaggtggtccctgtgttagagatgaggaaaccagggtgacgggattagtctgttctcacgctgctgtgaagaaatgcccgagactggggtaatttataaagaaaagaggtttaattgactcacagttctgcgtggctggggaggcctcaggaaacttacaatcatggtggaaggcagctcttcacagggcggcaggagggagagtgatactgagcaaagggggaagctgcttataaaaccatcagatctcgtgagaactcactcactatcatgagaacagcatgggggaaactgccaccattattcaattatctctacttggtcctgctcttgacacctagggattattaaaattcaaggtgagatttggtggggacacagagtcaaactatatcagtgactcaccatcccagtttgcctgggactgtgccaggaaaaccctcagttttggacaaaccaggatggttggtcaccctaaaggtaaactgaggcttggagggtaaggacattctccaagatcttgtggttgatccgtggaggcctgggatggccactgaagtccacctgatggtgatgatactctaggaggacaatgatcatatagtaagtgtctcctctgtgcctgccccttcttcagccctcataacagccccaggaggcagacaacgaggcacagatagaacttgtgacaggcgaactggggtcagatctcagcagcagggcttggctgtgtgaccactgtggtcagctccttctcagcctcctgtcctgggcccacagcagacatacaacaaatgtttgttgaggggaaaaaaaggcatgaatgaagtattattatcctcattttatgggaaaaactgaggcacaaagaagctgtccctggcacagggtcacaatttgaacctggacaggggctccagagcccatgacacgtttccctcttgtagaaggtccttgtctgtaacctggtggtgcctcctgcctctgactcctccggccagtcgccctgacagccccctcaccgcgttgcactacctggtcccctggtcccagcctcctttcatggaaggaggtcttgccgtctgcctccctactcctgacttggggcccctgctctgaaccttccaccccgtccgcctggactggatgcttctcccggatcctgatgcctgagcttcagcttccccactccggactgtttcatgcgttcattcatgtgtccaactcttcactcctttcctcaacaaacattgactgaaattgaaatgagccagttctaccccggtgttgggaattccgagatgaatccagcctgagctttgtccttgggggacacagaaaacaacaaagaaatggcacttgttacccagagacccagagagatgcagctctgatggagatggcgcaggcacgggctgctggggcttgagttcaggggttggggggaggttcctagcctgggggctctggaaaagcttcctggagaaggttatgctggagtctggaaagataagaaagaattagcaagacaggcattgggaggggaggcgagaggtactgtgacatcatggacaaagcggtggaagacagcgtgagacattcaagaagtgcacgttgttccttacagctgggtccaagctgtcctcaggtgtggacgcgtggctctaggaagcccagcaccctcccgagtacctagccagctccgggcccagcagggcttccgagaatttcatgtccagaaatttatcagaaaaaaacacaacaaaacaatcagcaatgtggacatgaagttacgcaggacggaggatgtttactgcggtgtttttatcacagaaaacgagtgaaacagcctctgtgcccagccacgagaaggggccacacttgtcaaagggccaccaccggctggagtcatccaaaaggctgaggagtcagatttcagagactacttaaaggcaccagacaatgcatctgatgtaactgtaggtaaaagacagcaagaggcaaactattttttattaggagacctacatatgcatatatatatatatatgaaatgatattaggaagaaatgtgtcaaatgcttcacagtggttatctctggtgatggactaacctgggggttgtagttcctttttaaaaataatttcagccagacgcggtctctcacacatgtaatcccaacactttgggaggccaaggtgggcggatcacttgaggccaggaatttgagaccagcctggcccatgtggcaaaactctgtctctaccaaaaatacaaaaattagccgggcatggtggtgcatgcctgtaatcccagctactcaggaggctgaggcaggagaatcacctgggaggcggaggttgcagtgagacaagattgtgccactgcactccagtctggggaatagagtgagaccgtgtctcaaaataaataaataaataaaaatgggccagacacggtggctcatgcctgtaatcccaacactttgggaggccgaggcaggcagatcatgaggtcaggagttcaagagcagcccgactaacatggtgaaaccccatctctactaaaaaatacaaaaattagccaggcatggtggcacatgcctgtaatcccagctactcgggaggctgaggcagaattgcttgaacccgggagatggaggttgcagaaggccaagatcgcaccactgcactccagcctgagtgacagagtgagattccatctcagaaagaaaaataaataaataataataatcatttcctcggctgggcaccatggctcatgcctgtaaccccagcactttgggaggctgaggtggggggattgcttgagcccaggagttcaagaccagcctggacatgaggataccttgtctctacaaaatacaaaaattagctgggcatggtggtgtgtgcctgtagtcccagctactcgggaggctgaggtgggaggatcgcttgcctaggtgacagagcaagaccctgtctaaaataaacattcctgtgttctctgattttgtaatggtgggccagtctcacattttcattttcagagacagattctaggaggcaactccatgaggccacaacttctctttccagcatcctcctgagccatgcctcccagcccagcaaaaacccccagggagccacccggaatgacgtgtcgtcctcccatcccgtgtacagtgagcccacgtgctctgactcctgccgttcctgtctgaatgccctctgctttctctctccatctggcacagttcccccagcccccaggcccccctcagggtccttccactggggaggtcatgcacaccgagcacccttgccactgaacaacgggtgtgcatgcccagatacttgcctggatggtgagctgctgggggaaggacctgccttacctctttcttccccaggggctttatagggcccaggatttatttctatttgtttcccgcctccaatatcttatttcgaaaatgtccaaaccaaagataatggtataatgaacacccttcgcttagatttgccacaatttgctttttctctctctctttgtcttgctgaactagtgcagacatctgaacacttggccagggctggggatttggaaggtgcttaacgcctgctggaatcaacgaaagggagagcaaggacacggcgctgctcccctctgcctttggccccagtggataaccttgcacagcaaagcgctggcctttctaaaatgctaacacagaggagctgcccacctacttggaggctggctgccaacagtcagcacagcccctctgcagacacgcaaggcccctgtcatcccttcctgcctcatcgctcactgagccctggaagacagcctcgtcctcacacccacctgcgccccccatgtgctgctggacttgggccatggaacctctgtcctccccgctcacccagggagggcatatatctcttccatgtcccttgcaaacctgacatcctcagagaagtggaggacttccctgatatttcctctgccccttggcaccaagggcagcctctgttggagtgacccattcatcctggtctgcccaggactgcccagttttagcaatgaaagtccagtgtcctggaacccctcaggcctgggcaaaccaagaggactggtcaccctggcttctgttgactctcactgggtgggcaggacatgttcacactcccactgccgggagacagcagcctgagagtcaccaggggcaggggctgggctgctctctacctccccaaccctgccaaggccaggccacagaagaggcccaaggacaggcttgctgacgctggctcactgcctagaggaaagaagaaatgaaccagcacagggctgggtgcaatggctcacgcctgtaatcccagcactttaggagaagggcaaggcaagtggatctcctgaggtcaggagcttgagaccagcctgaccaacatggtgaaaccccatctctactaaaaatacaaaaattagctgggcgtggtggcaggcgcctatagtctcagttactggggaggctgaggcaggagaaccgcttgaacccaggaagaggaggttgcagggagccaagatcacgccactgctgcactccaacctgggtgatagagcaagactgtctcaaaataaaaagaaagaaagaaagaaaaagaaacgaatgagtagacaacgaaacagtaatcttgcctccttcaaatctgctcagatgtcacctcctccatgaggccttccctgactgccatctcagatgatagcctccccactccccacccccactttacaggcttccctagcatgtatcactgactgacattctccatgtcatttgttcactttcactagggtccgtctcttggactacagtgtcagctccacatgggcaggggtttttatctgttttgatcactgaggtatttctgatgcttagaataataggtgttcagtaagaattcattgaatgaatgaatccttgctttcctgcaaaagatggagcctcctggccttctcacacatttggtcttttgtttaatttgttcaacagacatcagtgccctctgcgtcactgtgtgtgcatgcatgcatgtgtgtgggtgtaggtgtgtgtgcatgtgcctgtgtgtgtgcctgtgtttgtgtgtgtgcaggtgcatgtatgggcgtgtgtgtgcgcccatgtgtctgtgcgtgtgtgtgcattgtgtacttgttgtttgcatgtgtgcttgtgtgtgtgtgtgtgtgtatacaaagcagagtgcccaatctgatggcaggaggggcagaggccagggtgaggactcaaagagccatcatgcctggttgtatgtgaagccaaggacctggcatttgggggtgggttctctggggcaggaccctgagctctttgcaacagccttaaaagaaagcctggactgtaataaccatggccaacatatattgaacacttgctatgtcccaagcactgttctgtgtgcttcatgtatgttttctcagttaattctcaaatctctgacatgtaattgtccccattttgcagatgaggctggggagcctaagtgacttgctcaggggaccacagcaagaaagtgggggtcacagtcagactctggagggtgctgctaaccctggtgctggagactccatttgcagaagaggaaggaggatcagtgaggtgaagtcacttgcccagggtcacagaggtggtctgctgagatttacagcaggtccaggacaccagaggagtctgaggtcccacttggtggccaccctggaagaggtgagggtaaccaaagggaagaggacagagacccagagccaggcaggagctgtgcttgaatgcaaaacagctgcacaaaactggaggacaggagggaccgggtctgactggggagatggaggccaacttctcagcaaagctgtccttgcttcctcttctctcctgaaaaatggccacagaagccgtggaccacctgtctccaggcctccacatgggctggctgccatgcactggccctggagagaagcagaaagggggggcgggcagcatcccctgtcccaggcccctcctcctgcgctcccggcaatgtcggcctgactcacctggtgataccaagtgtatattctgtgtcaggagctgcggtgtgcaactcaagatgctctgacttacttaattcttacacccaacaagttccaacagggaaacagagttcaggcagcgaggtagctgcccaagccaccagcagagggagggtacaagccccaactatctggctccagagcctgtgcctctagcccctacccaggatgcagagccctggctcccctggctggcctggctctccgccacgagcctgtgtagtccctgacagcagacaccacccacagtgttccacagtccagcaaagggctcagcacacagcaggctcagctgaaaacaatccttgctctttgagatatgggaacagtgacttcttcctttggatgtttctccctctacccaagtctgggaaacagtaacagtctcagttggacagtaccaacacctttcaaagctgcccctccttggaaggccaagaagtgggcagaacatgggcttccaaccaggccaacctggaaacgaaccccagttccaccctgcaaatcactgcacctccctgagcctcagtttcctcatctgtaatatggggttcataagtgtcattatgaggagcatggtggtgttggcctgtagtcccagctactcaagaggtgagggctggaggatcgcttgagcacaggagtttgaggccagcctgggcaacatagcaagaccctgtaacaatatttttttaaatagtaaaaaaaaaaaaaaaaaagtcaccgtgaggattaaaggagacaacaagagctggtgccaggcacacagtgggtgtgctcagggagggtgtatctgtccaccgagcaccatggccacctccaggctctcccaaggccaccttggccactgcccccctactttgaaactatggctatgtaaatcatgatatgtttgaagcatacagaacacacagaaatgagctgtgcccggtcagagcactccactctggcacacacgtaatcataacaggcccttggattcctgagtgttttccaagggttggggtctgtaccatgtgccgttcgtgggcggcctgcttcctttcattctcacgacttcctgtggaggtgggtcctcggttaccccaatttataaatggagagactgaggctccaagaggtcccacagccagggagtggtggaagtagaatttgtttttatgtagatgtgtatttattgacatcaaagatgtttaccacatattattaaatgaaaagcagtccataggccaacagagtataatttgggagagtatcattaaaatattaacagtagttatccctaggtgataggatcaagggccttacaattcttttctttttttctgcttatccatattttctaatttttttaataacagctttgttgagatataattcacatcacatacaattcccctgtttaatgcatgcaattcaatggttgctagcatactcacagaattgtgaagccatcaccataatcaactttagagcattctcaggccgggcacagtggctcacacctgtaatcccaccactttgggaggccaaagtgggcagatcacttgaggtaaagagttttgggaccagcctggccaacaccgtgaaaccccatctctactaaaagtacaaaaattagccggccatggtggcgtacctgtaatcccagctactcaggaggctgagataggagaatcacttgaacccggaaggtggaggttgcagcgagctgagatcacgccactgcactccatccagcctgggcaaaagagcgagactctgtctcaaaacaaaaaacaaacaaacaaaaaaaacaaaaacaacaaactttagagtattttcatcattcccaaaagaaacctcctgcccattagcagtcactccccattttccagaacccccctctccagacctaggcaaccatattctgtctctatggatttccctcttctggacatttcatacaaatggattcacacagtatgtgatctttgtgacaggctcctttcacttggcataatgttctcaagcttcatccgtattgtagcatggatcagtattttattccttttcatggccaataatatccacattatatctgtcaattcatcatattgaaagacattcaggctgggtgtggtggctcatgcttgtaatcccaacgctttgggaggccgaggtggtcggattgcttgaggccaggagttcgagaccagcctgggacacatagtgagaccctgtctctacaaaatacaaaatacaaaatattatctgggtgtcgtggtgcatgtgtggagtagcctttagtcccagctactagggaggctgaggtggaaggatcacttgagcctgagggtttaaggctgcagtgagccgtgatcacgctattgcactccagcctgggtgacagagcactcaaaaactcaaaaaaaaaaaaaaaaaaaaggaagaaagaaacagacattcaggacaactgggctgttttcacgttttggctgttaggaataacgctgctattaacatttgtgtaagtctgtgtgtagatatatgttttaattctctcaattatatatctaggagtggaatttctgggtcaaatgataattctatgtttaaacttttgagaatgtgccagactgttttccaaaatgactgcactatcttacattaccatcagcggtgtatgagggttgcaatttctctatatcctcaccaacacttgttcttatttgtcttttttattctagccatcctgtgaatgtgaagtggtatctcattgtggttttgatctgtatctctctgatagccaataatattgagcacctttcatttgctgattggccatttatacatcttttttggagaaatatatgtttagatcgtatcgccatttttaaaattgagttatttgtttttgttctgtttctgtttttgtttttgtttttttgagacagagtctcactctgttgcccaggcaggagtgcagtgacacgatctcggctcagtgcaacctccacctcccaggctcaagtgatccttccacctcagcctcttgagtagttgggactacaggcaccaggcacacaccaccacgcctaatttttgtattttttgtagagacgggttctctccatgttacccaggctagtctcaaactcctggactcaagcaatcctcctgccttggcctcccaaagtgctgggattacaggtgtgagccactgtgcccaaccaaaattgggttatttgtgtctttattattaagttgttggaagtagcatttagagccaggtctggcccttgctttactatcaaatggtggacactgcacacacccccatggcatatgccccaccgccagggacatcttgaagccccctgcagacttggccctgctctgagcaggtggaagagtaagtcctgctggggcctggcccacaagtgtccagtgaatgtctatggatggacagacagacaagtatatctctaggaacgagtaagccaaaggggaagaaaaaacacacagaccaagaagtccacaccccaggaggaagaaactgctgaggcccagctccaggaggtagagataacacttttggcgcggcgagaggccaccaggcaactgcctcttgtgtccttggtggcagtaatctatctggcctgtttttacgtgactgactattggcctgtctgaggctgggaaggagaggccagggagattagcagggaacccataagcctatctgtctaggggcttgtaaggggggcagctggtcagaggcgggcagggaactggtggggtgtgtccctgccagcctctggccccagaaactcactgcttcatcaccaagggcgcctgcatcttgaacacccagctctggattctgactacctgggtttgaatcccagccctaccatctccttgctgtgtaaccatggacaagttactctccatctctgagcctcagttcactcacagcctcacctgtagaatggagacaaccagagtgagaacgaaatgagaccctaaggctgtgtcttggtggggccaggctgccggtgggaggctacagacagtgggcaggagggctcacccacagggcatccccagaccctgtactcagagcctgtccccttgtgaaatggagtcacagactctcctgagaccagccgccgcatgaaggtgcacctcggcccagtgctgtgagaatgtggctgctggtggaggcagctccaagaacctgtgtggtaaagacaggctgggagggggtgccagggcagcctctgactcaggcagcctgggatcagtgtcctactctgtcttttaccagctgtgaaccttgggcaggcacttggcctctctgtgcctcagtttatcctttggaagacagagatgacagtcatgcttactttatagggtggctgtgaagattaaatgggttaatagaggtaaaatgccagttaaaatctcagccttaaaataaagcccagagcatctcctgaattcatttaacttctttgaaccccagattctcccatattcccccggattcatccagctgggctgtgtggaggacgggaaagtgttagactattctggcatttcccaaagtggatcccatggacttctaactcacgggatgctctaggaaaataaaaaagggcaccattgtcacataggcctgggtgctagtgtagacccagccgcttcctggaaccacacacacacacacacacacacacacacacacacacacacacacacacgaaagtttctgcgaaaccctgcagtgaagagctctgtggatgtttgcgttgtttctcaaatttatttgacgatgaacacccttttctgcccaaggtcgatttaacatcctcctagaaaacaatgatggtcaaggtcatttctatcttgcagcttccgtgaatcacagaaaagatgggaagatttgctaaaaatcatcatcatcacctaggagaagtgcctttctgtttttaaaaccctttcacactcaccaccatgaaagcatcatggccctgtggggcactctcagccctgccacagggatcagagagggtcagagtgggaaggccacaccagggataccccacgcccacgactgcccagccaggactggcccaggtccctttctaccccgcacagctgcctctggctaccccaaaccagacagaatacccagaaggttgtcaggacagaaggtggcgtctgcgaggagccttctagaaaaaggagttgtagccaggcaccgtggcttacgcctgtaatcctagcactttgggaggccgaggcgggtggattgcctgagctcaggggttcaagaccagcctgggcaacacggtgaaaccctgtctctactaaaatacaaaaaataagccaggtgtggtggcgtacacctgtagtcccagctactcgggaggctgaggcaggagaattgcttgaaccctggaggaaaagattgcagtgagctgagatcgtaccactgcactccagcctgggcgacagagcgagactccatctctaaaaccaaaacaaaccaaaacaaaacaaaacacaaaagaaaaaggagttgccaaaaagaagccctatgggttgagccagcccagcctcaggcaagggagatgtcaaggatcaggagtcccctgggggcacctgcaggggaggccctgtgaccctgagcctaattaattgggaaagtgccccattcaagtagcccctcacatctccctgtaaacatctcagcaaatctaacatccagcaaccagattacatctcccagagagtggcctcttgaacacaggacaagggccaaaattcttccctaggccctgcgaggtttggaaaatgagcttgatcagctagtcaagggaggagactgacatttattgagcaccagtgatgtgtcatgcatcgtgtacctgtatggtgagatctcaattctgataataatccctcttcacagatgggggaaactgaggctctcggtggtaaattaacatgtccagggatgcagcagggctaggattcaagctccaagattgggtttggctcgccagccccagtgccaccacacgccccaaaccctgtgccacacctcgctctccaggcccccttcccattcctaagccaggttctcagggcctcagatataagaggaattggttggggggctaatgtgatctggcccctaacagcctggcccacactgtggatggagaaactggcacttgggtttgtcgctcgatgtcctggagaatcgagctctttcagcccctagtactctgatcatctgttcagggaagacaggtagagaaatccattttctgggtatgctaagccaaaggccatgcctaagtctttgaatgctgtgatcattcccagctgccctcaggtgcagcctcctgcctggcatcccgcccggctcactgaccttccagaatcctggcactcaggctgggggtgtatggaggggaggggggcccatcatacaaacctctctgcaaaacccctattcctctccttgatgaccctgcccccctggggggatattctcccaaactgggacttcccagaatttctgggtcagcaaacagactggctgagtggctgcaggccactcctctcctgcgagacctctcccctgcactgctgcacgtcctcctgcccagcgcagaagcagacattggagaggagagagagccagcaccaagccctcccagctttcccaccacactgcccatcttcaagccctccgagcttttccaccataccacccatcttcaggctgtctgagaggcaggctttctttccttcatccctggcagcagatccaggtcacagaggggcagctacttgcccaaggccacacagtgaggcagcagtgggcatcacacctgggtctgactcactccagagttggggacctttttcccagtccagtacagtggccagcagtgttgaggatggagaagtgttagactattagtgtgagatctggagcctgggctccccagcttcctcactgggtcacttggggtagacacctcaacttctctgtaccccagtttctccatctacacagtgctatcagagagtccctggcttcaaattctgtgtaagttgtgtggccttgggtgagtcacttaacctgtctgtgtctctgctttctccaatttaaaacagagtgggccttaaggtaagggtcagtatgaggattttttttttgagacagagtcttgcttgatcccaattttttttttttttttttttttgagacaaagtctcgctcgatctttttgttgagacagagtctcgctcgattttttgagacagagtctggctcaatctcagctcactgcaacctctgcctcctgggttcaagcgattctcccacctcaacctcccgagtagctgggattacaggcacatgacaccacgccttgttaatttttgtatttttagtagagatggggtttcaccatgttgcccaggctggtctcgaactcctggcctcaagtgatccacccgccttggcctcccaaagtgctgggattacaggcatgagctaccacgtctggcctagtatgaggattaaactgtgtgtcaagggcttcctagcaggtggtgtctagaaggcccacactgatggcctgctgttgtggtcaagatggggctgtctaggctgactccagaaggaaacacaaggaataggccccagaggtcatctccggggagggaaacagttggggaaagggtgggagccctaacttgtccctataggttgtctgccaccttcagaattgtgtattgcagtcacgcattattactgttaccacagctgattacatgatgactgcacagagctgctcccctggcctgacacatgcactcatgctagccagaggccccatgcatgccttgggtgcccaggccagctcctaccacttgcttggctcatccctccacagctacacccatgcctcacccaggcccttttcaactaccccatgtctcccagcaagaccatggcacagccttgagggccaggagggtctctccatctagcacacactggtcactcaccacatgacacttgatgtgagtctctgtcctccattgtctcactcataagtggagaggctcatgcctcccccagggtaactataaggattaaaataaagaactagggccgggcgcagtggctcacacctgtaatcccagcactttgggaggccaagctggatggatcacctgaggtcaggagtttgagacccgtctggccaacatggtgaaaccccatctctactaaaaatacaaaaattagccaggcgtggtgacgtgtgcctataatcccatctactggggaggctgtggcaggagaactgcttgaacctgggaggcggaggttgcagtgagccgagatcctgccattgcactccagcctgggagacaagagtgaaactccgtctcaaaaaaaaaaaaaaaagaagaactagggtttggcttggtggctcatgcctgtaatcccagcactttgggaggctaaggtgggaggatcacttgaggccaggagttccaaaccagcctgggcaacatagtaagaccctgttgctacaatatattaaaaaaattagctgggtattttagcacacgcctgtagtcccgactactcaggaggctgaggtgagaggattgcttgagcccaggagattgaggctgtagtgagtcaagattatgccactgcactccagcctgggtgacagagcaagaccctatgtctaaaaaagtaaaatggagaactaatgtgtggaaagcgccagatacagttccccacccggagttgaaagggtgaaactaccacgggtcggggaattgctcagggtcaggtgcatagcctggagtgcaggagtgttggtcccagctccttccccagcctcaccacccacggcagggggcgtcgccttcccccacccttccaggctcagagggtgtcaggtccctcatagtatctccccaatccattgatggcacctacagcaccctaggcaagctaacccctacccacttctctcaccctctgtgccctctgaggagcaggctttcttcctccatccctggcagcagatccaggtaacagagatctgctacttgggctacttgcccaaggccacacagtgaggcagcagtgggtatcacacccgggtctagctgactccagagttggggtcctttctcccagtccagtgcagtggccaggggtgtgggatctggagcccaggctccccagcttcctcaaacagcctaagcccatcctgcctccaggcctttgcactccccattccctcctccttccctgcccttcccatcattcaggttctgctcagctttgcctccctcagaggctctcctggaccacccctcccgaaatgccccaatccctattctctctgtctcttgcccctgattgtttgcttcatggcactaaccattgcctgaaactgtcttttttttttttttttttttttttttttttgagacagagtctcgctctgtcgcccaggctggagtacagtagtgtgacggtggctcactgcaagctccgcctcccaggttcacgccattcttctgcctcagcctcccgagtagctgggactacaggcgcctgctgccaaatctggctaattttttttttttgtgtgtgtgtttttagtagagacagggtttcaccatgttagccaggatggtcttgatctcctgacctcgtgatccgcctgcctcggcctctcaaagcgctgggattacaggtgtgagccactgcgctgggccaataaactttctttagggaataacttagaaattattttgcaacagaaaaattgcacagatagtacagggagttcctattggcccttcaccaagttttttcttatgtcaacctattacctaaccatggtaagtggtcaaaaccaagaaagtgacattggtacattacactgatgagccgcaggctttactccggtgaaactgtgttcttccttactcatttgttctcagctgcctcccccatgaggaggcaaactctgaaaagcagggaggttgcctctcccactgacatcaatttcctcatacctggcaaggagtgctgattggataaaggagaggaaagaatggcaaaaacagccaatgactatcaaggactcctgccagacagtgttcctaagtgctttaaacactgtaagccccagcctgggcaacatagtgagaccctatctctacaaaaaatttaaaattagccaggtatgggggcatgtgcctatagtcccacctaccagggaggctgagatgggaggatcgcttgagcctgagaggtggagcctgctgtgagctgtgattgcaccactgcactccagcctgagcagcagagtgagaccttgtctcaaaaaacaaaacaaagccaaacaaaaccagacccaacacatagtaagctgtttaatcctcacatcagcccatgaagcagctatgaatcataggggaactaaggcatggtacggtttggtggctggcccaaggccacagagatgggcagtaccagagtgggtgggttctagcacactcctcctgcccctgtcacaacacgctgatggcaccacagggtaacacagcaaatgccagtccctccatgttctcagtctacgaaacagtggaagggtcacacctcccacagcccagcaggagcacaggcttgggatggagcctgagcctctgcttcttgcttctgcccacagtgactagtggctatcccggccctgcacagaatgacacaggggctctgttccgagggccctcagcctcacccttcttcagggaaacagaagggggctggttcggccccggaccatgggctcccgccagtgctcccaattccccagaccctgccgacacaaagcaggcctcagcccgccccgctcccttggcccacagcttggactgggcctctaggatctggctgctgagggccgggtgcagagcatgggcccctgtcctgaggtccagcattctcagaggagctttctgggctctggaagagagaggaagaggaagacatggtgtccctttccggatgtggggtgggagtgacacacaggagtactgcagcctcctcccagcactcagggaccaagccagagagatgtgccagcgcctcccaagggagaagccattctccagcagctggacaggaccagagcctgccccgcatgtccggccggggttctacccagagccagcctggcacagcctcggtccctaatcatgtttgctgaatgccttgaatacaagcgccggtgcccagaatctccttgaggtttcagctgggcgtgccgggcccatcccccactctggggagcagaatgattgtggggggtggtaacaggggacaccctgaggtggtggtggccttggtaggacaggcaggcagagctgggggtgggggcgccctgggctcggctaattaaacagcgaccgtgatgaattggagagaaactgctgcttgctaattaaaggtgcaggcaacttgcctggcaaggatgggaggcagaagtcctggaaacatgttgaggtccaggccagcgaggacagagcttggccaaagtcccccaccgtgcccattctgggcatccctcccattgccctcccccgcccagcaggggcccgcagccccctccccacttccctatctctccgacccaccttgctgagcctgaggcctccaacttccccccacccctccccaccaacccaaatcctttcctgataagggcctgggtgttgcggaggaggaggctggcgctggtggctgggctgggggtggactcgctgagcctttgaggtcctccttcccgccccaccgccaaggtcccagaggtgggcagtgagtccagccaagactgatgtggcctgttgggaacaaggcccccaagaagatcatagaatcttagtacctgagactcgcaaggggctttaggtcttccctaatttcccaacagtccccagtgtcagcccaggtgtgggagacagggacagcacttcttacccggctcagcattccagtttttgtaaagggaaaactggccaggcgaggtggccactgcctgtgatccagcatgttgggaggctgaggcaggagaatcgcttgagcccgggagttcaagacaggcctaggaaacataggagaccctctctctaaaaaaaaaaaaaaaaaaaaaaaaattagctgggtgtgttggcttgcgcctgagggttcagctactcatggggtagctactcaagtgggaggatcacttcagcccagaaggttgaggccgtagtgagccatgatcgccccactacactccaaagtgggcaacagagcgaaaccctattcaaaaaaaaaaaggaaaagaaacgagaaaattggagcaaatgatctctgagccttgaagattcttacagggtggacaagaaaaccccctgaagctgctcatccctgccccaagtcacttcaaagcagggctgtaggctcagacacctttaccaaccaacgtgacctcaggcaagggagctcattgtcacatgcctgggtttccccatttgcaaggctggggatggcaacagagcccacctcaaagggtctctgagaagactggaggagataacaaaggtgaagtgtccagcacagcaactggtctgacctgaatagccagccactgccatctgaaaggtctggggaactggggggtgacctggcacctagcctgtccgagtcttacctcttcatgtggcagctgcagtctggcactctgaggaggaggattagagagcttaagtgacttctgcaaagccacaccactacggaagaggaagaggcagccttggatcccttgagtgaggagaggatgggacctggattcctatgttgacatttgttgagcatctactggatgcagggtcctgaacaagaccccaggaagggactaagatgaatctgagattcactctgcctttaaggggaccccagtctggaaggagagagaaaacacacatacaaataactagaatgcaaagcaaatgtggctggatgcagtggctcacacctgtcactttgggaggcttaggcaggaggatcacttgagatcaggagttcgagaccagcctggccaacacaacaaaacctcgtctctactaaaaatacaaaaattagctgggtgtggtggtgcacgcctgtagtaccaactacttgggagactgaggcacgagaatcacttgaacctggtggggcagaggttacagtgaactgagatcgtgccagtgagctgagatcatgcacttcagcctgggcgacagagcaagactccatctcaaaaaaaaaaaaaaaaaaaaaaaaaagcaaatacccctggcatcagagggggcccagcagccctccatgcaaaggggctggggtgagactcttgggatggcggggagatgctgctgtgtcttggagctcaatttgcaaggcaaaggttttgattttatttgaacgataaaatcagccctgggggtcatgggggtgctgatggagcctcctctggcttttttgggaagttctgggtggtccctgacctctgtgattcctgcttcgaaggttctgggatctatcctggaggtatctaggagtcccggatgctgtggtttttggagactacactgtccagacccccagcatgaatacattcacgtccacaaaaaacagtgagggcccccttccaggtagccagacacgcaccagtttggggggcttcctgctgctgggcaatttggtggggagaggatgcagcaccagtgagaggccctctcagagatggtggaagcctctcaaggctgagagatgcaaggctgctggccccgatgttgcaaagcctgagcctcaggcggcaacccaaagcgggcagggtgagtgctaggtcactggccttggggatggtgcctccgtcactcccttcctggagatcagagctcagccagaggagcgggctggtctagccacaggaagtctgtgcaagcacagccagcagctcctggaaaataggcgctgctctcagcctccccagggcaccctgcacccaagctgggccaaatgatggtctggggcgccctctggtggctcctctgggcagtggtggatgctgaagccactgtgaatttaagggtgggtggggcagagatggtcagagttggaagatttcaaggtggaccactctttccactacacagatgggaaaaccaaggcccagagggaagtgacctgcctacagttgcacagccagtgactaatacaagaacagaacccagaagttcctctgtaccaatgcttttttttagggggtctcaagacatcccaccctaggggagggaaggctgagtgtccagggctcactcccagtgcatatggacagctgaactgtaggtcgctgagtatctgtgtgacatagcatgcagcacttccctcccaggcttggttctttgcctctaaagcctggggttactgtgttggcaagggatgggggactaggcctcctgcttgcacactgctagaactgagggtgtaaaccagccaatctttcggggagttctaagaagagtgttcctacagctggtatcatacttcatggtgagagattgggtgctttccccaagaccaggaacaagacaaggatgtccactcttacggcaaagttgaattcacgacttgtattcaacactgtactgggtacaatggcaagaaaataaagtcatccagattgcaaaagaagaagtaaaactatccctacttgcagatgacatgatcttatatatagaaaatcttggttgggagcagtggctcatgcctgtaatctcagcactttgggaggccaaggcaggtggatcacctaaggtcaggagtttaagaccagcctggccagcaaggcaaaaccatgtctccactaaaaatacaaaaattagccaggcgtggtggtgtgtgcctgtaaccccagctactcaggaggctgaagcacaagaattgcttgaacttggggtgcagagtttgcagtgagccaagatcacgccactgcactccagcctgggtgatggagcgaaaaaaaaaaaaagagaaaatcctaaagaatccactaaaaaaaagttataactaataattgggtttggcaaagttgcaggatacaagatcaatatacaaaaatcaattgagcttctacacatttgcaatgaacacttcaaaaatgtaattatgaaaataattcaatttatactagcatcaaagagaataaaatgcttaggaataaaagaagtacaaaacttataatctgaaaactacaaaacattgtttaaagaaattaaagatgccataaataaatggaaaaataccaatgttcatagatctaaagacccaataccattaagatggcaagactccccaaattgatcttcagattcaacacaatctccatcaaaattccaacttggttctttacagaaattgacaagctgatcctaaaattcatatggaaatttaagggactcagaaaagctaaaacagtcctgaaaaagaataatggtgggccaggcgtggtagcttatgtccgtaatcccagcactttgggaggccgaggtgggcagatcacttgagtccaggagtttgagaccagcctgggtgatatggtgaaacctcatctctacaaaaaatacaaaaatttagctgggtgtggtggcatgtgcctgtagtcccagctactcaggaggctgaggtgggaggatcacttgaacctgggaggtagagattgcagtgaaccaagaatgtgccactgcattccagcccgtgtgacacagcaagatccttccccaaaaaaagaagaagaaaaaatgaacaatgttggagtgcacacacttccaatttcaaaaattactataataaactacagtaatcaggacaatgtggtactggcataaggacagacatagagatcaatgaaatataaataagagtcctgagagtccagaaataaaccctcacatttggttcagccgcaagagccgaacatatttaatggtggagttcaatggggaaaacagagtcttgcaaaagaaagaggtcagacccctgcctcacaccatacacaaaaattaaagtggatgaaaacaaatgtaggagctaaaactataaaactctgagaacatagacataaatcttcatgaccttggattaggcaatagtttcataaatatgataccaaaagcacaagcaaccaaagaaaaaatagactaggcttcatcagaatttaaaattttgcatcaggcatggtggctcacacctgaaatcccagcactttgggaggctgtggcaggaggatcgcttgagactggacactatcaaaaaagtgaaaagacaacccacaggataggagaaaataactgacaatcatatatctgataacagattctaaccagcatatataaagaacccttacaactcaataataaaagacaaatagcccagtttaaaaatgggctgagccaagtgtggtgctcactcctgtaatcccagcactttgggaggctgaggtgggcagatcacctgaggtcatgagttcaagaccaacctggccaacatggagaaaccccatctctactaaaaatataaaaattagcccggcgtggtggcagacgcctgtaatcccagctactcagaaggctgaggcaggagaatcacttgaacccaggaggtggaggttgcagtgagccaagatcacaccactgcactccagcctgggtgacagagcaagactccacctcaaaatttaaaaaataaaaatagaaacaggcagatatggttgggatgtttgtctcctccaaatctcatgttgaaatgtgatctccagcgctggaggtggggcctgctgggagatgtttgggtcacggaggtgactccctcatgaatggcttggtgccctcctcacagtaatgagggagttcttgctctgttagttcacaagagagctggttgtctgaaggaggctggcagtgcccaccctttctcttgctcacactggctcccctttgccttctgccatgattggaagcttcctgaggcctactccaggagcaggtgctggtgccatgtgtcctgtacagcctgtagaactgtgagccaaataaacctcttttctttacaaattactcagtctcagctattcctttatagcaatgcaaacagactaatgcatgggcataggatgtaaatagacatttctccaaagaagacatacaaatggccaataagcacatgaaaagatactcaacatcattagtcattaggaaaatgcaagtcaaaaccacaatgagatagcactttgtacccactaggttagttataataaaaaagacagataataacaagtgttgatgagaatatggagaaatcagaaccctcatacactgctggtaagaatgtaaaacgttttggaaaaagcctggcagttcaaaaggttatatatagagttacatgatccagcaattctgcacctaaaaggtatatacccaagagaaatgaaaacatgtattcacataaaaacttacataaggccgggcgcagtggctcatgcctgtaatcccagcactttgggaggccaaggcaggtggattttcggagttcagcagttcgagaacacccagggcaacatggtgaaaccctgtctctaccaaaaatagaaaaaaaatagccaggtgtggtggcatgtacctgtagtcccagctactcaggaggctgaggcatgagaatcgcttgagccccagaggcagaggttgcagtgagccaagatcgcaccactgcactccagcctggacaacagagtacgactccatctcaaaaaaaaaatcttacatgactagtcatagcagcattattcccccaaaatagaaacaaccacaacccaaatgtccatcagctgatgaatggataaatgaaaggtggtatattcatacaatggaatattattcagcaataaaaaggaggactaaagtgctgacacatgctgtaacatagataaaccttacaaacatcatgctggggccagacacagtggttcacacctgtaatcccagcactttgggaggctgaggtgggagaatcacctgaggccaggagttcaggaccagcctgagcaacacagtgagaccccatctctacaaaaaaattaaaaattagctgaggctggccatggtggctcacacctgtaatcccagcactttgggaggctgaggcgagtggaacacttgaggccaagagttccagaccaggctggccaacatggtgataccctgtctctactaaaaatacaaaaattagccaggcgtggtggtaggcacctgtaatcccagctactcgggaggctgaggtaggagaatcacttgaactcaggaagaggaggttgcagtgagctgagatctcaccactgcactacagcctgggcgacacagcgagactctgtctccaaaacaacaacaacaacaacaacaacaaaggagtttgagaccagcctgggcaacatagtgagacctcatctctaaaacaaaattttaaaaataaataaaaaggcgtcacatttactaacatcgatgaggtccaagatataccaccaagtcaaaagaaaaaaaaagcaggttcaaaaataagcctgtaggctgggcaaggttgcttctgcctgtaatcccagcactttgggaggccaaggcaggaggatcacttgatatcagaagttcgagaccagcctggccaatatggcaaaaccccgtctctactaaaaatataaaaattagccagacatggtggtgggcacccctaatcccagttactcaggaggctgaggcagaagaatcccttgaacctgggaggtggaggttatagtcagctgagattgcgccactgcactccagcctgggcaacagagctagactctgtgcgcccccaaacctaaaaaaaaaaaaagaaagaaagaaagaaaaagaaagcatgcagattaaaacaggtacttaagagactttaagaagataaaatttcagctgggcacggtggctcacgcctgtatctcagcactttgggaggccgagacgggcggatcacctgaggtcaggagtttaagaccagcctggccaacacggtgaaaccccaactctaccaaaaatacaaaaattagctggcacctggcattctgatttttaagaagcaagcataataggattccattcttatgaaaaaatctgtatctatatgtgtataacaaaaatacctggaaatttaggatttagggtactctttttatttttggagaacagggctcactctcacccaggctggagtgcagtggcaggatcacggctcactgcagcctcaaactcctgggctcaaggaatcctctcaagtaactgagactacagatgtacactaccatgcccagctaatttttgaattttttcttttagagctggggtcttgctatattgcccaggctggccccaaactcctgggctcaagcaatcctcccacctcagcctcccaaagggctgggattacaggagtgaactaccacacccaatctatgatactcttaatttatattttactgaattttccaatttttgttactgcaatggataataatcacttctacagacagaaaaaacaataaagctttttgctgtgttgcaggcattcctttggccctgacattgtgtgagcacaaagggtaggtggggaatgacactggagctacagggagatggagcaggagaagaccaaggctcagcgtcctccggccttggcgtccagggctgattcaaggcctagaccccactgcggcttcccagagactcagacccacttctctttttttttttttaaacagagtttcgctcttgttgcccaggctggagtacaatggcgtgatctcggctcaccacaaccttcgcctcctgggttcaaatgattctcttgcctcagcctcccgagtagctgggactacaggcatgcaccaccacgcctggctaattttttgtatttttagtagagatggggtttctccatgttggtcaggctggtctcaaactcccaaactcaagtgatccacctgccttggcctcctaaagtgctgggactacaggcatgagccaccgtgcccggcctaagaccccttctctttcagggcagctggtgcagctgctgcacagccgacccccttgccccacactccaaagacactgggaatgtaatcctggcttgatgaaggtcaccctgtttctggccgtacaattcaccaaggaggagaagccctgggcaggaggcctggggctaggggcaggttctcatcctgcctactaccagcacaaaaacattatcgcagctcaatgaacactctctacgcatcaggcagtcctgctaggtgatgtacctgattcattttatttcctcctcctgatgacctgaagtgatgggtgggaccaccatcttcattgtacagatgagcaaactgaggctcagggaacctacatgagtggacccaggtgctcaaagtggaggtgcctgcagcagccactatctttgagactggacctggctggacccctcatgggtggacctcagtgaattctgccaggatcccaggaagggtgccttccctcatttcccagatgaggactctgagaatgagaggggaaggccacttgtccatgtcccacagtgactgtgtggcaggaagaggtgcaagccagagcctgtgctctcagctgccataccaggcagcctctttcacctgtgaggggccatgggcatgctccccacctccgtggctggcactagtaatatcaattaataataatagataatagcaataattattatgacatataattatatcaaatgtattatattaacatcatcatcatcatcatcatccacatcaacacagttgtgttgtaacctggggagtgtgtgtcagtggccagtgtgctgtcctgtatgccagcgcatttgctcttctcagcagatctataagtcttcattctgactttatttccccccattttaaaggcccagggagcagaccacatggggactacacctctggggcacagttgctactcctgtcctgtacagggcagcccagtgggaagctctctgaggctgtgcggtaagcacctttcccattgcagggaggttggggggcagctctccagaggatctgggtccatctcccagccgagccacccagccacaggatgtgcccttcccagcaggagaaaggacactgaatgacagagccaagggccaaggtgccaggaacagcaaccagggtttcaggggatctgtaactgcctcctcagccagtccaggcccgagcttactccatgccctttcactggtcaatcggttggccagctcatgccagggagctcacaccttcgagaggccacgctgctgccgaaaagaggggctgcttctccctgagtgcccatgacctgccaggcactgactgtgctaggccatcagcactgagcctcacaaaaccctttcaatggccctattttacagaggagacagtgaaggctcagggaggtcaagtgacttgtccaaagtcacatggacaggaagcctcatagtttcctggtggccagtttccaccaagaacgtgtgtgtattagtccattctcccactgttaaaaggacatacctcagactgggtaatttataaaggaaagaggtttaattgactcacagtactgcatgactgggaaggcctcagcaaacttacaatcatggcagaagaggaatcaagcatgtccttcttcacacggcggcaggagagagaagtgccaagcaaagcggggaaagccccttataaaaatcatcagatctcgtgagaatgaactcactatcatgagaaccgcatgggggtaactgcctccatgattcgattacctcccactgggtccctcccacgacatgtggggattatggaaactataattcaagatgatatttgtgtggggacacagccaaaccatatcaaggagggaaagaggaagggacaatcaaggtgttcagagggaggaaagagacccactgtgcgggaggcggcaagaaaggagggcctgcgtcaccagctctgactctctcaggacccgacttagtcatcggcccacctgttctccactcattcatacatttgtgggccttctccaggtgccaggctctttgccgggcattgagggctcagaggtgaaccaggctcatctctgttctcacaaagctcatgacagcagggcagaatggaaagggaaacagatgggcagacatcacttgacttggtctgtatttatgaaaggtctaagtaggccaggctcagtgttgggcactgaaggcaccaagtcagtgagaagctcaaggcccctgcctttctgaaggatgtgctccagtggtgtccagccctggccctccagaaacctttcttgcatgacccctgaaccctgaacacaaggcagaatttctctggaaagactgggagaagcagcaaatctaggggttctccatgaatcttccttgggcctggttctggggtgctgagcaggaatttgtctgggagagcaggggaccctgattagtgcctttcctggggactaaatcagggccctgagaggccagagctgtgcaaaggggtcatctggactactggacggtcagcaagggccacccattcaggatgcagccacagatccatggggttggagacccagcagaggctctcagtcaggatgggccacagctctaacaaaagggaggtgacttgcccaaagccccccactccacacctgtgctccccacagacagaagcatcagctcataggtagcactagctcactccatcctagcccccggggaggcccatgtcagcgtaaggcccatttcccagccccaggaaatggagaaacagagccacaaaaggacttgcccaagagcaccacccactggagacacaggcagaatcagaactgggagttgcccagcactttccaccacccgctcacgccccaggatggcagatccagcctggtacaggcgacgcaggatgatggcacccaatcttggggagcagcacgagccaggggcacaaagggaaactcttttcctaagcttcccctggtggtatgggggtttagtctttgttttgggggcttgttctaaatgctaaacctggctgactctgggcacactgcctataggttagccctgctctgcaaggagctatagagttaaaaataaataaacgggctgggcacagtggctcacacctgtaatcccagcactttgggaggtcaagggggcaggcagatcacctgaggtccagagttcaagaccagcttggccaacatggtgaaatcctgtctctattaaaaatacaaaattagctggacatggtggcaggcacctgtaatctcagctactctggaggctgaggcaggagaatcgattgaacccgagacggagttgcggtgagccaagatcacgccactgcactccagcctgagcaacaaagtgagactctgtctcaaaaaaattaacaaacaaatctctgttaaacctttgcaatcaccctgagatgttcaactgaggggtccttctcagtgtgaatggctgacaggaaatcccagaattgcccccatctcagcagtcaggaaggaacagctctgccaagcatggtggctcatgcctgtaaccctaacactttgggaagaggaggcaggagaatcacttgagcccaggagttcaaggccgcactgagctatgatcgcgccactgcactttagcttgggtgacaggcgagactctgtctctataaaaaaaaaaaaaaaacaagaaaggaacagctagatatatatatatagatagatagatataaatatagttttttttttttttgagacagagtctcactctgtcactcaggctggagtacagcggctcaatctcggctcactgcaacctctgcctcccaggttcaagtgattctcgtgcctcagcctcctgagtagatgggattataggcgcccaccaccatgcccggctaattttttgtatttgtagtagagacggggtttcaccatgttggccagggtggtcttaaactcctgaccttgtgatccacccacctcggcctcccgaagtgctgggattataggtgcgagcccccgcacccagctagatttatatttttacgtggaattttaaaaactactgaattcccttggtggaaatgagagtcaaaataagagaatgagaaaaaaaaaaaagaatggctaaataaattattaatagaatattttacagtcattaaataactttaaagaaaatgttaatgctgagaaaatattcaccatgtaatgttgggggaaagccagctacagagtatgattacaattaaaatgcacacatatatacatatatatatgatctatatggaaaaacaagcctggagagaaatgtaacaaaatagcaccatagttacctccggggagtgggatgacagatgattttcattttctcctttctaccttcttgtagtttccaaattttacaatgagtacaaattgcatttataattagacataaaccaaaaaagcatgagttgggctggggctggatggcagggtagaggcttcaccagcccaggttcatcccctccacagccaggatggagctgcttgggcgctgggctctgtcctcaccagctggcccagccaggccacaggaggcctaggacggcctgcaccacactgtccccggagggaccagccatgggacactgccctcaaggaatccaacccctgcccggggccctctggagggtcacttgtaggccataaatgtcctggctggggacactgggaaatgaaccactcagggctgagaatcagaacattcattatctgctgtacgagagaagccattttctttgttccttgtttttgtttgggatggctgagtgcagcaagtgggctagggagagctggcctttgtcaccctcccactgtggccccgcaggctctcagcctccccatgtgggagtggagcacccagctgctctggtctccctggactttctgatcccagcgctctgggtttcttctaacctgggaggtgagggccctgggtgctgatctgcgccttagggaagccaaccaagttcacttaaaagcagtgttggaaaggcactgacagtgagatccaggccggcctcctgccggggtctcctcatacccccacctctttctcagcacagggtgagaagccagtggtctccagcctggatccccacacaggtttccagagaaggggctccccgcttgccagagccagccgtagagttgggcaagtttaagaacactgccctcacgtccttccagccccagccctgccaccccaccttggggtcctggaagctcctgccctcctcctgggctattttagcaatcaggtcacccgttggcttgctgtgagcttgaggtcgatggaaacccacaggccttttctacagagctggtggtatctccccctcctctagatgcagccacaggcaggctcctcagcgtgagaagagaggaccaggcagtggcttggcagtcccccacagtgtggggcccctcctctctcaggaactgaggccacacgctgccacccacaccatcccagccagtggtcctgcagatgtggctgacagcagggaggagagccagtcacagggcgttgggtgcctgagcacccacacatccccacactgtgccccatgggtgctgcacacaaggccctcaatccagtctccacgagccccaggcagtgagtcgatcctcatttagagcagagctgagtgatcggccaaggtcaccgtgctagtgtgcagcagggctgagacagactccggagctgccccagcaaagcccaaatccattctggctgcactagtgtttacccaggaccccgcccttggtggccactgggtgtctggtccctgatccaagctgccaagtaagttcccctgatggagcttgggggagactttgtgccctggttctacccacacagcagggtcccaggttcctaggaccacgcaaggcccaaagcccctctctgatggcccgtgggttctgctcagaggattctgatcacctactcctgtttgggctaaatcctaagtagcagcagatggggccctctggctgaaggctgccccagtctccagctgcagaatgcgggacagttcccatccaccctcctccagacacctgacagggagcaggtggcctttttggccagccccaaccaggtgccagaccaagagcagagagcctgtgctcaggagcctccactccacccagggaagaaagacataaacacgcacaggaaagggcttttggagacagtgctggggagccccagtgaccaggccggaaacactgtaggaggtgggagggagataaggccctgcccaagactgggaagagcaaggcgcggtccaggaaccagacagaagctggtgtggctagaacagcgctgcccagtggaaaacaacgcaaaccacaagtgtgagccacacagggaatttgaatttttccaggagccacgacaaaaaggttttttaaggccaggtgcggtggctcatgcctgtaatcccagcactttgggaggccaaggagggtggatcacgaggtcaggagtttgagaccagcctggccaagatggtgaaatccagtctctacttaaaaaaaaattttttttttaattagccagaggctgaggcaggaaaatcgcttgaacccgagaggcagagcttgcagtgagcccagatcatgccactgcactccagcctgggtgacagagtgagactccttctcaaaacaaacaaacaaacaaaaccactttttttaaaagatgaagtgaaattagccgggtgtgctggcgcatgcctgtagtcccagctactcaggaggctgaggcaggaggatcacttaagcccaggaggcagaggttgtagtgagctgagatcataccactgcactccagcctgaataacagggtgagaccctgtctcaataaaaaataaataaataaagtaaaaaaaaaaaaaaaaaaaaaagataaagttggttgagtgtggtggctcatgtgtaatctcagcattttgggaggccgaggcaggaggatctcttgagctcaggagttcaagaccaccctgggcaatgtggcaaaaccccatctctacaaaaaatacaaaaattaaccaggcatagtgccacatgcctatagtctcatctactcaggaggctgaggtgggaggatcacttgagctcaggaggttgaggctgcagtgagccaagatcgtgccactgcactccggcttgggcaacaaagtgagactctgtctcaaaaaaaaaaaaaaagtccaggcgcagtggctcatacctgtaatcccagcactttgggaggctgaggcgggcagatcactaggtcaggagatcgagaccatcctggctaacatagtgaaatcccatctctactaaaaatacaaaaaattagccaggtgtggtggcatgtgcctgtagtcccagctactcaggaggctgaggcaggagaattgcttgaacccaggaggcggaggttgcagtgagccaagactgtaccactgcactccagcctgggtgacagagcaagactccatctcaaaaaaaaaaaaaaaagatgaaattaattttaatttatatatatatatatatatatatatatagttttgttttgttttttagagatggggtcttcctttgttgcccgaactcctggcctcaagcaatcctcccacctcggcctctcaaagtgctgggattacaggcatgagccaccacgtacaatttgatatattttatataatccaatgtaactaaaatattatcattttaatataatcaatacaaaaattaatgagatgatttacatccttttttttgacactctggctttgagatctggtgtgtattttatagactggccacatttcaagtgctcagcagccacagatggtcagtggccactggctggggctgcactggggcagagcacagtgagtaaaggggaggagatatgaggtaaggtcgaagcagtgggaaagggtcacctgggattttattccaagagcttcgaggtcgtgggagggctttaagcaggggcatcatgtgatctgactacttactgtctttgaagctgactctggctgctgcctggagggcttcggagcaggtgagattggctgcccagtgagatgcccaggtgggctgaaggtggcctagagctgcgttgatgacagccacagaagagcttcagggaatactgacaaggctgtgggcaggcagtgagacagggaggcaggcctggccgtctgcttttcctctccctctctttgaccaaaattccatccatgtaaccctgttcctatagctgccttccttccaggaagagatctgcgcagttgctacttaacaaagcctagaagaacccaaccagaataattttgccaagggctagaattgaaatatctgccaccttctgtagctcatagaatcactgtatttctgagcaagaaatcttttatttttttagacagagtcttgctctatcacccaggctggagtgcagtggggcaatctcggctcactgcaacctccacctcccaggttcaagcaattctcttgcctcaggctcttgagtagccgggactacaggcgcgtgccaccacacccagctaattttttctatttttagtagagacaggtttcaccatgttagccaggatggtctcgatctcctgacctcgtgatctgcctgccttggcctccaaaagtgctgggattataggcatgagccacggcgccaggcctagaaatcttctagccactcagtatcatacagtgattaggtggtctctggggctagcccgcctggagtgaatccctgctgcccctctaactagctgtgtgaccttgcacaaaatacttaattcttctggacttccatgtcttcatccggacaccagagcattaatcatctgtatctcttgggatgactgggaggggtaaatgggtctgtaagagtggttacaccaagggcactcctgttatctattattgttgatgttgccactgttattaacctacaagaacattgagccccagggataggaagggacctatccaatgttacacagcaaacctgaagcacagcaggaagcagaatctaaatttttaacttctgaggtggggcacggtggctcacatctgtaatctcagcattttgggaggccgaggcgggtggatcatttgaggtcaggagtttgagacctgcctggccaacatggtgaaaccccatctctactaaaaatacaaaaattagctgggcgtggtggcgggtgcctgcagtcccagctactcgggagggtgaggcaggagaatcgcttgaacccgggaggtggaggttgcagtgagccgagattgagccactgcactccagcctaggtgacagagtgagactctgtctcaaaaaaaaataaataaaaaaataaaaataaattaaaaaaatagctgggtgtggtggtgcatgcctgtaatgcctgtaatcccagctactagggaggctgaggtaggagaattgcttgaactcgggaggttgcagtgagccaagatcgccccactgtagtccagcctgggtgacagagtaaggctccgtctctaaataaataaataaatgaataaatgtttaattctggctcttactcagagctgcctctcaactgaatttgctggttgtcccttcatccagacattgaccatgttcttgccatgtgctggtgccacgtccacagcttgggggagacactaagatggtacaagactcatctctacaaaatcgaagttttccagttcagaaggaaaagctctttctcaaacactcttggccacagcgggaggaagccttagtgcatgcagagagtcgtgtgctggtaacggggcaattaaaacagtactggttgaagaaccaggagatcctggggtgccccagcctctgcccaacttgctctgtgatgcaggcaaggggcttggcctctctgggactcagtgcccttgtgtgtgctgaacttgtgttaactgggggcggactctaggcccagaccctgactccaaagtatgcacagccgattcccaggcaggctgggaggtgtagctagaactataggcatatgcctccgaggacacagatcctatggcccgaattttcctggaacacttctggctgacctgctcccttcgtaagagccatgtgtgtacttgatcacacatcctgggttttaaaatataatttgtcactataataaagtcatgagagtctagttcatccatttcacagaccagtaacatttccaaagaaactctggggaacctgcaaaggactgaaagttgttattctgccaaggaaggcccttagaaccaaacgacaaatggtgctggaaaaactggatatccacatgcgaaagaatgaaactggaccctttccttacacaacacaaaaatcaactcaaaatggatcgaagacttaagacctgaaactataaaacttacagaagaaaatataggggaaaagtttcatagcactggccttagtaataatttcttgaatatggcaccaaaagcacaggcaagaaaagcaaaaatagacaagagggactacatcaacctaaaaagcttctgcccagcaaaggaaacaagagtgaaaggcaatctactgaatgggagaaaatatttgcaaaccatatatgtaataagaagttaatatccggccgggcacagttgcttacgcctgtaatcccagcattttgggaggctgaggagggtggattcacgaggtcaggagatcgagaccagcctggccaatgtgctgaaacctcgtctctactaaaaaatacaaaacttagctgggcatggtggcgtgtgcctgtaatcccataatcccagctactcaggaggctgaggcaggagaatcgcttgaacccgggagtcggaggttgcaatgagccgagattgagccactgcactccagcctgggtaacaacagtgaaactgcgtttcaaaaaataaataggccgggctcggtggctcacgcctgtaatcccagcactttgggagcctgaggcgggcggatcacctgaggttgggagttcaagaccagcttggccaacatggtgaaaccttgtctctactaaataatacaaaaattagccaggtgtggtggcaggcacctgtaatctcagctacctgggaggctgaggcagggagaattgcttgaacctgggaggtggaggttgcagtgagccgagatcacgccactgcactccagcctgggtgacagagaaagactccgtctcaaaaaaaataaaaataaataaaaaataaacaaataaataaaaataggccacgcacagtggttcacacctgtaatcccagcactttgggaagccgaggtgggcggatcacgaggtcaggagtttaagaccagcctggtcaacatagtgaaaccctctctctactaaaaatatgaaaattagctgagtgtagtggtgggcacctgtaatcccagctactcaggaggctgaggcaggagaatcatttgaacccaggaggcagaggttgcagtgagccaagatctcaccattgcattccagcctgggcgagactccgtctcaaaaaataaaaataaaataaaaataaaaataaaaaataggcaaaggacttgaataggcatccctccaaagatgacatgcaagtggtcaacaagaacatgaaaaagtgctcaacctcactgatcaccagagaaatgcaaatcaaaaccacaatgagccatcaacttacacctgttagaactgccattatttaaaaaaaaaaaaaaaacaacagtgttggcaaggatgtggagaagttgaacccttgtgcatggttagtgggaatgttaaatggtgcagctgctacagaaaacagtatggaggtttctcaaaaaattaaaaatagaactaccatatgatccaggaatcccacttgcaggtatttttccaaaagaattgaaatcaggatctccaagagatatgtgaactcccatattgattgcatcattattcacaatagccaagaggtagaaacaacctaaatgtccatccacagatgaatggataaacaacatatggtgtgtacacacattggaatattatttagccatcaaaataaagaaagcctgtcatgtgctgccatatggatgaactttgatgactttatgctaaatgaaacaaaccagtcacagaaggacaaataatgcatgattccatttatatgaggaatccaaagaagaaacagaaagtagaagaaagaaaaaaaataaagacaaaaaaattttaagtagaaaaaagaaagggaaaaaatagtagaatgggccaggcacagtggctcacgcctataatcccagcactttgggaggccgaggtgggcaaatcacctcaggtcagtttgagaccagcccgaccaacatggagaaaccctgtctctactaaaaatacaaaattagccgggcgtggtggcgcacacctataatcccagctactcgggaggctgaggcaggagaattgcttgaacccaggagttggaggttaaggtgagccgagatcgtgccattgcactccagcctgggcaacaagagtgaaactctgtctccaaaaaaaaaaaaaaaaaaaaaaaatagtagaatgggggttgggttgccaggggctgagggggagtggggaacagagagttgctgttcaatgggtatagagtttcagtcacacagataaaaatgtccggaggtcttctgcacaacattgtggttatagttaacaatactgtagcgtgcacttaaaaatttaagaggagccggggcagtggctcacgcctgtaatcccagcactccgggaggccaaggcaggcggatcacaaggtcaggagttcgagaccagcctgaccaacacagtgaaaccccatctctactaataatacaaaaaattagctgggcatggtggtgggcgcccagtagctattacagtagctagctgtaatcctagctacttgggaggctgaggcaggagaatcgcttgaacccaggagatggaggttgcagtgagccgagatcccaccactgcacaccagcccaggtgacaatgcaagactctgtctcaaaaaaataaaataaaataaaataaatacacacacataaaatatattacatatatattatacatacatacatacatacatatgtattagctgggtgtggtggcgcatgcctgtagtcctagctactcaagaggctgaggcaggaggactgcttgagcctagaaggtcaaggttacaatgagctatgattgcatcattacacttcagtctgggtgacagagcaagacaatatctccaaaaaaaaaaaaatacttcttcaatttaaatagctttagttttgtgggaaaaaccaagaaccacagtgtgcctgtctctatttcttgctcttgttcccttttattccctcctgaatttctcaccacaccaggcctttttgttctgggactcttcctcctctaccctccccactccctcccctgcctcccccaagctcacagcatttcacacagttccagaaaagtgcttctctccctgactgccacctggccctgctgtcttcccacagggctgtgggctccggcagcagagaccttttcctactccctgtgcccctgcatctaaacagacccagcataggagaggggcctggtgaagatggctggtaggaaggcactagactcgggctttgagagccagaaggcctcagggagtgaagaatatgggactggcaggatctaggggctgaaatgagtggccataaaagaagccccctcaagacccaagactccttggtagtaagggctgggcatctctctgtgtcccacctcacaccctggggcgggtgaggagaggaagtggaggggttgcagggttgggggaacaagcgacaagcccgccctcctgaggagccccagggctggtacaaacggcaggaagaggctgagctgggcccctggagccacagaggcaggagggagtgaagaggccctgtggctgccatgggggacagtccagcagcctcctcctgctcccctcaagactggccggaggtgtctcagcccccgtagccaaccacagagagagcacagggcggaagtggctggcgcctcagccatagctgccggagatgggctcaacggccacacggtccccacattcggggagcctcaccgcagccccgtgggcacagagacccaggtggagctccaagggacacatgaggcacagggagtctagggcagcagcttcaaaaccacacactggtctttctgctggcttttttggtcaccatcccctgcttaaaaccccagggtcaccccacactttcagcacagacaggctgcattccacccacctgcaggctcctctgcccggcattcatctgtgccacctgccccggccatttggctccgactgcaatgacacgtttgtctgggagattcttcaagggcacataaaacatatctgcctttgctcactgtgatgtctccgacgcaaagcagagagcccgccagcgtagccactcagagctgagtggtggtggaatgagtgaaaaggctgcagctggaagggctgggaggcggggggcagagtgggggcagccaagggttttggggatcacacaggcttgggaagaaaagtcagctcagacccactggctatgtgacctggccctgcaggtccaactgtcaatgggtctaaccccgcccacctcaatgatctgtgagagctgagcgggggagacactgttcagaaaagactgggtccctgaaactgttgttgtcgtttaatccagccattttttttaagtttgtttaagagacaggggtctccctatatttcccaggctagtcttgaactcctgagctcaagcaatcctcccaccctggcctcccaaagtgctgggattacaggcgtgagccaccgtgagcttggccccagctctttcatttatggacaggacatttcaggagagggatccatccagtctcatcttggtgtttaatatttaaatgcaccaaaaatggggtgccaattggtgccaactttttggaaagagactttgatgtaatctgcctaaaagtaaaatgctcatgttcagcaactcagcccttcagcttctaggaattttgttctgcagggaaaaaaaaatgctgtatttgtattattaatattgttactgggtggcagggggaggaaagtattcagtgttttcagaaccacccaccaggaggcgcttttgcatcaggggcccaatcaggttagcccagagcacctggatttaagtagcaaaaacaaatgacaatctctagcccaatgtctcaagaacattccagtcttttacttcatctcaccctcgaaacttcctttttttttttttagacagagtctcactctgtcaccacggctggagtgcagtggtgcaatcacagctcactgcagcgtcgacctcccagactcaagcaatcctcccacctcagcttcctaggtagctgggactaggtgcacatcaccatgcctagctaatttttgtattattatttttttttttgtagagatagggatcttgccattttgcctaggctggtcttgaactcctgggctcaagcaatcctcctgcctcgggcctcccagttctgggattacaggagtgagccactgcgcctggccatgaccaaaacttttattagagacagtatctacttgcttggtgccctctctgcccttcctcctaaagaatcccccttcaaaaggaaaaaaaggccattcaaatttgagagagactcaggggtccagagtaaactaagttaaatgaaatcaaacctggaccgtgggcttcaagtgtgttattaaccccctccctcctgtcctgctgcatccttggctctgccctttcacttacgtccacgtctctaaacccagccgttcttccttctcccttgggtctctgtgtcttctgtctgcctcaggtgtccttccacacgctacccacccgcctagggaatactccttctgagttcctgggcaaaccacccagttctcctcctgaaccctcccccaaaaggctccctgcacgttccatctcatgagggccaggctgtgcccaggtgaggacactcatcacctccacttttcccatcacactggtgtgtggagcgcccaccccacctgggatgtagagggatgctccttgcccagcagtgcttctccctgggcctcagtttcccagtctagggtacccccacacctctctcagcttgggcgtgctgtactttaccccatgtcagcagttctcattaagctagtctttaaaggaggaaaaaataattttaaaaaatcttcctttgttctggcctccggtctatttacaatgacagttcatgaggaactgggttctgagcgaaaacaaacaaaatgcctccattttagaaggggtaaggtctggaggggaaagagggagataggaaagaacctgtggtggcctatcctctccccgtgacaggaaggcctttgaacaacacaattctgattgtgctgttgctacctcatttcaaatccttccccctgccccaccctccagaagcagcacctggcatggtaggcaaagccccatcagctctggcctgcacgactggcgctccagctttggctgtcctcccgcagccctgggatccctaagcctagaatacgccacgcccattcccccaccttccccaccagccgaattccccttccgctggggagactcaggttgggggtcaatcttcaagaagcctccctgtccaacccactgaggcaggtggcctcagggtcagggctccaggtttcccccacgcccaccccactaacacacacacacacacacacacacacacacacacacagccacctgggaattccagggagcacagctgcgagggcagcaaggaccacaacaatgctgaccacaatagtggctccaggaaggcctgttcttgttccgggcgggaggcctaaggcagtgatgctccctggcagcctctggaagcccaggggaagccagtttctatgtgggattccctgactctggcccatgggcttaggaacacattgtgtccctccactcccagggcactgagtcccagctgtggggtcatctgagtcccacagcacacctgctcatttgttcattcattagtttattcattcattcaacaaatatttattcagtgccaggctttgggccaagaagagaaagccactaaaaagagcaacagataaatacacggttgcacgtgatgtcaagtgtcataaggcatgatggggtgtgagaggatgcagagccaggtggccagggaaggcctcctagagatgatgcttgagctgagatgtgacaaatgaggaggtgttagcctgggaggccactggaggccggagcagcagagggagtgcaggcatggagcggctggccagacacgaggcaagaggagaaacagaggctggatcatgcaggactgtatgataggtggggaaaccgaggcatggaaactggtgacttgcacatggccctgcaactagttagatgctcgcttcctaagtgccacccaccccaggaaccaggccttcccatctgagcatgggatgcctgcactgctcttcttcgcagtggaacaaaggaacccgttttttttgttggttttgagacgaagtttcgctcttgtcgcccagactggagtgcaatggcataatcttggctgactgcaacttccgcctcctgggttcaagcgattttcctacctcagcctcctgagtagctgggatttacaggtgcccaccaccatgcccagctaattttttgtatttttagtagagacggggtttcaccatgttggccaggctggtctcgaactcctgacctcaagtgatccacctgcctcggcctcccaaagtgcttggattagaggcataagccaccgcgcccggcctcaaatggttcttaatcacctagtgtctgtcatgtgtccacccggggttacccagggcagagacggcatcatctccatctcagaggcccagggccgggtgtattgtaggtgtttaataaacacttgcttaattggatcttggtatctccaggatgtaggccccgatgctgcccttgaccacatggctccctgagtgttaactgaaccagcagagttggtcttgcagcacgtgcatctcattcaggcccactgcattttctggccctcactgctaagagtccgtgcagaaatgtgagttctcagcagtgctgagagcactgtgtgcccccaaagagctctgactctcagctccccacattggtttcacctctaatttgtacccctctagctcaaaccttaatggcgaaagcttgacatcgcctttggcaattcagaggctattacttgtcagcactatctaccttgtcagtgcctgggagaagcaaaccccacctcataagcatgtatcaagcaatcacttatcaagcacctcctaggttcgggatcttttagaaagccccacttggggaggtgcgatggggaatggctctgggcctccccataggccagtttatcagctctcacagaggagcacaaaccactggctcaggacgtgcaggtgcgaaggaaagaggaagggcgtggttggcagcccctctttccctgggcagtctgagtcacattccacctctcccagtgttacagggtttgtgaaatgaccacagctcctcactcttctgaggagaaaccagaggtagaggagaaagcacagagtagtgcagagggaggagccctgcctcccctccacacccttctaagactgttaacatgtccttccagcaatgtcagccagtgtcagctgtggggtgcatcagaattctggaagcccagaagtccaggaatttgccatccagacggtgagacatatgcatagagaagtgcagcacaggctgggtgcagtggctcacacctgtaatcccagcactttgggaggccgaggtgggaggatcacttgagcccaggagttcaaggccagcctgagcaacagtctcaatagtgactgtctctatttaaaaaaaaagaaaaaagaaagaaagaaagaaagagagaagtggctgggcgcggtggctcatgcctgtaatcccagcactttgggaggctgaggcaggcagattacctgaggtcaggagttcaagaccaacctggccaacacagtgaaaccccatctctactaaaaatacaaaaattagcagggcgtggtggcacgtgcctgtaatcccagctactcaggaggctgaggcatgagaattgcttgaacctgggaggcagaggttgcggtgagccgagatggcgccattgtactccagcctgggcaaaaagagtgaaactcggtctcaaaaacaataaatagaagtggccgggcatggtggctcatgcctataatcccagcactttgagaggccaaggtgggcggatcccctgaggtcaggggttcgagaccagcctggccaacatggtgaaaccctgtctctactaaaaatacaaaaattagccaggcatggtagtgggtgcctgtaatcccagctactcaggaggctgaggcaggagagtcacttgaactcaggaggcggaggttgcagtgagccaagatcgcaccactgcactacagcctgggggatagagcaagactctgtgtacaaaaaaaaaaaaaagaagtgcagtgcaggcaactggtgctcagatgggaaggcctgtcagggcactgtgtcggggacagagatggttgccgccatcctgggacagtgtccaacatagtgcaagagatgggctgggtgaggcataatgccagcgatgacagcaaccacccccagtggtgctggctgtcgttgactgtggttcactgtgagtgccaaacacacatgctttgctgcatttactcctccagccccggagttgccactgctcccatttcagagatggggaaaccgtggcagggagacttgcccatgggcccccaggcagtaagagtagggctggagggaagaaactggcaggctggttccagagacctccctcttaggtatcactgagaggggcttccaggcacctctgtgtggttgaacttgctgatctgttcaaactgctgtcatataaggacgttcaacttgattttcagcatcaccagcaaccttgctgctccttccccctctgggctagtagggtgagagctcttctcagagacaaagaccaggatgcaggagcaggcatggcttggcctgcagacaagactggtaggaggaggagacctggacccagttgctctaaatctagcaaaaagattttctaggccctccagaggctacctcctccccttagctcccactgcctgcagccgcctgcaaattgcttagaagtgttgataattacagcaggcccaatcccatcaacacctgagggagaggaaactggagggtcctccttctgtaagcttatcccagagcccactgacatccatcatctcccctgatcccctaggatggaggcaggaggtgggacatggtccctgttctcttgagcaggctagtgacttgcccaaggtcatgcagacccttccagggaatactgggattagggctcagcttttcctgctcagctcagcacccaccgataaccagtagcgcttttccttttctgagctgagcaagcctcagagggcgagtgaaagaggagccaccggaaggtgctctggcaggtcagattgcccacgcatgccagtgtccagccccctgcagaactctgggccttggtgaggtcatttcagaaggaaagaacgttggcactaacagggatctcaaaagcacccagtgtaggccaggtgcgttggctcatgcctgtaatcccagcactttgggagacggaggtcaggagttcaagatcagcctggccaacatgttgaaaccttgtctctactaaaaataaaaaaatcagccttagccaggcatggtggcatgcgcctgcaatcccagctattccagaggctgaggcaggagaattgcttgaaaatgggaggcagaggttacagtgagtcaagatggtgccactgcactccagcctgggtggcagagtgggactctgtctcaaaaacaaaaaccaaaagaagcacccaatgtaagcctttcgtgttatagatggggtcatagaggaacagaggatgaacagagtctgcccaagactgttagcaggttagacccaagcccctgactccccatcccccacttctcttctggtgcctgacaagagagtagtttcctacacattcaccttcttcataggctttgcctccaggagccagggaagtgtacagaatggctttggggctgggcagacttggtttggagccacatccccctacttggttgctgtgtaactttgggcaaatgaatttccctctctgggcctgtttcctaatctgtaaaatggggaaaataataactgcttcttaatgtaagaattcaatgaactaaggtgtccacaggatggagagctctgcaaaggccccaggcaggcaagggactgaagacaggcattcctgaaggctaaaaggtgatcaggcattccacaaatcccccttcctctttccctctctgatgccaaatacacccaagctcagagacacatcttctgcctgggctttgagacaggcctgaaaaccctcccacactgtctacaagcacagaagagcttctctctggaatgattgctctgacctggaggagatgacagagccagcactaggaatctctggggagagcgctccaggagctggtgcatgggtggaaaggtggaattcctccccactgctgccacccccaacactgcccaccccaggagcctcctggcttccaggggtggctgcagagacctgctaggtggaggggttttctcagggagccttcacttgctcccacagacacatctgctgaaagcagtgcaggcaggcatgaggcaggcagtggagctgcaactggctgacagcaggctggagaggggagagggagaaagggagcgaaaagggggaggggagactgggtgagtcgtactcccttccccacggcccaccccgacaagctaagaaaagctctggggggagaaaagctgctaagatgcacagttgccctcccctctgtgggaggcccttccttccccagagccagctgccccaggcagattagcattgggctccggaaaagcaggcccacaccagcccatgggaggccgccggctgagtcagctcctctacctggcaggaaatcattcataaaaatgacacctgcccagagcccagcgcccagcctcaccagccagagtctccagccacacagccacactgcctcctgccgcctccctcccacctcctcccagccactgtacagggcagacctctttctctttctctttctcctgggaagaagaataatgagactgatgtgaaataaggccagctcggccttcgtcaatcagtatttacgggtcgcctgccctggggacaatagtagagtcaagaagagcaaccacttcactcaatgatgaacaaacatctgcgacacagcttccagaggttctcactgtcccagccacgtgcgtggcggacactctttacgttcagtttctgtgtggatgaccagaggctccttagacacacagctagacacagataactgggccaatcctcccacaaagggggtccgtagagcagtggtgacttacacaggtcacacgtgaggtcaaactttaagtccatgtcaggccggtcgcggtggctcatgcctgtaatcccagcactttgggaggccgaggcaggcggatcatgaggtcaggagatcgagaccaccctggctaacatggtgaaaccctgtctctactaaaaatacaaaaaattagccaggcgtgatggcacgcgcctgtaaccccagctactcgggaggctgaggcaggagaatcgcttggacccgggaggcagaggttgcagtgagcctgagattgtgccactgcactccagcctgggtgacagaatgagactctgtctcaaaacaaaaacaaaaaacaaaaaaaaactttaagtccatgtccctaaaatgtagacaacattccatcttgttctttctttttttcagagacagggtcttgctctgtcacccaggctggagtgcagcggtgccatcacagctcactgcagcctcaatctcctgggctcaagtgatcctcccgcctcagcctcccgagtagctggggttacaggaatgagtcaccacacctggcccatattgtcattcttacttcccttcgttcaaaccctgatgcactctcttatctgggagataaaatgcaggctgctctcctgctgaagatgttacatcctaatcacagccctgcatgtctgggcctgcgatctcggccctcatatcgctcccccttgatctccttcaccagccgccctggccttgtcgtttctcaaactcacaaaacatgctgtcacctcagggcctttgcacgtgccttcccttctgtcttccatcattacatgtcaggctcctctgcatcctgcaggactaggtcacctgtcagcttctcagagaccttccctgaccactttaagaatctgcctccccctggccgggtgcggtggctcatgcctgtaatcccagtactttgggaggccaaggtgggtggatcacaaggtcaggagttcgaggccagcctggccaattgggtgaaaccccgtctcaaaattagccaggcgtggtggcacgcacctgtagtccccactactcaggaggctgaggcaggagagtcacttgaacctgggagacacaggttgccatgagctgagatcgcaccactgcattccagcctaggccacagagtgagacttcatctcaaaaaaaaaaagaatccgcctcccacaacacacacacacacacacacacacacacacacacacacacacacacattattccctatccctgcatgaagacagctcccatcctaactcacagaacaagttcattatggacttctttacccagctactgtctgtctccccaggcagagtcaacccacaaggttgattttgctcaccctggtgttcccaaggcctggtacaaagtagatcctcagaaaatatttgttaaatgaataattaaatgacttctcactgtaagcaattggcaccacttaggctagcactcaagcaccttctatcctcttgaccataccacaaagttaaccagttacacgatcagaacacctcttcttcatttgttccttcttatgatgttcagtagagagaggctcagaagagcactgcagggtgaggctggagctaggagtttggaacacaggtgcagggctgttccacccaccacacaggtgaactcccagagggcaggggcctgttgatggtggatgggaacattcagtaaaacattccataaactgttgccttttttttttttctgagacagagtcttactctgtcgcccaagctggagtgccgtggcgtgatctcagctcactacaccctctgcctcccaggttccagtgattctcctgcctcagcctcccaagctcccaagtagctgggattacaggcacacaccaccacgcctggctaatttttgtatttttagtagagatggtgttttgccaagttggccaggctggtctcaaactcctgacctcaagtgatctgcccgctcggcctcccaaagtgctgggattagaggcgtgagccaccgcgcccggccttgccatcatttttgttctcctctgtgaagaggacagccaagagtgtcagaggtcctcaaacacttgctgcttcataaggagggtctcccccttcttaccaatctctaatcagcatttacaaagcagccaccaggacccagacctccattagaagcccaggcaaatataaccaaagtgtatgatctagggttctcaacacgtacgtgcacatcagagtcacccagggagcctgttaaaagcacagatgggcacagtggctcacgcctgtaatcccagcacgttgggaggccaaggtgggcggatcacgaggtcaggagatcgagaccatcctggctaacagggtgaaaccccatctctactaaaaatacaaaaacttagccaggcgtggtggcacacgcctgtagtcccagctactcaggaggctaaggcaggagaatcacttgaacccaggaggcagaggttgcagtgagttgagattgcgccactgcactccagcctgggcgacagagcaaggccccatctcaaaaaaaaaaaaaaaaaaaaaaccacagatgtcctaatcactacccattccatcctattttgatttcacaggtccaggctggggcaaggagagctcccaggggattgtgatgtgcaccaaacactgagaacccctggccatgcaggggaactccctgaggagcttctgcaaacaaggatgccaggcccctctgctatcagagatcctcatcttaaagagcctgggctggagacctaacagtgaaatttttcaagcattcctcaaatgctgttgtgcagccagggtggggggtgggggggatcacttgaggtcgggagttcaagaccagcctggtcaacatgctgagaccctgtctctactaaaaatacaaaaattagccgggtgtggtggcaagcacccatagtcccagctactcaggaggctgaggcaggaggattgcttgaacccaggaagtggaggttgcaacgagccgagatcgtaccactgcactccagcctgggcaagaaaatgagatgcagtctcaaaagaaaaaaacaaacaaaggaaaacgattcctgcattttatcatcaggaaactgatgcaggaaaaaaaaaaaaaggtcttgccgggtgcggtggctcacgcctgtaatcccagcactttgggaggccggggcgggcagatcacctgaggtcaggagttcgagatcagcctgggcaacacagtgaaaccccgtctctactaaaaatacaaaattagctgggcatggtgacacatgcctgtaatcccagctactcgggaggctgaggcaggagaattgcttgaacctgggaggcggaggatgcagtgagccgagatcacgccattgcactccagcctgggcaacaagagtaaatctccgtctcaccaaaaaaaaaaaaaagagagagagagaaagaaaggtcttgccagtaccttctgtccaggccttgcaaacccagagtggccccaagtcagtggggtctccttcaggccccacaaggcgagctggagagctgctggaaatcagctgatgtgctggcagagctccagcccagagtttctcatgacttggagccgacatattcccagcatctcagctcatttcaggcaaaatcatcgagcatattttaggatcagcaaaaacccacaatgcctttggccgagcactttccctcttcttgttgaagcccaggggtattttctaggaaattgagtccatctgtttctgattcattcgtacttaactcatcaccgggctgttttgtaagagccctttgatgtgaaagccgccttattccataagcctctctaagcctttatttagtcaacagcaggtaaacgggcctctccaaagaggccagaggcagcatattgatctcctgctacacaaagtccatgtgaagggaaagtgtggcccaaacgcctgcctggagacactgagactccccgtctttgggcctagcagggcaaagcagaccactccctagccctgacccagcgctgtggggctcagccacgcagagggacctcctctggcgactcactaactctcctccccaggcactgtaacccagcgtcctcctccataactcacagccttgctacatagatttacgatttcctgtatgttgcctaagagttccttttttttggtgggggacagggtcttgttctgtcacccaggttggagtgcagtggtgtgatcatgactcactgcagccttgacctcccaggctcaagcaatcctcccttcagcctcccacatagctgggaccacaggtgtgtgccgccacacctggctaatttttgtattttttgttgagacagggtctcactatgttgcccggactggtcttgaactcctgggctcaagtgatctgcccaattcagtctcccaaagtactggggttataggtgtgagccaccgtgcccagccccaagtggtttttttttgttttgttttttgagatggggttcaagcgatcctcctgcctcagcctcccaaatagctggacctacaggtgcctgccaccacgcccagctaatttttgtattattagtagagacagggtttcattgtgttggtcaggctggtctcgaactcctgacctcaggtgatccacccgccttgacctcccaaagtgcgggggttacaggtgtgagccacggtgcccagccaatagaattttttttttaaagagaaccattggtctagccattcatttagtcttgggtagaacttgcagggggatcgggtagctacctaccaccaataaatttgcttggtttatcattttctccaaaagtactcagtactatggcttaggcttagtactaagcacccaatgatgagtgatagaggtgatgatgtacaactctgaagcaggcactgcattcagtcctcagaatcaccttcagaggatacactatctccattttatagatgaacctcaaaggtatggacaggtgacacaagcctccaggttacgcactgcttagcaccagggctggtacacagtgggcggctaacatattctcactgaactggtgcatccatgaatataaacaataataggtggatttaggtcgagcatggtggctcacgcctgtcatcccaacacttcgggaggctgaggcgggaggatcacttgaacccgagtttgagaccagccgggacaacagagtgagacttcatcattgcaaaaaatttaaaaattagccagtcatggtggtgtgcacctgtagtcctagctactctggtggctgaggtgggaggagctcttgagcccaggagttcgaggctgcagtgagttatgattgtgccactgcactccagcctcagtgacagagtgagaccctatctttagaaaattaattaattaatttaaaaaaaggaggtggtgggctgggcgcggtggctcatgcctgtaatcccagcactttgggaggccaaggtgggcagatcacctgaggtcaggaattcgagaccagcctggctaacatagtgaaaccctgtctctactaaaaatacaaaaaagttagccgggcgtggtggcatgtgactatagtgccagctactcaggaggctgaggcacgagaattgctcaaacccagatggccaaggttgcagtgagccaaaatcacgccactgaactccagcatgggaaacagaatgaggctctgtctcaaaaagaagaagaaaaaagagatggatttaagtctcaggccaggcacggtggctcacgcctgtaatcccaacactttgggaggccgaggcaggtggatcacctgagatcaggagttccagaccagcctggtcaacatggtgaaaccccgtccctactaaaaatacaaaaattagctgggcatggtggcatgcccctgtaatcccagctacttgggaggctgaggcaggagaatcgtttgaacctggaaggcggagggtgcaatgagtagagatcgtgccactacactccagcctgggcaacaagagtgaaactccatctcaaaataaataaataaataaataaataaataaataaataaataaataaataaataaaaataaacccaagtctcattcaaagtcaaacacattctaccacattagcaagaagtgttacatgaggtaatgcacactgtgggagagaaaggactccctcccttcttcctgccttccctccctccctctcatttgagtttatgaaagcagtgatgcgaccaaagcttttctgaatctaacctaccctcaagacatgcagggcctaacttagggagcagcgatgaacagagatggtaaggaactggtttcacaggggccatgacatgggggaccacctgctagaggaactgcaaatgactcaggccacgggctcagatcagcccagggaatcaccgcagtctggacagcaacaaggcatctagaaataattgaggtggtcagtggggaggaagttcagttgttttggctggaaaaaaggttgtttttttagaaggaggctatctctgtcacctacgttggagtgcagtggcctgatctcagctcactgcaacctccacctcctgggttcaagcaattctcctacctcagcctcccaaatagctgggagtacaggtgcgcgacactatgcctggctaattttttatttttagtagagatggggtttcaccatgtttcccaggctggtcttgaactcctgaactgaagcaatctgcccgccttggcctcccaaagtgctgggattacaggcgggagccaccactccctgcttgaaaaaaatgtttttttatttttattttttttatttttatttttttgaggggattgcacagtttatttccaaacactcagaggataggaggtggcctatgggctccatctgcctcccctccctgcatttggctgaatcaagaacttctccccccgacccccaagaccctaggctgtgcccaatagagaaggcactctcaccccccaccctgaggagacctagacaggtgaggagcatggagggtgggggaacagagttcaagtattcacagttcccccatctacacccctggattacactgtgccagagccatgagggaggatcccacctctgggattcctagtggtgttgatagtccttctcccacttagaaccctccagatgaactccctactccttttccctgaaataacaaaccaagtcctaagccctgtagtctgggcaaggaggggccttagcaggccactcacccaaggcccccagggatgggggtgagagccttcacctgtagtgaatgggttgggagcaagtgtctataaggagagaggaagggagagaactgagaggaccctgggaggcaggcttggaggcttctgacacatgagttcagacagctctggtctgcgactccaccccaccccacaccccaagcccagaatccctgagagtccaactgcaaaggcagtatggccggagggaggaatgggagcaggggtagagttgagcaggaccttggcccccctctcctagtaggtcctgctcctgggacacatgcttagggacggccaggaccaggctcaggtcctagtcccatctcttagggtgctgatcttccagaatagctgaatcctggggaacatagacacaccaatccccacaccccagacgtcctggcctcaggtagaatggtgggaatgggctctcacaagggtattataaaaagctaaaaccattaaacactttctggggagaagtggctcccagtctcttgcctccccaagttatcagtctccccagcgcctagcagacagggctaaggaggtcccagagagctgagggaggagacggccacagcccctgggcccagagagagggcccactagcaccatggaatgttgaggtgcctctgcagcctgactggcccccacacaggggccctccgaagctggagtgcacacttgctaaagcttctgtactcttgagaggggacccctgcaagggagcagagaaggcaaagacttcgcttaagtccaggcaggggtctgaactgggaccccaaagggcacccttgggagtcatgatttgaagaatcttcgtaccacaaactggcccaacagaaccacacccagaaccaccagcacgttcaggatgggaccattgcccaagttcagggctgccacccagccacccctctgtgcaatccaccgggcaatgcagtgatgcagcatgaagtccaccacaaagcgggtcacctggcccaggaagccagtcaggccacgctggtagatgtgtagggccagacggtagctgaagcccagaagagccaccacacggccccaattgatgccactctcaaacaggctggaggcaatcttggtgaagtactcataggcattctctgccgtgggctgcaggtgctgcaacatggtctggaactctgagtcatagcgtcggttgatgtcgtccccaatgatggcgagctgccgtcccacctgccccatggtgctgctaggttgcagaggtaaggtgaccatctctgggtcggcaggggcagccgccccttcagcctcctgttcctgctgatggtggtaaaaaacgtagctgcggaaaacctcctctgtgtcctgggctacctgctcctcagaagcagagggcagggcaggctctccgcactcctgcctgggaggacctgggccttgccccgaggccatttttcaggtctcagtggaggacgggatcagcctgccgggatcctggcccaacccgggtggctcagcagggtggagatggaggtcccgaggggctggcggctgctgctcccaggggctgagtgggagcccagtttccaggaatgggcgtcagtgcattcccagcatctggatgtagcctttacttgtccctgtgcagcctgagggacccgcgagactccagtgatcatagaggtgccagccaaaaatgtttttttaaatgatgttctcagtatctacgttcttagcaactaagatgatggatcttagttatagaactcataactaataaaatcctctaggactacagttcatacaccaaaaaatagaagctataataatcttgtataaaggaaagaatctaaaatagaaactatggacagtggctacctctggggaataggttgtttttacttttcatctttttcagttctataacatttgaatttttattaagtatatttcatgtattgtctctataaatagagcacattaatttatattaaaattgaaaatttttgaaactataaataagcaaaagaaattaaaaacctataattctactgcccaaaaataaccaccgataacatttttgtttatatccattttgtccatttagtttgtttctatgtaaacatttttttaaaagagaagtttcaccctcaccttactatgttttggcttttttttctttgagatggagtctcgctctgttgcccaggctggagtgcagtggcgcaatctcagctcactgcaacttctgcctcccgggttcaagcgattctcctgcctcagcctcctgagtagctgggactacaggcgcttgccaccacacctggctattttttgtatttttagcagaaacagggtttcaccatattggccaggctggtctcgaactcctgactttgcgatccgcctgccttggcctcccaaagtacttggattataggcatgagccactgcgccggcctgttttttttttgtttttttgttttttgtttttttttgagacagagtcttactctgttgcccaggctggagtgcagtggcgcgaccttggcttactgcaaactccgcctcctgggttcaagcgattctcctgcctcagcctcctgagtagctgggattacaggtgccaccaccacgactggctaattttttttttttatttttagtagagacagggtttcaccatcttggccaagctggtcttgaactcctgacttcgtgatccacccgtctcggcctcccaaagtgctgggattacaggcgtgagccaccacgccaaggcttttttaatttctaattttttataaaggcagggactcgctgtgttgcctggacttgtctccagctcctgggctcaagcaatcctcccacctgcacctcccaaagtgctaggattacaagcatgagccactgtgcccggccctcaccttactgtcttctaacctcatttttgtgtctacacatcacgaccatgatcctctttgtagcactctcttcaacattagttattctcatattaaaacgggccatttacattggtaaacattttaaaaactgtgatgtatccatgctttggaatgcaacactggcacagtgattcatgcctgtaattccagaactttggaggactgaggtgggaggattgcttgaagccgggagttcgagactagcctgagcaacattgcgagaatctgtctctacaaaaaatacaaaaaaatttaggtgagcatggagaccagtaaaaggcaaaacagtagggacagaaaccaggccagtggctgccaggactgtgctgacgggagggctgagcatggtggcacatgcctgtaaccccagctacttgggaggccgaagcaggagaatcacctgagaccaggagttccagaccagcctgggcgacatggcaaaatcccgtctctactaaaaaatacaaaaattggccaggcatgcaccacagggcttttaggctcagccaggctcaggcggctccatggtgcttccaacaaaaattgaaaaaaaaaaaaaaaaaagaaaaaaaaattaaccggcatggtggcacacacacttgtatttccagctactcaggaggctgaggtgggaggatatcttgagcctgggaggtggaggttgcggagagctgcgatagtgcactccaccctgggcaacagagtgagaccctatctcaaaaacaaaacaaaaacaaaaacaaaaaacaacccagccataaaaaggaaagaactacagatgcactagtaatacagatgaatctcaaaaacattatgctaagtgggagaagtggggcacaaaaagctacataatgggctgggcgcggtggctcacacctgtaatcccagcactttgggaggccaaggcaggcggattacttgaggtcaggagtttgagactagcctggccaacatggggaaaccccgtctctactaaaaatacaaaaattagccgggcatactcgggaggctgaggcaggggaatggcgtgaacccgggaggcggagcttgcagtgagccgagatcatgccactgcactctagcctgggtgacagggcgagactccatctcaaaaaaaaaaaaaaattagctgggcatggtggtgtacgcctgtggtcccaactactcgggaggctgaggcaggagaatcacttgaacccgggaggcggaggttgcagtgagccgaaatcacagcattgcactctagcctgggcaacaagagcgagactccttctcaaaaaataaaaaataaaaaataaaacaagtctccataatgaatgatgtcacttaaatgacattctggaaaaggcaaaacagtagggacagaaaccaggtcagtggctgccaggactgtgctgatgggagggctgactctaaccacacatgagggcacttcgtggggtaatgaaaattgtccatgtcttgactgtggtagtgattacactaccattacacatttatcaaaactcactgaactgcatactcaagaagggtaaatttcactatatgtaagttacttgacttctcccaccccccccgccaaaaaaaacaaacgaaagtgctgtccaaatataaagtatcattagacattatagcacttttctcagagattctgaaatacctttgtgaaatgtgacaaatgttaaaaaaacaaaaacaaaaccccagccaggcgtggtggctcatgcctataatctcaacattttgggagaccaaggcaggaggatcccttgagcccaggagtttgagaccaaccctggcaacagagtgagaacctgtctctacaaaaaatacaaaaaaaaaaaaaaaaattagctgggcatagtggtgcatgcctgtaatcccagctaccagggagaattacctgagcccaggaggtcgaggctgcggtgggtcgtggtcacaccactgcactccagcccgggcaatagaatgagactctgtctcaaaaaaaaaaaataaagcaacttggaaaagatcaagtatcctttagaaaaatatttgttgttgagtgttctgtctttcagaaaggccattttccactctggcaaatgctcatgtgtcaggttgctggtcccacaagagagcagttgaccacttgggctatttgaggactttccacaacatcatcagcttttttatttttaaaatatgaggctggagtgtagtggcacagatcatggcttactgcagcctctaactccggctcaagcaatcctcccacttcagcctccagagcaactgggactacagtcacatgccaccacacctggctaatttttaagttttttgtagagacagggttttgctatgttgaccaggctggtctggaactcctggcctcacatgatcctcctgccttggcctcctaaagggctgagattacagatgtgagccactgtgccaggcccagcttcttttttttttttttttttttttttgagacgaagtctagctctgtcgcccaggctgcagcacagtggtgtgatctctgctcactgcaagctccgcctcctgggttcacgccattctcctgcctcagcctcccaagtaactgggactacaggcacctgccaccacgcccggctaattttttatatttttagtagagacggggtttcacctgtgttagccaggatgctctcgatctcctgaccttgtgatccacctgcctcggcctcccaaagtgctgggattacaagcgtaagccaccgtgcccggcccccaggttctttttttaatgccactatagtaaaaataaacaatagtgtcagaactgaacagttataggaaacaagaatgataggccaaaaagtgaaaaaatgaaagaaaaaaaaaaagaactgaacaatcaacaccccctccccccacttgatcttcccatcccagccaagccagtcctcttccctccagggaaagaatacaggtatttctggctcatctcctcttgggccagactattaccatcctaatgaacactatactccaaaagcaaataaactgcaatcaaaagtgagattaccagacagcagatttctaaacagaattggaagaacagtgaatcaatgcaaaggtgcagtgctaacagtaagaaaaatcctgcccaaatcccccagcattgcagcaaaatcccccttgacagtctgcagagcctgatcaatgccccttattcaacagagtatattcgtgacaaaattccaatccagcaaaggaactgtagtagttctggagttcataatgggctctgaactattgtaaatgggagtgaggatataatctactcttacatagaaaaaacaacctggccaggtgcggtggctcacgcctgtaatcccagtactttgggaggcccaggcaggtggaccacgaggtcaggagattgagaccatcctggcgaacacggtgaaactccacctctactaaaaatacaaaaattagctgggtgtggtgtgacgcatgcctgtaatcccagctactggggaggctgaggcaggagaatcgcttgaatcagggagtcagaggttgcagtgagccgagatcgcgccacatcagcctggtgacagagcaagactccgtctcaaaaaaaaaaaaaaaagaaagaaagaaagaaaaaaagaaaaaacaacttgtcagttatctgtgttcagggcttatcactccctcccccagggcctagcaaagcctttgcccatatgaggcgctccaagaatgttggtggagtcatggagcaggatagtcaactgctctgggaagagggcccccttacactgtggagctatctgtgatctatgttaaaactgacccacaatgaaaacaacttccctggcctttttttttttttttttttttttttttttttcagacagagcctcactctgtcgcccaggctggagtgcagtggcgggatctcaattcactgcaaccttcacctcccgggttcaagcaattcttgtgtctcagcctctggagtagctgggactacaggcacgagccaccatacctggctaagtttttgtatttttagtagagatggggtttcaccatgttggccaggctggtctcgaactcctgacctcaggtgatccgcctgcctcggcctcccaaagtgcagggattacgggtgtgagccaccacacctggcctggatttcttcttctaaagtcagggaggtttgttaacattgcttccatggaggctctacactcagcctcatttcatttcaacaaagggcaggacctgttccaaggctggcttggggaggaggagcggggctgaatgatgctgattgtaggggtgattgagctgaaaagcaagtctcctatcacgaagctcatgggctgggcatggtggctcacgcctgtaattctagcactttgggaggccgagtcaggcagatcgcttgagcacaggagtttgagaacagcctggccaacatggcaaaacccttctctactaaaaatatgaaaattagttgggtgtggtggcaggtgcctgtaatcccagctacttaggtggctgaggcacaggaatcgcttgaaccccggaggtgggggttgcagtgagccaagatggtgccactggactccagtctgggcaagagagcaagactctgtctcaaaaacaagacaaaacaaaacacacacacacacacacacacacacacacgcacaaaagaaagaaagaaactcaggggctagtgggaaagagaatcctgggaacaaataattacgatttgataataagtagctcactggttagttaagcatgctctgtgtgaagtgatctaccccaataaccttgtgagctgagaattataaccctgttacaaacggggaaactaaggttctcagatgttaaggagtttgcccaaggtcacacagttaataagcagaaaggccagtattgaaacccaagcagggctgggtgtggtggctcacacctgtaatcttgatgctttgggaggcccgaggcgggagaatcacttgagtcaaagagtttgagaccagcctgggcaatacagtgagacagccccccctccccccaccccgctctctacaaagcgaaaaaagaaaccccaggcagtctgacttcagagcttgcactcctaacccctgaagcagaggaatgagggcccaaggtgtgtttattatggccaagaactatcaggagaggcctttagaaatgtggggcagcactgtgagcccaaggggagaagaggcagatggcaccatggcttggtggctgtaagcagcctggtagtctagatgctccagtaggatgcctgccatgaggcagtggagatggagcactggaggaggtcagcagggccaggttgtcagggctgagtgttctaagttaggagttctgactttcctctggacacctggcagaaccctgagcagtggatctgttgggtgacatgagacttgtgcataagaatggtcacacaggaaatgggctggactgtggaagctgtgaggctgaagactccaggggggccatcagaaagccaatgttgtgatccaggtggggcagcagcggctgaattgggcagggcaaggagctccctggtcagaatctgtccggtggccagctgggtgcaactcttacacagcacccggacttggacctgcaccagatggcttggcgtgctggaagcccttctagtgtcaggagcccatttctgaatcaagcaggaccccatggatcacaggacagcactgtctgacccctggccagtgaccacagtttcagtctccaggcctcagtttccccatctgtaatatgagtgagttttaaacagattgtattggccgggcatagtggttcacacctgtaatcccagcactttgggaggccgaggcaggcagatcacctaaggtcaggagttcaagaccagcctggccaatatagcgaaaccctgtctctactaaaaatacaaatctagccgggcatggtggaatgcgcctgtagtcccagctactcgggaggctgaggcaggagaatcacttaaacccaggaagcagaggttgcagtgagcgaagatcacaccactgcactctagcctgggcaacagagcaagaccccatctcaaaaaataataataataaataaattgatagtattttaggtaccttcccgttctgactttctgtgaacttttttttctaattttttatttttacttccttttttgtgaattctttttattaatacattagattctcatggtctcaagctacatgaggctctctgaaaactcatgaatatatctggacactgttcaaaggcactcatctgttcctctttggaacttttggacagtaaacttgctggtggaagcagaaattgaaagaaggtagagatcaacttggcactgtgaggattaattttgtgtcaacttggctggaccacagtgcttagagagttggttgaacactattctagatgtttttctgaaggtgtttatggatgacactaaattttttttttttttgagatggagtctcactctcacccaggctgaagtgcagtggcacaatctcggctcactgcaacctctgccccccgggttcaagcaattagattctcttgcctcagcctcccaagtagctgggaatataggcacctgccacagcgcccagctaatttttgcatttttagtagagacagggtttcaccatcttggccaggctggtcttgaactcctgacctcatgatccacctgtctcagcctcccaaagggctgggattacagacgtgagccaccttgcccggccgacactaacatttaaatcagtggacttttgccaggtgcgatggctcacgcctgtaatcccagtactttgggaagctgaggtgggcagatcacgaggtcaggagttcgagaccagcctgaccaacatggtgaaaccccatctctactaaaaaaaaaaaaaaaatacaaaaattagccgggcgtggtagtacacacctgtaatcccagctactcaggaggctgaggcaggagaatcgcttgaacctgggaggcggaggttgcattgagctgagattgtgccattgcactccagcctgggcgacagagtgggattccatctcaaaaaaataaaaaattagtggacttttaagtacagcagcccccccttatccatgtgggatatgttccaagacccctagcagattcctaaacccacagatagtcccgagccctatacatatgtttttctcaatctgacaacagtacctgctactaaatgattaacagcatatatagcatgggtaccctggagaaaggattgattcccataccacaacatgaattcgtgtccaggatggagtgggccagcacgagatttcatcatgctactcaggatggtaggcaattgaaagcttataaattatttctggaattttccacttaatattttcagactgtgagtaaatgaaaccagggaaaatgaaaacatggatacagggggacctattgtatagcaaattcttctccataatgtgggtgggcctcatccaatcagttaaagccttaaaaaaaaaaaaaaaaagcctggcatcctatcccttcctccccagcaaggaattctgatagcagacagcctttattttcctattttttttagagacaaggtctcacgccattgctcagactggtcttgaactcctgggctcaagtgatcctcctgccttggcctcccaagaagctgggggtacaggtgtgtgccacagtgcctggctagtagataccctttgaactgcaactcttcctgcatatgcagcctgctggtctactctgaagactgaccatgtcactgtaatcatgtgagccaatcttttaaaataaaaatctctctccccaatacatatacatatacatatgtacacatacatcctgttgattttgttctctgagaactgtgattaacactggcaccatttatcaaaactgctcatactggaccaggcgcagtggctcatgcctgtaatcccagcactttgggaggccaaggcgggtggatcacctgaggtcaggagttcgagaccagcctggccaacatggcaaaaccccgtctctactaaaaatacaaaaaaattagccaggtgtgttggcatgcacccgtaatcccagctactcagaagactgaagcaggagaatcgcctgaacccaagaggcagaggctgcagtgagccaagattgcgccgcttcactccagcctgggtgacagagtgagactccatctaaaaaaacaacaaaaaccacaacaacaacaaaaaaacactgctcgtgctggttacaatccatccacaaaactgaatatgctacagccacagggaggggatgcagactctttataaaatgatatggaaagatctcctagatgtattaacaaaagtatgtagagtgtgcaattatctgtgtaaacaaaaaagggtgtaaaaataaaaattcacgttgtttattttttcattttttgagacagggtctcactctgtcgcccaggctgcagtgcagtggtatgactgatcacagctcactgcagcctctaactcctaggatcaactaatccttctgccccagcctctcaagtggctgggacaacagacatacaccatcaagttcagcaattatttttttttttcccgatatggagttttgcctgttgcccaggctggagtgcagtggtacgatatcggctcactgcaacttctgcctcccaggttcaagcaattctcctacctcagactcctgagtaggtgggattacaggtgcctgccactacaactggctaatttttgtatttttagtagagatgcagtttcgccatgttggccagactggtcttgaactcctgacctcgtgatccacctgcctcagcctgccaaagtgctgggattacaggtgtgagccactgtgcccagccacgttcagcaaacttttaaattttttgtagagacagggtctccccatgttgcccaggctggtttcaaactcctggcctcaagcaatcctcctgcctcggcctccaaaaatgctgggattacaggtgtgagccaccatgactgaccctattgtttctatgtggggaaaaataaaaacctgtggaagggtacctaagaaactaacaacagaggttatctattggaacaggccagtgggagaattaagtaaatgggagacaagggagaagaaaccttttgttttactcttttttatactctttgataaatgtacatattctatcacccagcagttccatacccatgtaattaccttataaacatacttccatatgtgcaaaacgacatatatacaaggatattctgttgtggcattatttgtaagagaaaaagaatgggaacaacctagacacccatcagcaagaaactgattaaataaatcatccatttgaagtaaaacggtgcatttgttaccaagaatgacgcagttctctgtgttctgatatggaacgatttccaagttgaatggaaaaaagaaaggtgcaggacggtgggtacataatgctaccatttgtgtgggaagaaaagtgaaactatatgcatatccgtttgcaaatgcagttaatgtcttcagaacacagaataaactaataacagtggctacctctggggaagagaactgggtaactgggaaacggtggtggggaggggttattaccttacactgtaccttttaatcatgggcatcttttagctattcaaaactttataaaatttctgaggaggtatttgccaggcgcggtggctcacgcctgtgatcccagcactttgggaggccaaggcgggcagatcacgaggtcaagaaatcgagatcatcctggctaacatggtgaaaccccctttctactaaaaatacaaaaaattagctgggcgtggtggcgggtgcctgtagtcccaactactcaggaggctgaggcaggagaatggcgtgaacccgggaggcggagcctgcagggagccgagatgccgccattgcactccagcctgggtgacagagtgagactccgtctcaaaaaaaaaaaaaaaaaattctgaggaggagggtagtggaggaggaggagcaggaaaagtcatctgtacacaaagcatttcacatgttatgctttttcctgtggcttttaacctgagtttccccggaattgctcttacaaattccaactttggaacagacccaatttcactggagacccaggatcgtcacaaaaccaggaagataatttttaaagacaagagcaagcactagctctctgcaaggtacacgactctttaatccatgcagaaagacaactggatccagaccttttcttcagaacctttttattcatcatctaaccaacagaggtggttggctcgaactcaaactaaaatggcctcaaaaggcccacctcgttacgacatgacagggcaaaaccagaagtagggacagagtttagcctcagttctctgcagagaagaccaagcatgtatttacacacaggtgcctcattaagaactgattggcaatgttccaccagcacagacccagagtgtgcagaaatccgtgggggctctgtatatgtgtcattcagacaatccgccgattcctcagccataaacaagctcttgctttttgggaggagggtgatcagcatgttatcttgaatgatggcaccatttgtttactctggaactttgaaggggaggtgacaacttattttctcccctgaatctgagatgcagtggcctgtcagagtatctaaaaatgtgtcctggaagacaggtggtggtggttgccctaacagagagtttacagggtaattgtgttgggctctttcagtacttaatcctgctgtttttcagaaaccctttgcacctgggccccatggagccagcagggccccatggagcatcccacaggcctgtgagtgaagtgcctctcagagcagtcacccagggaagggaggagggcagggaacggggccaggggagatgcagggacagaaatcagcagaaacactccatgctggttctgactcgctccatctcgtgcaggaagctgtagaactgaggcaaggttaattctggggagagaaaattcagcttcagataaatgtttccaactccacagaatcatccaagaaaattaatttccacccggaggattttttttttcttttttggcttaatacatctaagcagctcttgatgggtaactgatcataataaagaactgagagacttgaatgcagaaggttctctgctccaaaggaaaaaaaaggggagtgagtgttcaaatggcacagctccatggcacaaagagatgaaagggtatcattcgggatgttcaatgtgacttctatggcaagagcttcttgctcgtcaaccttcttcttcaatcccagccattccgttcccaccctttccctttttcaaaacggctcttcaactgtgggggctccaacctgccagtggctttctaacactccttgtgccatctttcaggagaggaaaggcagtggaacagctactccacagctggcaatgactgtttttatagaagacatgatttgtggtgagcgtcaccagcccctgattgcagagaacacaaaaaaggtgaagaggctcaagtgggaattcagactcacctatatacacattttcggtttgatttcctttcttaaccaccaactttagctgatgaaagaaaaagaaataatttaaattaaaatgatgacaactgggcaaagaaattcttaaaaccctttgacttaattaagcttccaacctgagagtcatacaggagcagtctggatcatccaccaccgaaaattctaacaattcccatgattacaggaacaatcacgcatcaatgaataacactaggatctattcatctaaaagtaggcatgttagtgactacatctttagctggccacactgctctgagatatataaggtacttcagtaaaacatccatttaaatatccatttaacccaatgtagatataatttttaaccaagtcaaaaatctacccattttcaaggatcaggagaagacttacttgtaaaaatatacttcccactttctccaattcgctgctcccagatgtcactgtgacaaaaaaaaaaaaaaagagagagagagagagaaataacaagtgactgattgaggactgaccctgaagaccccagttttgcagctgtccagcagaagccatgtgggggcaagtatgagggcagcaaggtgtgcttttggaaagtcaacttatccagagccatgaaacagctactgaatgtggacagaatacaaaacagcagctgctgccccaacagtgctagggactaggtcatgccttccccatagtggctgtgtcacagcctctgcaccccaaccctgtaccacccaaataacccaggactggttgtaactagttacctccaaatttccactccatatctatgagctggttaatcatcagagtctgacctatggcccatcgagcaagggtgggagcattctgcttccactggaacaaaagcaaaagacaaagtcaattacaataggaaaatctccccctctccatcctgccctaaacattgcaatatttagcattgacacagatagtggggagggtgcagaagatagtggggagggtgcagaacgaagggctcagtctatatgcacatacctagggatggaggagggcacagagtggcagaccacaacattaatgttgtatttttcattccaagatttaatccatcttggaaaaaaaacagtgctgccatcatactggcccccacatggcttctactagacaattgcaagatggggtcttcagggtaagttctcaatcagtcacttgttatttttctctatttttgtcacagtgacatctgagagcagtgaattggagaaaggaggcatatatatgtgtatatatatacatacatatatatgtatatatatatgtgtgtgtgtatatatatatatatatatttttttttttctttgagatggagtctcgctctgttgcccaggctagagtgcagtggcatgatcttggctcgctgcaagctccacctcctgggttcacgccactctcctgcctcagcctcccaagtagctgggaccacaggcgcccaccaccatgcccagctaattttttatatttttagtagagatggggtttcaccatgttaggcaggatgatctcgatctcctgacctcgtgatccgcccgccttggcctcccaaagtgttgggattacaggcgtgagccaccgggcctggccagtaggaggtatatttttacaagtaagtcctctcctgatccatgaaaatgggcagatttttgactgggtcaaatcaggagaaatgattagagatacactgaatagtgctggttaaagctgtgtgtatgacatgcgcttgaagccagatgaaaaccttaggctggggaaatgatgatactgataggtggtttggccttacttggcatttcccattgttttctctcttcatgatataaaagcaaggggctggcggtggtggttcacgactgtaatcccagcactttcagaggctgaggcaggtggatcacctgaggtcgggagttcaagaccagcctgaccaacatggtgaaaccccgtctctactaaaaatgcaaaattagccaggcatggtggcacatgcctgtaatcccagctacttggaaggctggggcaggagaattgcttgaaccaaggaggtggaggttgcagtgagccgagattgtgccattgcactctagcctgggcaacgagagcgaaactctgtctcaaaaaaaaaaaaaaagaaagaaagaaagaaagaggtcgagcacagtagctcatgcctgtaatcccagcactttgggaggccaaggtgggtggatcacaatgtcaggagttcgagaccagcctggctaacacagcgaaaccccgtctctactaaaaatacaaaaaattagctgggcatggtggcatgtgcctgtagtcccagctactggggaggctgaggcagaagaatcacttgaacccgagaggcagaggttgtggtgagccgagatcacactgccactgcactccagcctggacagaatgcgactccatctcaaaaaaaaaaaaaagaaagaaaagcaagggatcttaatcagccattaaccttgattaagaggaattataccttttcagaaaagtaagtggctttctcctcactaagacctataagagaacagaaggagatattaacataataaaaagcctcagaagccagtcaccctgagcaaccctggccaatgacctacccagagttatgaaatccgcctggacctgcttggctgtgagactcttcttcaaagcacctgggaggcaggggagaaatcagttagaaaggcagaccagtgaattagtcggcaataagtatttaatgggcacaacctatgtgacctaaaggacaaaaggaacacccaaagactggccagctccaagatctcaatccagccatggggaaatagcatccgaaatgaccagaaaacaagaaagacagtacattttacaatttatttattttatttaaaaaatatatttatttttgccgggcacggtagctcaagcctgtaatcccagcactttgggaggccgaggcaggtggatcacgacatcaggagatcgagaccatcctggctaacatggtgaaaccctgtctctattaaaaatacaaaaaaaaaaaaaaaaattagccaggcatggtggcaggcacctatagtcccagctactcgggaggctgaggcaggagaatggcgtgaacccgggaggcggagcttgcagtgagccgagatcacgccactgcactccagcctgggcaacagagcgagactccgtctcaaaaaaaaaaaatatatatatatatacttatctcaaaatatatatatattttttgagacggagtctcgctctgttgcccaggctggagtgcagtggcgtgatctcggctcactgcaacctacacctcctgggttcaagtgattttcatgcctcagcctcctgaacagctgggactacaggcgtgcgccaccacaccaaaccaatttttgtatttttagtagagactgggttttaccatgttgaccaggctggtcttgaactattgacctcaagtgatctgctcaccttggcctcccaaagtgctaggattaaaggggtgagagccaccatgcctggcacatattttttttttaattgtacaacacaattatttatccctccaaccagtgtgagagaagtcagagacaacagaaaagacttcacggacttggggatggagcaactggtctgaggaatgagtaaggatacgaattcctggagcaagaggcaggggagtgtaatgtcaggttgggcacagggggcaaccacctagagctccacaatgcattatgtagccactattgcatgtggttatgcaaattttaattaaataaaatttaaaattccattcctcagtctcactagctatttcctgtgtcaaacagtcacacaaggccagtgaccattatactgaacactgaagattacagaccatttacatctgcaaagaaagttctattggatggcattgtcctaagaagttagctttcacacagtacaccaagatggactaaacagactaacctctacaattcacaagtcacttccagaggggctgtcaaaacttctcagaagccctaggaacacttccctgtggtggtcaccttgttttgctaggctccaattcctgaaaacaaagccagcaatctgggcttctcaatgtttaacctgcaggctacatccccagtcacaatttggcaaccactctcaaattttccactttttagttcaccagaaaatgactaattaaagaataggaagatgccaaccaccatcaagggaaggccctgaacctataccctaaacccaagtccccacccccaactcactccagaaaaacaatcctaaaggctgttgtaccggtaaaatcaaccatataaacaaagggaggaaatcttttatctccaaaatcagactgagcaaggaagccacacggaataaaaaaggcaagaccccgggaaaccttagccataaaggccctctgagaaggtggctacttcccagccaatccaaataactcctaactaccatgaatacagtgtcttagtttatatccaattcaaacccaatgctttatttgacaatccccaaacactgggctttattattgtaactttttttttttttttgagacagtgagacacggtttcactctatcgcccaggctggagtgcagttgggcaatctcagctcacctcctaccacaccggggtgggtgggtggggctcaagcaatcctcccacctcagcctcccacatagctgggactacaggcgtgtgccatgatgcccagctaattttttgaatttttgtagggacagggtcttgccatgttgcccaggctggtctcaaactcctgacctcaagcaatccacccaccttggcctcccaaagtgctgggattacagacatgagccaccatgcccagctattattttaacttagtttaccaggaaacattaagcatttttgggagaaaatttggcaaatgcagatagtcaagaattgcactgccaagaattcacccaaccaagctgcacccaaaagcacgctgagatatacaggggaagctctttagcaatgtggatagtagggatgaaaggtcatggagagaccaggcacggtggctcatgcctgtaatgccagcactttgggaggctgagggggtggatcacttgaggtcagtagttcgagaccagcctggccaacgtggcaaaaccccgtctctactaaaagtacaaaaattagccgggtgtggtggcatgcgcctgtagtcccagctacttgggaggctgagggtgcagtgagcagagacggcaccactgcattacagcctggcaacagagcaactctgtctcaaaaaaaaaaaaaaacaggctgggcgcctgttacaaaattagccaggagggtgaggcaggagaatcatctgagcctggcaggtggaggttgccgtgagccgagatctgccactgcactcaagcctgggcgacagagcgagactccgtctcaaaaacaaacgatgacaaaaacaacaaacaaaaacctcaggtcagaccatgctattttttctgctcaaaaccctctactatctcctatttcactcacagtaaaatccaaaggttgtacaacaccctgcatgctctggcctcctcttagaacccctaggctctctcccttgcttactgtgctatttttagaatatgccagacagctttctacccctggccatttgcccttgcagttctctgcacatagctcatcccttcgcttcattcagggttctgcctgactcttacctcctcagaaaggatccccgaccattctatttcacattttttctttttttacttttttttttttttaatctcattctgtcacccaggctggagtgcggtggtgtaatcacggctcattacagccttgacctcctgggcttaatggatcctcccacctcaggctcctaagtagctgggactacaggcatgctccacaatgcttgactaatttttaatttttttttctagagatagagtctcactatcttgccagctcaaactcccgcactcaagcaatactcccaccttggcctctcaaaatgctgggattacaggcatgagctgccaatcccagcctcattctaatttaaatagcactgccctttactcatactcgtataatgctgtgggatattctgcattgcatttataactacccaactttatgttatatatttattatcaatttttccactagaacaccagcttgataagaacaaagactaggctcattttgcctactgctgtgtcccaagctctgagagaaatgcctggcaaagtttattggttggcactcaataaaagcacgttgaatgcaagaatccttacaatggattgctatccaggcttaaaaaaaattatgtaaggccaagtgctgtcatcccagcactttgggaggctgaggtgggaggatacctgagcccaggggttcaagaccagtctgggcaatacagggagaccccatctctacaaaataaaaaaattagcaaggtatagtggcacaggcctgtggtcccagctactcaggaggctgaggtgggaggatggcttgagcccaggaggttgaggctacagtgaaccataattgcatcactgcactccagcctatgtaacagggtgagacctcatctcaaaaaaaaaaaaaaaaaaaatagatgtagctcagtagctgttgatggaccaatctgcataatataatgtcaagaaaaaaaggaaaggcacctataatcccagcactttgggaagctgaggtgagaggattgcttgaggctaggaatttgagactagcctgggcatcatagcaaaaccctgcctctacaaaaataaaaataaaaaattacttgggtgtggaggtgcacacctgtaatccagctgctcaggaggctaaaataggaggatcgcttgagcccagaagtttgaggctgcagtgagccatgatggcaccacttcactccagcctgggtgacagagcaagactctatctctaaaaataaataaataaaaataagtgttactttggccgggggtggtggctcacgcccataatcccagcactttgggaggctgaggcgggtggatcacttgaggtcaggagtttgagaccagcctggtcaacgtggtgaaaccccgtctccactaaaaatacaaaaattagctgggcgtggtggcacacgcctgtagtcccagctacttgggaggctgaggtaggagaatcgcttaaacctgggaggcagaggttgcagtgagccgagatcacaccactgcactccagcctggacgacggagtgagactctgtctaaaaaaaaaaaatgttacttaaaaaaaaaaaaaaaaggaaacagttaaaggaacaaggccacaacagtcagcaactgacagagccaagtggcttataggccagagggtccccacaccaagttctttctacaccaggtcattctcagacgctatcttggtgctgcggtatcaggcaatgccttgacagttgctgacaatgaagtcaacaaagctgcagggatggaagagcaagctctccatcctgaagttacctctggagggcagaggccagacttgaaacatggattggcatcatgctaggcctcaagctcttaacttctttttcagctttttcctgtggtgattcctttgtcctaagcaaatgccagccacaagacagacctgcaacatttgaccttatgtcagacagaatgaaaattgtgtggggcctcttggagggtggggtggggggagggatagcattaggaaaaatagttattccatgctgggcttaatacttaggtgatgggctgggcgtggtggctcgtgcctgtaatcccagcactttcggaggccgaggcgggtggatcacaaggtcaagagatcgagactgagggctgggcacgatggctcatgcctgtaatcccagcactttgggagtccgaggtgggcagatcatgaggtcaggagttcgagaccagcctgaccaacatgatgaaaccccatctctactaaaaatacaaaaattagccgggcgtggtggcaggcgcctgtaatcccagctactcaggaggctgagacaggagaattgcttgcacccgggaggcagaggttgcagtgagccgagatcgtgccattgcactccagcctgggccacagagcaagactccgtctcaaaaaaaaaaaaaaaaaaaaaaaaagagagagatcgagaccatcctggacaatgtagtgaaactccgtatctactaaaaagtataaaaattagctgggcatggtggcatgcatctgtagtcccagctacttaggaggctgaggcaggagaattgcttgaacccaggaggcagaggttgaagtgagccaagatcgcgccactgcactctagcctggtgacagagcaagattccgtctcaaattaaaaaaaaaaaaacctaggtgatgggttgacaggtgcagcaaaccaccatggcatactatgtaacaaatctgcacaccctgcacatgtaccccagacctttaaaaaaaaaaaaaagaaaattgtgtaaactccaacagctgcagtcagcagaacatgacacgtggggaaatttaagaacatccttcttcaaacacagataactttgagatggtcccttttttttttttgacacggagacttttttttttttttttttcgagacagagtctcactctgtcccccagactggaatgcagtggtgcaatcttggctcactgcaacctctgcctcccaggttcaagtgattctcctgcctcaccctcccaagcagctgggactataggcacgcaccaccatgcccggctaattttttgtatttttagtagagaccaggatggtctcgatctcctgacctcgtgatccgcctgccttggcttcccaaagtgctgggattacaggcgtgagccactgtgcccgtcctctttcttttttaatttcttttttttttttttttgagacagagtttcacttttgttgcccaggctggagcacaatggtgcaatctcagctcactgcaacctccgcctcccaggtgcaagagattctcctgtctcagcctcccaagtagctgggattacaggcatgtgccaccatgcctggctatttttttttgtatttagtagagatgggctttcaccacgttagtcaggctggttgtgaactcctgacctcaggtgatccacccgcctcggcttcctaaagtgctgggactacaggcgtgcgccaatgcgcctggcaacaggcaccaattttcaccagaactgctgccttagccaaaccctcaaagctgtcaaacaatatgaaggacaaaacaaagggaagtgagggtgacgacttcagttttgccaagacggttggaaaaacagcaaacattgttcttattcagtgtacaaatgggagcccaaggaatggacacaggcttggtgaaaactcctggaagcagatgggagaggatggagagctgctttcatccagtcagtactgaccctgaaggctgaccagctgaagccaccctgtgaggctcacagagaacagaggtccgtagtcacacacgcacatttactgagcactgccatgtgcctgcactgtgctagatgctgggaaacatcaatgaactgaacagacaacaatctctgcccttatgaggcttccattctactggcaggagaaagaccacagcaataacgtaaaacataagccatacagggtataagaagggggaggctgggcatggtggctcacgcctgtaatcttagcactttgggaggccgaggcaggtggatctcaaggtcaggagttcaagaccagcctggccaacatggtgaaaccccatctctactaaaatacaaaaattagctgagcgtggtggtgagcgcctgtaatcgcagctacttgggaggctgaggcaggagaatcgcttgaacccaggaggtggaggctgcagtgagccgagatcgtgccactgcactccagcctgggcaatagagtgtgactctgtcttaaaaacaaaaacaaaaaaacccccaaaaaagaagggggaaagtgccatggagaaaaatagtagggtggtgcatgaggctggcggtcctggggaatttagttcaatgtttgattaaatgccacttatgactacatttcattgctgattattcttttttgtgtgtatgttgctaaaaagaactcgttggggagtggggaaggggagttacctccttttcataaaaaaataaaataaaataaaaatcagttacggatcacccacaggggccagatatcttgctaagtattaaaataaaaatagggccgggcacggtggttgtaatcccagcactttgggaggccgaggcaagcggatcacctgaggtcaggagttcgagaccagcctggccaatatggtgaaaccccgtctctactaataatacaaaaaattaaggccaggcacggtggctcatacctgtagtcccagcaccttgggaggctgagatgggcagatcacgagggcaggagttcgaggccagcctggccaatacggtgaaacctcgtctctactaaaaatacaaaaattagccgggcacggtggtgcatggctgtagtcccagctactcaggcggctaaggtagaataatcgcttgaacctgggaggtggaggttgtagtgagccgagatcgtaccactgcactccagcctgggcaacagagtgagactccatctcaaacaacaacaacaacaacaacaacaacaacaaaaattagccaggtgtagtgcgcatgcctgtaatcccagctactcaggaggttgagaggcaggagaatcgcttgaacccaggaggcagtggttgcagtgagccgagactgcaccactgcactccagcctgggcaacggagtgggactctgtctcaaaaaaataaaaataaaaataaataaataaataaataaataaatgaaataaaaataggtgaccaagcagggtggctgagcctggggagatcgaggctgcagtaagcagagattgtgccactgcactccagcctgggcaacacagccagacctagtctcaaaaaataataataataataataaaaaaacaggcagccaggctaggtggctcatgcctatatcccagcactctgggaggctgaggcaggtggactgcttgaactcaggagttcaagaccagcctaggaaacatggcaaaaccctgtctctaccaaaaatacaaaaattagccgggagtggtggcatgcacttgtggtcccagctactcgggaggctgaggtgggaggctcactgaagctcaggaagtcaaggatacagtgagcagagactgtgccactgcactccagcctgggcaacacagccggacccagtctcaaaaaaacaaacaaaaagaataaaataaaataaaaaaacaggcggccaggcgtgatggctcatgcctatatctcagcactttgggaggctgaggcaggtggactgcttgaactcaggagttcaagaccagcctaggaaacatggcgaaaccctgtctctaccaaaaatacaaaaatcagccaggagtggtggcatccacctgtggtcccagctactcgggaggctgaggtcggaggcttactggagctcaggtagacaaggctgcagtgaactgtgatcatgccactgaactccaacctgggtgacagagcgagattctgtctcaaaaaaaataaattaatcaaaaataaataaattaataaattaattaaaaacaggcttaaatagtggccctactgccaagttatctgtaatctcagctaggagataacacataataataatgacaatcataatattagcagcagtgtgctaccacttagtgaagtgagcaccttattacatttattatctttatccttataataaaagtatgagtctactattagttctcaggtaccattgggtctcagagctgttaaatccctggtgagtaagcaagcacagaagggccacccagcagccacgtgctggactggagtcctatctagatcctgatgggaacccattccaaacaaacaaaatacaggagacaatggggaaattaatactgaccttgtattttccttttagatatgataatggcattgtagtttgataagggggaaattcctttttttcttttagagatagacaactaggtattcaggaataaagtatgtctgatattgcctttaacataatccagtttgggccgggcgcagtggctcacacctgtaatcccagcactttgggaggccgaggcgggcggatcacgaggtcaggagatctagaccatcctggctaacacggtgaaaccctgtctctactaaaaatacaaaaaattagccaggcgtggtggcaggcgcctgtagtcccagctacttgggaggctgaggcaggagaatggcgtgaacccgggaggcggagcttgcagtgagccaagatcgtgccactgcactccagcctgggtgacagagtgagactccgtctcaaaaacaaaaaaaacaaaacataatccagtttgcactgggcatgttgcccacacctgtaatcccagctactcagcagactgaggtgggaggactgcttgaggccaggagtttgagactagcccaagcaacaaagcaagacccccacatctctaaaactaaactaaactaaagtaatccagttcagagagcagtaaggagccatgggtggggtccacatgaatcaatctggccatgggttagtaacttttttttttttttcataatatggactctagctctgtcgtccaggccagagcgcagtgtcaggaactctgctccccgcctcccgggttcagcctccaatgtagctgggactacaggtgcccaccaacatgctcgactaattttttgtatttgtagtagagatgtggtttcaccgtatcagccagaatggtcttgatctcctgacctcgtgatccacatgcctcggcctcccaaagtgctgggattacaggtgtgagccaccgtgcccagcccgggttaataacttttgaaggattttctttggtttgttttttagagacagggtcttcctccgttgtgcaaactggagggcagtggtgtaatcatggctcactgcagcctggactcctgggctcaaggtatcttcctgtctcagcctctgaagtagttgagactacaggtgtgcaccaccatgcccagttaattttttttttttttttttttttaagacagagtctcactctgtcacccaggctggagtgcagtggtgtaatcccagctcactgcaacatctgcctcccaggttcaagtgattttcatgcctcatcctcccaagtagctgggattacaggcatgtgccaccacgcccagttcatttttgtatttttagtagagacagggttttgccatgttggccaggctggtctcaaactcttgacctcaagcgatccgcccacctcagcctcccaaagtgctgggattacaggcgtgagccaccatacctggccaattttttttattttttgtagaggtagtgtctcattatgttgcccaggctgttcttcaactcctggcctcaagagattctccccctttgacttcccaaagtgctgagattacaggcatgagtcattgtgcctggctgaagtcaggtgtttcaaagaattacatactaaatagtacaagaaaaacattttttaaaaaaggcaaaaaaggccaggtacagtggctcatgcttgtaatctcagcactttgtcaggagtttgagaccaccctggctgacatggtaaaaccccctcttgaccaaaaaagaaaaaaaaaaagagcctggcgtggtagtgtgtgcctgtaatcccagctactcaggaagctgaggcaggagaatcatttgaacccaggaggtggaggttgcagcgagccgagatcgtgccactgcactcgagcctcggcgacagagcgagactgcctctcaaaaaaaaaaaaaaatcaataaaataaaaaggggagccgggtgcggtggctcacgcctgtaatcccagcactttgggaggctgaggcgggcagatcacaaggtcaggagatcgagaccatcctggctaacacggtgaaaccccgtctctactaaaaatacaaaaaattggccgggcgtggtggcgggcgcctgtggtcccagctactcgggaggttgagccaggagaatggcgtgaacccgggaggcagagcttgcagtgaaccgagtttgcgccactgcactccagcctgggctacagagcgaaactccatctaaaaaaaaaaggggggccggacgcagtggctcacgcctgtaatcacagcactttgagaggccaaggcgggtggactgcctgagctcaggagttcgagaccagcctgggcaacacagtgaaaccccgtttctactaaaatacaaaaaatcagctgggcgtgacggcatgggcctgtaatcccagctacttgggaggctgagacaggagaatcgcttgaactcaggaggcggaggttgcagtgagcagagactgtgccattgcactccagcctgggtgacagagcgagactctgtctcaaataaatacattaataaaataaaataaaatgccaaaaaagatcagtactttacaaagcttttacttgactctccccctgccaaaaaaaaaaaaagaaaccaaaaagttccatcattaactgtgcttcacagatactggttaagcaagtttctttactgtaggacttttcagaacctgagatgtgtcaatgtgtgcttgaatctccagggttccaaggctggggttgcggggagagtatttctgactctggacacaccaatttgaggaagactgatctggtggtttcttaaggccacttcagctctaacaaactgtacttctacaataagagcttcttgcacaggcaggaccaggtcaaaggaagaggacactgatgagggcctggaggctcttacgttgcagattagattaggaaaggccttgaatgccaaactgaggcctacagacttcattacgcaaggtaaacagttgagagaagcaggatgatccaagttgtgctgtagttaagtgtgctccagggcaaactggagtctggatgggagaatggaggtggagatgtaactgccataactaggcatgtagggctaagaaactgttctgggatggcagcctttgggactagaaagaagggatgcacaaggacaaaggataagaaggggacaggaaggccgggagcagtggctcacacctgtaatcccagcactttgggaggccaaggtggggtggatcacctgaggtcaggagttcgagaccagcctggccaacaaggtgaaaccccgtctctaataaaaatacaaaaaattagccaggcatggtggcgggtgcctgtaatcccagctactcaggaggctgaggcaggagaattgcttgaacctgggaggcggagctggcagtgagccaagatggcacctttgcactccagactgggcaacaagagcaaaactccatctaaaaaaaaaatataataaaataataaaacttaggaggctttgggacattaactagcccagacatacattcacatactcattattaggtaaaagttttatcccataatttgacataaaggaataggactgaacactagcagctctatcaataaataaaggccataacagcctggcacagtaacatgcctataatcccagctacttgggaggttaagacaggagaatcatttcagccaaggacttccagaccagcctgggcaacatagcaagaccctggctcaacaaaagcctcaacaaaacaaaggttacagttgagcaagcactgtgttaagtactttacaggcattcatctcttcattcctaacaccgcaataagctgctattattattctacttttcagaaaagaaactgaggttctacaaggctgatttgtccagaaccaaatggctacattcagtgatgggaccaaaactcaaatcagagtgagcctgaaaagcccatctcttcactggtatgctgagttcctcaattttctctgtatctatagaaaatgatctgctatacgccgggcacagtggctcacgcctataatcccatcactttgggaggctgaggtgggcagatcaattgagatcaggagttcgagaccagcctggccaacatggtgaaaccccgtctgtactaaaaatacaaaaattagccgggcatggtggcacatgcctgtaatcccagctactcgggaggctgaggcaggagaatcgcttgaacccgggaagcagagattgcagtgagccgagatcgagccattgcactccagcctgggagacaagagtgaaactccgtctcagaaaaagaaaaagaaagaaaaatatagactaggccgggcatggtggttcatgcctgtaatcccagcattttgggaggccaaggcagacagatcgcttgagcccaagaatcaagaccagccagggcaacatggtaaaacctcgtctctacaaaaaatacaaaaattagccaggtgtgttggtgcaccgtagtcccagctactcaggaggctgaagcagaagaatcacttaagccctggagttggaggttgcagtgagctatgagaatcagtctgggtgggaccttgtcccaaaataaataaatacataaaaagaaggaaaatacagactcaacatcccctgggagggtcacagcatctcctaaattctattcaattcgctctgcacgtactgagcacctgctttatgccattaccttgcttctaactatggcttaggaaagaacaagactcgcccctgagtttgaggaactatctattagagccatgagacagatacatcagatacaaacaaatcagcaggaacaatagaaacctgtaaattagtactgaccaaaatgatagttacagataaaaaacatatctcagatgctggaaggggaggttactgtgaactcaagcgatttgggaaggctttctgaggcagcacagggttgcagctcaaggctgaaggcaatctaacaggatacagtggggggccaagtgcggtggctcatgcctgtaatcccagcactttcaaactccaaggcaggaggactgcttgggcccaggatcgctggagaccagcctgggcaacataggaagatcctgactctatttattttttaaataataggccgggcacagtggctcacatctataatctcaggactttgggaggccaaggcaggcggatcacctgaggtcaggagttcaagaccagccaggccagcatggtgaaaccccatctctactaaaagtacaaaaaattgctgggcaggacggcttacgcctgtaatcccagcactttgggaggctgaggtgggcggatcacttggggtcaaaagttcaagaccagcctggccaacatggcaaaactccatctctactaaaaataaaaaaatcagctgagcacagtggctcatgcctgtaatcccagcactttgggaggccaaggcaggcagataacctgaggtcaggagttcgagaccagcctgaccaacatggagaaacatcatctctactaaaaatacaaaaaacaaacaaacaaaaaattaggcgggcgtggtggtgggtgcctgtaatgccagctactcgggaggctaaggcaggagaattgcttgaatccgggagatggaggtttgcagtgagctgaaatcatgctactgcgctccagcctgggcgacagagcaagacgttgtctcaaaaaaaaaaaaaaattagccgagtgtggtggcatgcatctgtagtcccagctatttgggaggctgaggcaggagaatcgcttgaacccgggaggtggaggttgcagtgagccgagatcacgtcactgcactccagcctgggcaacagagtgagaatccatctcataaataataaaaataaaaatacaactacaaaaaattagccaggtgtggtggtgcatgcctgtagttccagctactcgggaggctgaggaaggagaattgcttgaaccttgtcgacggaatttgcagtgagccgagatcttgcccctgtactccagcctgggtgacaagagcaaaactctgtctcgaaaaaaaaaaaaaaaaaaaaaaaggatacactgtggtggggtgaggaagacagggaagactggggacagggacactagacagaggtctcctgaaaattagtgcccataacaggtgtttggtagacaggtctcagccctcagacaaacccatttccaaagatgaaggccagagaatgagaataatgatttatcgttctggccgggtgtgatggctcatgcctgtaatcccagcgctgtgggaggcgtggccggcagatcacctgaggtcaggagttcaagaccagcctggccaacatggtgaaacttggtctctactaaaaatacaaaaattagccaggcatggtggtgggcgcctgcaatcccagctacccagaaggctgagtcagaagaatcacttgaacccgggaggtggaggttgcagtgagccgagatcgtgccactgcactccagcctgggtgacagagtgagactcaggaaaaaaaaaaaaaagacttggccgagcccagtggctcacacctgtaatcccagcactttgggaggctgaggcgggtggatcacgaggtcaagagatcgagaccatcctggctaacacggtgaaaccccatctctactaaaaaatacaaaaaattagccgggcgtggtggtgggcacctgtagtcccagctactcgggaggctgaggcagaatggcgtgaacctggtaggcagagcttgcagtgagctgagatcacgccactgcactccagcctgggtgacagagcaagactccatctcaaaaataaataaataaataaataaataaataataataataataataataaagacttgtgatcctctccctctccctctccctctccgtctccctctccctctccctctccctccctctccgtctccgtctccgtctccgtctccctctccctctccccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctggttcactcagtgctcaatggtgcccaggctggagtgcagtggcgtgatctcggctcactacaacctccacctcccagccgcctgccttggcctcccaaagtgccgagattgcagcctctgcccggccgccaccccgtctgggaagtgaggagtgtctctgcctggccgcccatcgtctgggatgtgaggagcccctctgcccggccgcccagtctgggaagtgaggagcgtctccgcccggccgccatcccatctaggaagtgaggagcgcctcttcccagccgccatcacatctaggaagtgaggagcgtctctgcctggccgcccatcgtctgagatgtggggagcgcctctgccccaccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcatctccgcccggcagccaccctgtccgggagggaggtgagggggggtcagccccccgcccggccagccgccccatccgggagggaggtggggggtcagccccccgcccggccagccgtgccatccgggagggaggtgggggggtcagccccccgcccggccagccgcccggtccgggaggtgaggggcgcctctgcccggccgcccctactgggaagtgaggagcccctctgcctggccagccgccccgtccgggagggaggtggggggtcagccccccgaccggccagccgccccgtccgggagggaggtgggggggtcagccccccgcccggccagccgccccgcccaggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaaaaaaaagacttgtggttctgcactttaggcaccatgttggtcaggctggtctcaaaatactcacatttgtgagtaagaagaggttgtaaggatgttcactgtggcattgtttgtaagggtgagatatgggaacaacagaaatatccaacaacaggatatagattaactaaaaggagatatattcagtctatgggatattatatccatctaaagaatgaaggtgatgtggaaagagctccatgatataccaggtatgatgaaaaaatgtgagttccaggacactttttatggtttgctaccatttatgaaaaacaaagctacatgaatatgttcattagtgtacataaaaatataaaaggccatagtccaaaattatattgtgattatctctagggacaaaagtaggaggagagtaaaagaggatttttacttttgactctctatagctctatactgtgttttgtttttttttttttttgagacggagtgttgctccgtcgcccaggctggagtgcagtggcacggtctcagctcactgcaaactccgcctcccgggatcacgccattctcctgcctcagcctcctgagtagctgagactacaggtgccagccaccacacccggctaattttttgtatttttagtagagacagggtttcaccgtgttagccaggatggtctcgatctcctgacctcgtgatccgcccatcttggcctcccaaagtgctgggattacaggcgtgagccaccacacctggccgctctgtactgtttttgaaagtttaaaatgaaaatttattcctgctggtgaaatggctcacacctgtaatcctaacactctgggaggctgaggcgggcagatcgcttgagctcgggaatttgaaaccagcctggccagcatggcaaaaccccatctctacaaataataataataataatacaaaaaatagccaggcatggtggtgcatgtctgtagtcccagctactccggaggctgatacgggaggatcacttaagcccgggaggcggaggttgcagtaagctgagatcatgccactgcactccagtgtgggcaacagagcaaaagcctgtctcaaaaaaaaaaaaaaaaaaaaaaagtattcctatataaaaagactttggctgagtacagtggctcatgtctgtaatccagcactttggggagccaaggcgggtggatcacgaggtcaggagttcaagaccaccagcctggccaaaacagtgaaaccccatctctactaaaaattcaaaaattagctgggcatggtggcgcttgcctgtgcctgtaatcccagctactcgggaggctgaggcaggagaatcacttgaacctgggaggcagaggttgcagtgagccaagattctgcactgcactccagcctaggtgacagagcgagactccgtctcaaaaaaacaaacaaaagacttcaagcccaggcacagggactcactcctgtaatcctaacactttgggagactgaggtgggtggatcacctaaggtcaggagtttgagaccagcctgtccaacatggtgaaaccctgtctctactaaaaatacaaaaaattagctgggtgtggtggcgggcacttgtaatcccagttacttgggaggctgaggcaggagaatcacttgaacccaggaagtggaggttgcggtgagccaagaccacgccattgcactccagcctgggcaaaaagattgaaactctgtctcaaaagcaaaacaaaacaaaaaaaccctcaaattcttatcaagtcatgacagcaaagaaggcaagaatcacaaaaacacgaggctcagaaaatttcagttgaaaatctctggaatattctggttcaagcccccagaacctcaggagcacaatacagggcaaaggaaagaaccttcactaagatataggaaagtgctgaacagaagcaaacaaattaaacccccaacttctaatacacttgaactgaacctgggcatggtggcttatacctgtaatcctagcactttgggaggccaaggcaggaggacagcttgagctaggagtttgagactagcctgggtaacatagagagactctatctctacacacaaaaaacattagccaggcagggtggtgcacacctgtggtcccagctacttgggggttgaggcgggaggatcacttgagcctaggagtttgaggctgaagtgtgctatgattgcaccactgtattccagcttgggcaacagagcaagaccctgtcaaaaaaaaaaaaatgctccatttaaaaaaattattagattcaggccgggtacggtggctcacgcctgtaatcccagcactatgggaggctgaggcagacagatcatgaggtcaagggatcatgaccatcttggccaacatggtctctactaaaaataaaaaaattagctgggcgtggtggtgcgtgcctgtaatcccagctactcgggaagctgagtaggagaatcacttgaactcggatggcagaggttacagtgagctaagattgcaccactgcacttcagcctggcgacagagaaagattctgtctcaaaaaaaaaaaaaaaaaaagtattagattcaagggacattgtcaaattgctataaaaggttccaaatgcttattctcaatttctgtccttattatagagaggacaagaggacattctgaggacataacccaagatgcacactgaactttccagctgtgctgcaccacagcacactactattcaactatactatgttcacctgttacgtgggctccctccagagacagagtcccacccacgtctggctcattaccaaacgctctggcttggcccacggagcatgcttcaatgactccatggactaaaggaatgttcaagttaatgtctctggccacagctgctaagagaggttactcaccatttggaaccagaaggaggcttttcacgatgcttctgagggagccaagactgatctgattggtggtggcaaattcagagagctgagccagaaatctttccacctgcagagagagaacagtgaaaacccgggccttcactttctaagcatctcagggagcacggacccactccctaacacagaatgttttatttacctcttttggctcagttaggaagtggaaaagcacctctgtcagggctgagaactgctgtgaagaaaacaacacagaacatcagtacaatttctactactgggtcagcatgccccaccccaggcaactgcatagccttgagagggaagaacagtaacagccaggtgttatgcctgttctgatcatcctatagttacaaatgttcacaatacccaccaccagtgtcaatatacctgtgtcgctacatcatctgaaaaacacgtttattgggatacttagcagacatgtattgagagactgtaagcatatgcactcagatgcacacatatatctctaggacacagacacacacagacagacatacacacacacacacacacacacgcacgcacaagggggaaatcatcagaaaattaaaagcggttaccactttggatgatttttattttcttctgttttacctatccatattttctttcttttctttttttttctttccctgagacagggtctctctgtcacccaggctggaatgcagtgatgcaatctcggctcactgcaacctctgcctcctgggctcaagcaatcctcccacctcagcctccagagtagctgggactacaggcacatgccaccatacccgactaattttttttttaatgtagagacagggtctcactttgttgcccaggatggtctcaaactcctgggctcaagtgatctacccacgtcagcctcccaaagtgctggaattataggcataagccatgcacctggcctcatattttcttgggttccccccacccataaacatctcgttacttgtgtaagacaacaataaactgtaacactttattatacacctagaacagactcttacagttttgtgtgtcttaatcttttctctttactggtaatgtgttgttaggaactgaatgtttgtgtctccccaaaattcatatattgaagccctaacttccattgtgacaatatttgaagacagggcctgttagatgataaaggttaaatgaggtcataagagtgagatgctagccccatagggctgggggcgcttattttgattttttttttttttttttttagatggagtctcactctgttgcccaggctggagtgcagtggtgtgatgttggctcactgcaacctccaccttctgagttcaagcaattctcctgcctcagcctcccgagcagctgggattacaggtgcctgccaccacacctggataatttttgtatttttagtagagacgggtttcaccatattggccaggctggtctcgaactcctcacctcaagtgatccacctgcctcagcctcccaaagtgctgggattataggtatgacccaccgtgcctagcctagggctggggcccttataagaagaggaagaggccaggtgcagtggctcacgcctgtaatcccagcattttgggagaccaagatgggaggattgcttgaggctgtgagtttgagatctgcctgggcaacacagcaagaccccacctcttaaaaaaaaaaaaaaggaaggagggagtcatctacaagccaggaatcacactggctggcacttgatcttgtacttccgagcaagcagaactgttagaaataaatgtctgggctgggcatagtggctcacacctgtaatcccagcactttgggaggctgaagtgagtggatcacgaggtcaggagtttgagaccagcctggccagcatagtgaaaccccgtctctactaaaacaaaaaacaaaaaaaaattagccaggcgtggtggcgtgtacttgtaatcccagctacttgggaggctgtggcaggagactcacttgaatccaggaggcaggggttgcagtgagctgtgatcatgccactgtacaccagcctggacgacagattgagactctgtctcaaaaaaaagaaagaaagaaatgtctgctgttggagccaaccagtctatgatattttgccttaacaaaataccagctgcccaggtattttgttatggcagcctgagctgactgagacacagatcattactttatcatgtccctccctggcctgagctgactgagacacagatcattactttctcatgtccctccctggcctgagctgactgagacacagatcattactttctcatgtccctccctgtgaacagtgtgtatgggctggacgcggtggctcacgcatgtaatcccagcactttcagaggctgaggttggcggatcatttgaggtcgggagttcaagaccagcctgaccaacatggtgaaaccccgtctctactaagaatacaaaaattagccaggcgtggtggtgcgtgcctgtaatcctagctactcaggaggctgaggcagaagaattgcttgaacctgggaggcggaggttgcagtgagtggagatcatgccactgcactccagcctgggtgacagagcgagactccgtttcaaaaaacaacaacaacaacaacaacaacaaaaagcccactgtgtatggcatagtggggaaaaccaggatgccagggtttaaaagacccagttcaatcagtgttctccgttgactactcttgtgaatttggtcaagccgtttagcatctgtgtcccagtccccacgaggaaaacaaaggtaagaatacacagcttccaatactaacagtaacacatgcagagcctctagcacagagccaggctggacgctaaacaaatggtagctacagttagagtcataattagagtcactataccatttgatccaccttctagaagcaatatataaaaaaagaaaaagattataggcagatacttcagcttaaaacccccaaagttgtatgtgtagtatgttaaatgcacctatcccttctgctatgacacattaaactctacacatctgtcaggactctgtattattttattcaaaaatgtattctattttaaaagaaaacgaaactgggtgtggtggctcatgcctgtaatcccagcactctgggaggccaaagtgagaggattgcttgaggccaggagttcgagaccagcttgggcaatctgcataaaaaaatttaaaaattagccaggcaaggtggcatgctcctgtagtcctagctactcaggaggctgaggcaggaggattgcttcagcccaggcattccaagctgcagtgagtcatgatcacaccactgaactccagcctgagtgacagaacaagatcctagctcaaaaaataaaaataaaaaataaaaataaattagtcaagcatggtggtatgcacctgtagttctagctactctggaggctgaggtggaaggattgcttgagcccaggagcttgaggctgcagcaaactatgattgcgccactgcaatccagcctgagcgacagtgcaagaatgtgttattgatccctcgtccctatctctcccttcccaagccctccttatcctccaaagccctgccaagaaaccatgacactcccaacaagaaagggacctacccagattctcaacttctgaggctccctggggccacctacaattttcaactctgataaggaacacaaacatgtcttagaagagaagtttccttatatggcattgcagcttcacagcaacttaaatactgtaagtgcacagtatttgctgaataaatctttcctaaacactccccgcaatgctttgcctttgcaattgcataggtgcctccctctggaatgctcacccacccatggctatctatgcatgcatctcaaaatcttaaggattctccccagtaaacttaggaagagatgcacaaggtcattccagactagagaaatgcaaatcagtaaaaccagaatatactatttttcacttatcagatctgcaaacccaaaagtttgactaggacaccagtgctggtgaaagtacaaggaagcagacaggttcctgcatgactgataataggatacactggggtgacctttctaggggcaatttcacaatgtgcatctaacttgtatttttttgaggcagagtctggctctgtcgcccagactggagtgcagtggcgcaatcacggctcgctggagcctccaacctcttgggttcaaagcaatcctcccacctcagtctgctgagtagctgagattacaggcacatgccaccacatccacattgggctaatttttttatattttgtagagacagggtctcacaatgttgccccagctcatctggaactcctgggctcaagcaatcctcctgcctcaccctccctaagaactgggattataggtttgaccaaccacacccaaccggcatcaaatttttaaagtgattatacccctcgacctagtaattccattccatgaagtatatcctttaggtatgttccaaaaagtaaatgttttggcaagtcacagtggctcatgcctgtaatgccagcactttgggaggctgaggcaggaggaccgcttgatcccaggagacaagcattatgttcaggcaacatagtgagagcccatctctacaaatcataataatacatttaaatttaaaaagaaaaaaagaggcctggcaccatggctcaagcctgtaatcccagcactttgggaggcggaggtgggtggatcacgaggtcatgagatctagaccatcctggctaacacggtgaaaccctgtctctaaaccctctactaaaaatacaaaaaaattagccggtcttggaagtgggcgcctgtagtcccagctactcgggaggctgaggcaggagaatggcatgaacctgggaggtggagcttgcagtgagccgagatcgcgccactgcactccagcctgggcgacagagtgagattccatctcaaaaaaaaagaaaaaagaaggtcggacgcggtggctcacatctgtaatcccagcactttggtggctgaggcgggcggatcacctgaggtcaggagtttgagatcagcctggccaacatggcgaaaccccgtctctactaaaaatacaaaaattagctgggcatggtggcgggcgcctgtaatcccagcagaattacttcaacccaggaggcggaggctacagcaagctgagattgtgccactgcactccagcctgggcaacagagtaagactccatctcaaaaaaaaagaatgcagtagatctatttgtattgaagggagaaaataggatacattgctcagtttaaaaaacaacaacaaaacaggccacgcgcggtggctcacgcctgtaatcccagcactttgggaggttgaggcggggggataaccagaggttaggagtttgagaccagcctggccaacttagccaaacaaaccccgtctctactaaaaattcaaaaatggcctggagcggtggctcacgcctgtaatcccagcactttgggaggccgaggcgggcagatcacctgaggtcaggagtttgagaccagcctagctaacatggtgaaaccccatctcgactaaagaaacaaaaaattagccgagtgtggtggcacgtgcctataatcccagctacttgggaggctgaggcagaattgcttgaacctgggaggtggaggttgcagtgagccgagattgcaccattgcactccaacctgggcgacagggcaagactccatctcaaaaaaaaaaaaaaaaaaattagccaggcgtggtggtgtgcgtctataatcccagctactcaggaggctgaggcaggagaattgcttgaacctgggaggcagaggttgcagtgagccgagattgcacgattgcactccagcctgggcggagtggaactccttctcaaaaaaaaaaaagaaggccgggtgcggtggctcacacctgtaatcccaatacttagggaggccgaggcgcgcagatcatgaggtcaggagacagagaccatcctggctacggtgaaaccccatctctactaaaaataaaaaataaaaaaattagccaagcgtggtagggggcgcctatagtcccagctacaggggaggctgaggcaggagaatggtgtgaacctggaaggcagagcttgtggtgagcccagatcacaccactgcactccagcctgggcaacagagcgagactccgtcacaaaaaaaaaaaaaaaaaagtgccgtgcctcacgcttgtaatcccagcactttgggaggccaaggcgggtggatcacaaggtcaggagttcaagaccagcctggccaagatggtgaaaccccgtctctactaaaaatacaaaaattagccgggcatggtggcatgcgcctgtaatcccagctactcgggaggctgaggcagagaattgcttgaacccgggaggtggaggttgcagtgagcccagatcatgccactgcactccagcctgggtgacagagcttgactccgtctcaaaaccaaccaaaaaaaaaccccagcaagatgaagaaaaaatatatacagaatgaaccattttctatatatatataaaaattcaaagccagaaatgggaggatcacttgagcctagatgttcaagatcaccataggcagcatagtaagacctcatctctaaaaaataaaaataaggccaggcacagcggctcacgcctgtaatcccagcacttcgggaggccgaggatggcagatcacctaaggtcaggagttcaagaccatcctggccaacataatgaaaccccatgtctactaaaaatacaaaaattagccaggtgtggtggtagctgtagtcccagctactcgggaggctgaggcaggaggatggcttaaacccaggaggcaaaggttgcagtgagccaagattgtaccattgcagtccagcttgggcaacacagtgagactccatctcaaaaataaaataaaataaaaataagaaaacatgcccaggcacggtggctcatgcctgtaatcctagcactttgcgagtctgaggaaggtggatcacctttggtcaggagttcaagaccagactggcaaacatggtgaaaccccattctactaaaaacataaaaaattagctgggcataatggtgagcacctgtaatcccagctacttgggaggctgaggcaggagaactgcttgaacccgggaggcagaggttgcagtgagccaagattgcgccattgcactccagcctgggcaacagcgcgagactcaaaaaaaaaaaaattttttttaaaggatactcatatatatgctggcaaattaagacttttatttctataaaaataactaagaaactattttttgtttgttttttgagacagagtctctctgtgtcacccaggctggagtgcagtggtgcgatcatggctcactgcaacctccgcctcctgggtacaagtgattatcctcctcagcctcctgagtagctgggattataagcgtgcactaccatgcccggctaatttttgtatttttagtggagacagggtttcaccatgttggccagactggtcttagactgctggcctgaagtgatccacctgcctcggcttcccaaagtggttggattacaggcgtgagccactgtgaccagctataagaaactattaaaatgatttctggagataagaaaaataaacattttatttttaagagatgggggtctcactctttcaggctggagtacagtgggtgatcatcatagctcactgcagcttccaactcctaggctcctgcctcagcctcctgggttgctctgggattacagacatgctgtaccatacctagcttatttcactttgatatctttgtatactgtttgaatttcctgtctattactttcatttccagcttggtaagaggactgtgggccacttgcttgtattatcctttatatttttctgagtttactctcattctaaaatgattaacttaaaatcctgcctattctcagactccacattgcctgggactggccacgggcatcaaagggcacatctatgtgcaatttggtactatctgcttcttcattttatgacctgctgtagaagatcacaacttccccaggacaaaaggccttgaccatcaaatattcctaagtcctaccaggtttagtggctatttggtttatgtaggcattcaggtaaacacccaccgaatgagcaataaatgttaaagacaaggttcacacaatgattcgttttactacttgaggcctacaccttagaattcaaaataaattcagctaacagagtgggtacttggagaagtctgattatccaacaaaagacagagaaatgggccaaacgactcaggtaagttgcttattaggagaaaggtttaaggtttctgtattaacaataaaggtagctgggcctggtggctcacacctgtaatcccagcactttgggaggctgaggccggcggatcacaaggtcaggcgattgagaccatcctggctaacacggtgaaaccccgtctctactaaaaatacaaaaaattagccaggcatggtggcacatgcctgtaatcccagctactcaggagcctgaggcaggagaatcgcttgaacccaggaggcagaggttgcagtgagctgagatcatgccactgcacttcagcctgggtgatacagcgagactctgactcaaacaaacaaacaaacaaacaacaacaacaaaaaaaaccaataaaggtaaaggtttacagtatgtttcaaggttagaaaatgagtcagttcctgggggtgatggctcacacctgtaatcccagcaatttgggaagccacagtgggtatatcacttgagcccgaagttctagaccagcctgggcaacatggcacaaccccatttcttcaaaaattacaaaaattagccagagctgggcaccatggctcatgcctataatcccagcactttaggaggctgaggcaggtggatcacctaaggtcaggagttcgagagtagcctgaccaacatggtgaaaccccgtctctactaaaaatacaaaaaattagccaggcgtagtggcgggcacctgtagtcccagccactctggaggctgaggcaggagaatggtgtgaacccaggaggcagagcttgcagtgagccgagatcgcgccactgcattccagcctgggtgacagagcgagactccatctcaaaaaaaaagaaatatatacatatacatatatataaagtttagctgggtgtgagggagggcacctgtaatctcagctactcgggaggctgaggcaggagaattgcttgaacctgggagacagaggttgcagtgagccgagatcgtgccattgcactccagcctgggcaacagagcaagactccgtctcaaaaaaaaaagataagccaggcacggtggtacatgcctatagtcccagctactagaaaggctgaggtaggaggatcacttgagcctgggaggtcgaggctgcactccagcctgggtgatagaatgagaccctgtctcaaatttaaaaaaacgaaagaaagaaaagaaaatgagtcaactctgggtgtaatggctcacacctataatcccagcactttgggaggctgaggtgggaggatcccttaaggccaggaggcccagaccaacctaggcaacaaacagtgaccgtgttgctataaaaaaaattaaaaaataaaaaattagcctggtgtggtggcacatgcctgtggttccagctactcaagaggctgaggcaggaggactccttgagcccaggagttcaagactgcagtgagccattattgtaacactgctctccagccttggcaacagagtgaggtcctgtcttaaaaaaaaaaaaagaaaatgagtcaagtgctgatctcaaaggaagtggtttgtattttctacgaataccaagctggaggtaattttacagatcatacaatccagtatcttaaaaaaaaaaaaaagaaaaaaactttgttagtagcagaatctttttttattctccaaatggatatcttccagagaacactgatacattaacaagtaaaagctaagctaccaccataggctttgaagccaaacacgtgatcctaaattcctggctccatcacttcctggctgcctgacattatttatttattttcttgagacagggtcgcattttctgacccaggctggagtgcaatgccatggtcatagctcactgcagcctcaaacttctgggcttaagggattctcctgcctcagccacttaagtagctagaactacaggcacataccaccactctcagctaatttttaaaacttttggccaggtacggtggctcacgcctataatcccaacactttgggaggccgaggtgggcaggttacaaggtcaggagttggagaccagcttagccaacatggtgaaacctcatctctattaagaatacaaacatgagccgggcatggtggtgcacgcctgtagtcccagctacttgggaggctgaggcaggagaatcacttgaacctaggaggcggaggttgcagtaagccaagatcatgccattgcactacagcctgggcaatattgagactatctcaaaggaaaaaaaatgttttcctagagatggggtcttgctatgttgctcaggctagtcttgaactcctggcctcaagtgatccccctacctctacctcccaaagtgcttgattacaggcatgagccaccttgcctggctttctgcatgattttatttacttatttatttgaaacagggtctggtctgttctctgggctggagtgcagtggcataatcatagctaaccgcagcctccaatttctgactcaagtgatcctcccacctaagcctctggagtagctgggactacaggtgtgtgccaccatgcctggctaattttttatcttattgtagagatggagtcttgctacgttgcttaggctagtcttgaactcctgtctacatgactttaaacaggtcaatttatttctctgaaccatctttcttaactgtaaaatgggaataataatagtgccttccttttagagttgttatgcatacatttaaaatggtgcctggccacatggtgcatgctcaatatattaatatcgtataatagctatgttcatttcactgctctgtgattcagtttcttcgtctgtaaaatgtgaataataataagtggctgggtgcagtggctcatgcctgtaattccatcaccttgggaggccaagatggatcaccagagaccatgagttcaagacaagcctagacaacatagggagaccctgtctcaatttaaaataataacagcaactacctataaaagtgattgcaaggactcaattagttaacatacataagctgggcgcggtgtctcacgcctgtaatcccagcactttgggaggctgaggcgggcggatcacgaggtcaggagataaagaccatcctcactaaagcggtgaaaccccatctctactaaaaatacaaaaaattagcagggagtagtggcgggtgcctgtactcccagctactcggaaggctgaggcaggagaatggcgtgaacccgggaggtggagcttgcagtgagtcgagattgcaccactgtactccagcctcggtgacagagcaaggctctgtatcaaaaaaaaaaaaaaaaaaaatacataaaagcacttagatccctattgtccagtggccacttgccacataagcgcttgaaaagggctaatctgaccaggggtggtggctcactcctgtaatcccagcactttggggggccaaggtgggtggatcacttgaggtcaggagttcgagactaccctgaccaacatggcgaaagcccatctctactaaaaatacaagaaaaaattagatgggcatggtggtgaacacctgtaatctcagctacttgagtggctgcagcatgagactcacttgaaccctgtaggcggaggtttcagtgagccgagatcacatccccgcactctagcctgggcaacaaagcgagactgtctttaaaaagaaaagggctggccggatgcggtggctcacacctgtaatcccaaaactttgggaggccgaggtgggcagatcatgaagtcaggagatcgagaccatcctggctaacacggtgaaaccccatctctattaaaaatataaaaaatcagccgggcatggtcgcaggcacctgtagtcccagctacttgggaggctgaggcaggaaaatggcgtgaacccgggaggcggagcttgcagtgagccgagatcacgccactgcactccagcctgggcaacagggccagacactgtctcaaaaaaaaaagaaaagggctaaactactttaagatgtgccgtaagtataaaacaccagatttagaaaactttgtaccaaaaagtaaaatgtcattgatatttgtatatgggtaagatattgaaaaatattttgatattgtggatttaagcatgcatggcattttgatcaatgatggaccatatataaaatgatggtcccataacattataatggaggtaaaagatccctgttacctagtgattgtcacagaaatccgcgcccagccatgtttgtgttttaagctatgtgttactacaaaagagccaaaaagtttaacaaaaccagcctgggcaacatggcaaaactctgtctttacaaaaaatacaaaaattagccaggtatggtggcgcgtgcctatagtcccagctatttgggaggctgaggtggaaggattgcttgaacccaggagatcaaggctacagtgagcaatgggtgacagagcgagaccctgcctcaaaaaaaaaaaaaaaaaggtaagcattcatgaagtaaaaagttacagttggcagggtgcatggcttacgcctgtaatcccagcactttgggaggttgaggcaggcagatcacttgaggtcaggagttcgtgaccagcctggccaacatggtgaaacgctgtctctactaaaaatacaaaaattagccaggcatggtggtgcacgcctgtagtcccagctacttgggagcctgaggcaaaagaatcacttgagcccaggaggtgaagtttgcagtgagccaagatcacgccactgcactccagcctgggtgacagaggaagactccgtctaaaacaaacaaacaaacaaaaaaaactgacagtaggctaaggtcaacttatcaaaaacagaaaaaaaaaaatttttttttagggatgggggtctcactatgctgcccaggctggagtgcaatggctattcacaggtggaatcaccatgcactacagccttgaaatcctgggctcaagtgatcctcctgtctcagcctcccaagtagctgggactactgtggtagctgtgccaccgtacccaactagaaagttgttttttttttttttgagatgaagtctcactctattgcccaggctggaatgcagtggtgcaatcgcagcttactgcaacctccacctctcaggttcaggcgattctcctgccttagcctccagagtagccgggactacaagtgcccgccactacacccagctaatttttgtatttttagtagagacagggtttcatcatgttggccaggatggtctcgatctcctgaccttgtgatccgcccaccttggcctcccaaagtcctagggtaggtgtgagccaccgtgcccggcctattttttatcttttatactgtatttgtactgtaccttttctatttagatttgtctaaacacacaaatatttaccattatagtccagttgcctatggtattcagtacagtcacatgctgtataggtttgtagcctaggagcaatgcgctataccatatatcctagggtgcagtaggtttgtgtaaataaactctaggatgcttgcataagatgaactcagggctgggcacagtggctcacgcctgtaatcccaacactctgggaggctgaggtgggcagatcacctgaggtcaggtgttcaagaccagcctggccaacatggtcaaaccccatctctactaaaaatacaaaaattagctgggcatggtggcgtgtgcctgtagtcccagttactcgggagactgagacagagaactggttgaacctgggaggcggaggttgcagtgacccgagatcgcgccactgcactccagcctgggtgacagaatgagactacgtctcaaaaaaaaaaaattaatttccatttctatttaatttttaaatgtggctactacaaaatgcaaagttagaaatgtggcttgcaaatttttctattgcatagctcaagcttagaaccttcctgtcgttacaagttctaagtttggtttttatctcgcaagcagcactactgtgtgggaagttgtggggggtatggagatgaaagaagaggggcgctacctcctgggaagtgacaacctagcgggggaaatagatgtatcttcccagtgggggtgagaagtgtcattctcacctatttcagcagccttggtggtatgaaaaggcatcccaaccagcacagaagcaggatgcctccaagactgccttggttggcacctgcagcctgaagggggagaaaaaggctttgctagctcccctaccatcgaggatgaagacccccactgtacacagtgtataaggtttctttccatgtgaatcccagtgactctccttaactgggtggaggtggaaggtgtcatcagccttgtcccagatcgagcccctcaggcccacagagccccagtggggcctggctattactgacactcatgtcacactgagatgtaagacggcagcccaggccaagcttccccgggccccctcagattctcgggccctcccactcccctcaggcttcctcggcctccctgccaaacatctatctccctttggaccccactgctccccaaaactccccacgcccttagtctgttccttcagttccccaaactccttcagcctcatctagactcccctccgtccctcttctaggaccccaaaagctctcctcggccccaggaccccgcagaggtcccgtagtcccatctctgagaccccacaaagcctttcggacccctcaggtggcccttaggcctccggagatcccttggctccccacactctcctcagaccccagctcaccttagcctcgccccgaacccacctcacacaccccaaacgcccacaagacgccgctctgtctagtctctcccaactcccgcgcacccccggacgtcccccccaccccaggcccggatcctggaatcacctgggccccgcgccccacgccccgccgccgggcccacctgcgcgcccagctggttcagctgctgcatgtcgccgcccacggcctccggcaccgggtcctcagtgcagtgcaggcggcccatggcgcgcgccccagccccgcaggttccaccgccgccgccgccctgctcagcttcctcctccgctgccgctgccaccgctgccggcctctccgcgcatccacaaccgcactttcgccacggccgtcgcagcgcactcctcccccggccgccctgggctgtccggagccggggagccctcgcagggccgcggacacgcgcggccgccgggctccggggaggggcaggggcggcgccggcaccggcagacgcgaggtttcctgccagctctcccgctgagtgacctttgggtacggcgcttggcctctctgaacctcagtttcaccatctgagaaaatgatggctggggtagctccttaaatgagttaagcctccagaaatgtttaacgcagagaccggcacacaagaggtcttcaatcaatggctagctgctattatcatcatcactgttactatgcactccagagatatttatggcagcctactcgatgccagacactggggacagggaagggaacaaagcaggccagagtgtctctcggagagctgacatcagagtagagactaggtctcaaccttggaagggcatcagcatcaccccagcatcacctggtattgccgggccccgcccccagaggatctgattcgaaaggccagggtggagcctgagaatttgcatttccaataagcacccagggactacactttgagaccttctggagtggaagaaactgacttaccaaagtttcctcaaaatagtgcgagggctttgactgtgcggggcagggagggtggtggtgaggtgggtgaggggaggttactgagaccgtgatcatcactgcagcccctcaaacactctaacccccatgccctctcttcccaggggctcctcacagttcccaggtgaatattaccctaatccccactggaaacatgagaaaatagagacatgctacccagaatctaggaactgaacgccaagcctaagggcttcacctagcccctaagtccagccttgagggtaaagaggtaatgccgagaaacctggagcagggaaatgtggggggtttggctggccttcctcaccagccctcctcctctcctctaccctttcctgaaaatcccttctgtaaaagtataaacaaaatgtcttctacccggcccggcgcggtggctcactcctgtaatcccagcactttgggaggctgaggcgggcggatcacttgaggtcaggagtttgagaccagcctcaacatggagaaactccgtctctactaaaaatacaaaattagccgggcgtagtggtgcatgtctgtaatctcagctactcgggaggctgaggcaggagaattccctgaacccgggaggcataggttgcggtaagccgagatcgcgccattgcactccagcctgggcaacaagagcgaaactccgtctcaaagaaaaaacaaaaaagtcttctacccaaaggccaagcccatccccttcagtcattatatcattcatacattcattcaacaaatattgagtggcacatgcctgtggtcccagctactcggaggctgaggcaagaggatcacttgagatcttgagatcgagactgcagtgaacccagatggcgccactgcactccagcctgggcgacagagcaagaccacatctccataaaaaaaaaagaaggtctgctgtgaggcagataccatgacatgatagggggtggggattccacagtgacacaaccagatgaaccagatgcagtgcctggcctctgagaagtcagaattgacccagggggcagacgcaagtgtgtgtgaaagtattaagggatgccaaaaagtaggaggtgctttgagaatgtgtacaggacacagtccgagtttggagtacctggaagagaataaaccttcgggtgacaaacagacaggaactcagaggccctactcaccgtgcaagaattttttttttttttttttttgagacagattctggctctgtcacccaggctggagtgcagtggcacaatctcggctcactgcaatttctgcttcccgggttctagtgattctccagcctcagcctcccgaatagctgggaatgcaggtggccaccaccaaacccagctaacttttgtcttttttttttttttttggaaacggagttttgctctttttgtccaggctggagtgcaatggcgagatctcggctcactgcaacctccgcctcccgggttcaagtgattctcctgtctcagcctcccaagtagctgggattacaggcatgtgccaccaccccggctaattttgtacttttagtagagacgggtttctccatgttggtcaggctggtcttgaactccccacctcaggtgatccgcctgcctcggcctcccaaagtgctgggtttacaggcgcgagccaccgcacctggcccaacttttgtcttcttactagagatgggttttcaccgcattggccaggctggtctcatactcctgacctcaagtgatccacctgcgtcagcctcccaaagtgctggcattacaggcgtgagccactgcacctggcccggaatttttatttttaaatatttttaaccttgttaaaaaagaagatctgggctgggcgcagtgacgcatgcctgtaatcctagcactctgggaggctgaggccggtggatcacctgaggtccggagttcaagaccagcctagccaacatagtgaaaccctggttctactaaaaatacaaaaattagccgggcatggtggttcatgcctgtaatcccggctactctagaggctgaggcaggaaaatcgcttgaacccagtaggcagagattgcagtgagccgaaatcccaccactgcactccagcctgagcgacagagcaagactctgttcaaaaataaataaataaatagttgggggaaaaaaaaaagaagatccccatcagggcattacatttcttcatatctttaagtgttaaatcaactgtttaggtataaaaaataaaatgaacctgttttaagttttgttttgtttttaacatcctggagaaaaccactggatttcttttcatttctgcttccacagtgactggtgctgagtcacttgataaatactgtatttgtggaacggaattagctcatgtgacagaaaatacagaaaaggaaaggaattcacttgaaactgacacccaatactataggaatatggtgactcttcttttccagtctttttttttttttttgagacggagtctctctctgtcgcccaggctggagtgcagtggtgctatctcggctcactgcaagctccgcctcccgggttcacgccattctccggcctcagcctcccgagtagctgggactacaggtgcccgctatcacgcttggctaattttttgtatttttagtagagacggggtttcaccgtgttagccaggatggtctccatctcctgacctcgtgattcacccgcctcggcctcccaaagtgctgggattacgggcgtgagccaccgcgcccggcctttttccagtctttttccacatcgcaggtcactggggttgtgtgatttgttttcgttttacatacacaggactctcgcatttcaccaagttatttaataatccctcatactccacgtgtggttccttggaccagcagtgcaggcgttacctggaagcttgttagaaatgctgaatctcaggctgggtgcggtggctctcgcctgtaatcccagcactttgggaggctcgaggcgggcggatcacaaggtcaagagattgagaccatcctggccaacatggtgaaaccccgtctctactagaaatacaaaaattggccgggcgtcatggcaagcgcctgtagtcccagctactagggaggctgaggtaggagaatagcttgaacccgggaggcggaagttgcagtgggccgagatcgggccactacactctagcctgatgacagagtgagactatatctcacaaaaaaaaaaaaaaaagaaagaaagaaagaaaaagaaatgctgaatctcattccagccctttgggaggccgaagcaggcagatcacctgaggtcgggagttcgagaccagcctggccaacgtggagaaatcctgtctctactaaaaatacaaaaattagccaggtgtggtggcacatgcctgcaatcccagctattccgcaggctgaggcaggagaatcgcttgaatttgggaggtggaggttgcagtgagcttagatcactccactgcacacaagcttgggtgacagagtgagactttgtctcaaaaacaaatgaataaataaaataaataccgaatctcaggtctactagacctgctgattcaggatctgaattttaacaagattcccaagtgatttgtgggcacattaaagtttgaagtgcaaataataacaaccactttaagtgctcactttgtgcaggactttattttaagcatttgaatacacaccgtgtataatgataataatactttgcattgtctactgattgtcgctcatattactttttcttttttgtgtgtgctgaaacccaggaatgaaccattatttctattttaatgtttaccacaatgtgttattgctgtcgtttatacatctgtctcctccacttactaattattttgtctcaggcaaattactaacctttcagtgcttctatttctgtttttatttataaaatggaaatgataatataaccttcttggaaagatgaaacaagacaatgcttataaagcatttagcacagcaactggactatggtaagagctcagtaactgcttggtattattatcatttcaatttttcaatcttataaaaagaatatggcaataaacattcctgtacacaattcttttccacatctgattatttctttaggaaaaatttctaggaaggcaaggaatattatgttcagtccttctgggctctaaatgtcatggggatggggtagagatgaggatgtctaatggataccacaaaaagtagttataaagaatgaataggctgggcgcggtggctcacacctgtaatcccagcactttgggaggccaaggcgggcagatcacctgaggtcaggagttctagaccagcctgaccaatatggaaaaacaccgtctctactaaaaatacaaaaaattagccgggcctggtggtgcatgcctgtaatcccagttactcaggaggctgaggcagaagagttgcttgaacccaggaagcggaggttgtggtgagctgagatcacgccattgcactccagccttggcaacaagagcgaaactccatctcaaaaaaaaaaaaaaaaaaaaaaaaacagagagagagagagagaatgaatgaacaagggccgggggcggtggctcacatctgtaatcctagcactttgggaggccgaggcaagtggatcacttgaggtcaggagttcaagaccagcctggccaacatggtgaacctccaactctactaaaaatacaaaaattagctgggcatggtggcaggtgcctgtaatcccagctacttgggaggttgaggcaagagaatagcttgaacccaagagaaggaggttgcagtgagccaagattgtgccattgcactccagcctgagcaataagagcaaaactctatctcaaaaaaaaaaaaaaaaaaaaaaaaaaaaaaaaaaaaggccggccgaggaggctcatgcctgcaatcccagcactttgggaggctgaggcaggcagatcacaaggtcaggagttggagaccagcctgatcaacatggtgaaacactgtccttactaaaaatacaaaaattagccaggcttgctggtaggcacctgtaatcccagctactcaggaggctgaggcaggagaattgcttgaacccgggaggcagaggttgcagtgagctgagattgcgccactgcactccagcttgggtgacagagtgagactccatttcaattaaaaaaaaaaaaggaagaaaagaaatgacaaatacttcaggtgaaggataccctaaattccctgacttgattattacacattctatgaaagcaacaaaatatcacatataccccataactatgtacaaatattatgtatcaatatatttttttaatatcacaaggacggatgaattttcaaggtaagcagaaactaaaccattacccatgaaccatctctctgaaaacacccagaaattagcatttctgcctgaacaggcacctggtgcagttccctgatgaggctccgggtccaggccctgcccgccttccaacccacatcccctacatcccaaagaggagacatccaagtcctctaaattagcctccaaatctcaaatctcatttttggcttcaatgataaaatgctacctaaacatcgtccaaaaatgctgcataatattctatggagcaagaattaaatgctcataactaatccttgtggttgcctatttagaactctctgacttttctttctcattaagaactttgtaactaacaaaggcaatagataaaaaaagtctttccaattttctccttcacaatccactcttagaggaaggaaggagcagtgattactgttaatgtgataactttgcagcaggaaatgcaggccggagccaggactctcttctagagaacctcctgcccccatttcagccttaatgagggaccctactcccttcattcactttaaaatgtccctgtggagggcaacgaaagtcctcactccctctcccctcccccgcgcctgcaagtgaaaggagttcattaagaagtagtttctcaggcagggaggattcctgctgggagtttcaccaaggggccaggttttccctaggagaaaggtctaacccttcacactctgaaatgccaaagggcatttttttttaaattaaacttttaattttgagatcattgtagactcacatacagttttaagaaatgatacagagacattccttgtggcctttacccggtttccctcgatgcacagatcccacagtgtcatcaccaggatattgacattgatacagtcaagacgcagaacatttccatggcagcaacgatctcccatgttgcccaatggcattttaacagaagggacaagtgctagatcctctaacaaaaactagaagaaaatactatgaacattttcaggttaaaaaaaaaaaactgggccgggcatagtggcacatgcctgtaatcccagtactttgggaggccgaggccggcagatcacctgaggtcaggagttcgagaccagcctagccaacatggcgaaaccccgtctctactaaaagtacaaaaattacccagtcgtgggggcgcatgtctgtaatcccacctactccggaggctgaggcaggagaatcgcttgcacccgggaggtggaggttgcagtgagccgagatcacaccattgcactccagcctggacaacaagagcgaaattctgtctcaaaaaaaaaagaaaaaaaaaaagcacgtaacaaaaatgtaaaaatacagttgacctagattcctgacatctatgtcatgaaagtcattgacaaaggaaggctggagaattgctctagattaaaataaataaaaaagacaagataacaatgcaatgtgtaattctggatggaggtaaacaattgctataaaagacattggcacaaaataaatgtacttaacactactgaactctgcacttagaaatagttaagatggttgctctttcctgtagtcccagctatctgataggctgaagtaggaggatcccttgcgtctatgagttctaggcctgggcaacatagtgagaacttgtcctcaaataaataagaataaatagttaaaatggtaaattttatgtgcttttttaaaaccacaattaaaaaaatacattattgtgacaattgaagtctgaacacccactgtagattagataataatattgtatcaatgttcaatttcctgaacttgataaatgtaatttggttatgggaaaatgtctttgttcttaagaaatgcatgctcaaagtactcaaggtaaaagtggataaaatggttcagggaaaaaaatgagccaacacatgtggtaatgtggagatcactgattaatttctaaattggctctgagcatgctggaagccagagggagataagtcaatttcacctctagtttttcatccttacacaggtaaattaatgtagataaatttctcttgttggacttacaggagagttccaattctccaatttttatctaggacatggtgatgaatttgtttacctgttcaaaaatcttccttcaaatggcaggatttctggggtaaagtttaagcctttttaagatcctctggcctaagctccaatggatgtttaagctgtccctctagaaatttgctttttaaagagccctttggcagttcctactttgagggtgtgggtgacaatgtctctaccttttgggaatctcacccctcatttcaaattcatggtaggaatcactttgcctgagaaaatgaggcctggatctctattgtccgctttgtttttctctgcagaaccattataaagtgaatgcctggcctgccctgctttaggccagcaatgcatatcactgctgggtgctgtgaacacaatccggggtgtaatcttgggggactgacctctagaactttcttttctggactatttttatcatctgaaagatagaggagtcgcttcattcattccagtagtaggtatttgttgagcacctactatattccaggtcctgtgttgggtgtcagggacacagcaatgaataagatagatgactgctctgcctctacactgctcaaaatctaatgagggaggcacaccttatatgaagagtcacggaaagacattgcaaaggagaaaaatgctaggaaggagagtggggggctgtcaacaggtgtaatgggggtaaacctgtccggcggagggaaggtaagcagatggagcagttagcctctgtggggccttaggaaaggagcaattgagggggaagccctggggtcttgggcatgtcacccctaccttctccctctactctgcaggtcagcataacttggtaatcatttcctggcctgcagccagggttatcagcatgctgtgtatatggacgtcgtgaagattggaggctgagggccctgaccagaggagataagaacaggtttggacaagaagaatccatcccctctatgtttatctcaaaacggtagagcaggctgagtctggacccagaacaaatccaggaagtagaatccaagaagcagagagatgaatcaagaatgacactaaggttttgggcttcattccatgctacactatctgccccatttgacagtgaaggaagcagacgcccagagaagggaagacacctgtctgaggtcacacagtgggttaataggagaatgagaacagaacctagaccgctgaacttttccccttaaccatcttaccctcctcagaagtcaagcctgagcttccaaaaatgaaggaactcaggtccagggaaactttctgttttgtctgagggtgagggatgagataatgatgagtcagggcttcagggaaacgaacatttactgattacctaatgtgggggtagatgtggtccctgctctcagaaagctcaaagtgtgaatgaattaaagtcaatgtgaccaggcgcggtggctcatgcctaaaatcccagcactttgggaggccgaggcaggcagatcacctgaggtcaggagttcaagaccagcctggtgaacatggtgaaaccccatctcacctaaaaatacaaaaattagccaggtgtggtggtgggcgcctgtaatcccagctactcaggaggctgaggcaggagaatcgcttgaatccagaaggcagaagttgcagtgagctgagatcgcgccactgcactccagcttgggctacagagtgagacttcatctcaaaaaaaataaataaataaaacaacacaaacaacaacaacaacaaaataaagtcaatgttacttcatttcatgaacaacatcaaatttggagggggccatggggtattctccaaggggcaaaaacaggtgatgtccaacagagtgaggcatggcatctctttcaagggccaggatggagaaagaaatcagtggattcagctctggaccccaagtcaaaagccagaaagacaaatcacagattttgatttgcagttaagccttttctcacgagggccactgtacggcatccaataataataactgctactattatgataaataacaagcattcattcatttgatgtcttgtctggagaaacgggataaaacattatccacagacatagagactgttgcagaatgaagggagggctttcctgttttcttttcttttttttttctgatggggtctcactatgttgctcaggctggtcttgaacccctgggctcaaatgatattcctgcctcggcttccaaaagttctaggattacaggcctgagtcaccatgcctggcatcctgtcttctattaactaccactgtgctaggcatggtgcagaatatttcactctgacctgatcacgtcactgaaaaccctgcaaaggctccaattgctgaaagcgtggatgctctgattcctgtcttcttcacctgagtctgccttcctcttcagctgtgtgctctagccatgtgggcctcccctctgttccttgcccaagccgtgctccttgtgcctcaggagcttagcaagtgctgttcccaaatcccagaacacgtttccctcaccccttagcctgctgcttacttaaccattgcatcccctcagatccctgcatgagcattgcttcttttcttttttctttttttttttgagactgtctcgctgtgtcacccaggctggagtgcagtggcaggatcttgactcactgcaacctctgcctcccaggttcaagtgattctcctgcttcagcctcccgagtagctgagattagaggagcatgccaccacgtcctgctgatttttttttttttgagatggagtctcgctgtcacccaggctggagtgcagtggcgtgatcttggctcactgcaacctccgcttcccaagttcaagcaattctcacacctcagcctcccaagtagctgggattacaggcacccaccatcatgcccagctaatttttgtatttgtgtagagatggggtttcaccatgttggccaggcttgtcttgaactcctgacctcaagtgatctgccgcctcagcctcccaaaacgtgacttacttcttcaggaaagttttctcaggccccatgacctaattaattttcattttataataccctgtactcgtcatagcatttaatacaattgtaggccggccaggtgtggtggctcacacctgtaatcccagcactttgggaggccaaggcgggtggatcacaaggtcaggagtttgagaccagcctgatcaacatggagacaccccatctctactaaaaatacaagattagccaggagtggtggcacacgcctgtaatcccagctacttgggaggctgaggcaggagaatcacttgaacccgggaggcagaggttgcggtgagccaagatcgagccactgcactccagcctaggggatagaacaagactctgtctccaaaaaaaaaaaaaaaaaaaaaagtacaattgtaatcttacaactattagtgagataaatttgatgaatgtctgtttcctctactcagttgtagttccgggagggcagtaaaaggactttgcatttttcttctcagctttattccttaccacagtgcctggcacagagttcagtgaattcaataattcaataaatatgcacaccctggccaggcgtggtggctcacgcctataatcccaacactttgggaggcaaaggcgggtggatcacctgaggtcgggagtttgagactagcctgaccaacacagagaaatgttgtctctgctaaaaatacaaagttagccaggcttggtggctcatgcctgtaatcccagctactggggaggctgaggcaggagaatcacttgaatccaggaggcagaggttgaggtgagctgagatcgcgctattgcactccagtctgggcaacaagagcgaaactctgtctcaaaaaaaattaaagaaatatgcacacccctcctccaccaatgacagaaacagggaaggaaattccgtgctggttctgcaggggatagagagagatggatgaactccctccatcccaatcccgtttgggccttgtttatcccacgtgtgaaatggagattagactccttcctacttcacaagggtgttgtgagagtcaaagtgtaatacacataaaatgtttagctcaagtgcctgagcacatggtaggctctcagcagctattatgaaattgcttatttaataataattaatgaatggctgggtgcggtggctcacacctctaatcccagcactttgggaggccgaagcgcatggatccagccgggccaacacggtgaaatctcgtctctactaaaaaatacaaaaattagccaggaatggtggcgggtgcctgtagtcccagctacttgggaggctgaggcaggagaatcgcttgaacctgggaggcggaggttgctatgagctgagatcgcaccactgcactccagcctgggtgacagagcaagactgtctcaataataataataataataataataacaataataaataatgaatatgacctggccaggctctgtgtacttgtctagctaggtacatttaaggaaaatatttcaatgacccgttttggggttaaaaaaaggagaataggagtctgggtgttcctgttgaaagtgaaaggtgaggaacccactttgcaaatgaacgtggcctctaatggcactaccattaggactgaataccttacaatggggttctttcacatacatgggctctgcgaatccccacagtcattctgggaagtaggcatggctattattattattattactccaattagacaagggagatgcttgaggctcgaactccttagcatagcacacacagagtgggggtcacagggagatgggggtcgagtggaggatctagtcccagctctgccagctgtaggccccaggcaaaccacttcacttttctgaacctcattttccttcactataaggagaggcactagatactagatactagaggtggactgggcttgcctgagaggctgggagaccaagggacagacaggactatttggcagacactgaggatggaaggagaacatttatcccacacctgccaagagctgaggcagccaggaaagcagtgcagcatatactcattaataataatatataggccaggcgcagtggctcacacctgtaatcccagcactttgggaagccgaggcgggcggatcatgaggtcaggagatcgagactatcctggccaacatggtgaaaccccctctctactaaagtacaaaaaaaaaattagctcggcgtagtggcacccgcctgtaatcccagctactcgggaggctgaggcaggggaatctcttgaaacggggaggcagaggttgcagtgagccgagatcgcaccactgcactccagctctggtgacggagtgagaccctgtctcaaaaaaaaaaatgtgtatatatatatataaaatttaacaagcatttttatggtattttccatgtggtaggcactgttcaaaatgccttacatgtattaactcataattctcaggaaacccctaggaagtaggaaaaatgatctctattttaaagatgcgctttggtagtctgaggtgggaggatcacttagggtcaggagtttgagaccagcctggccaacatggtgaaaccctgtctccactaaaaagacgaaaattagcccagtgtggtggcccgcgcctgtaattccaactacgcgggaggctgaggaaggaagaagaatcacttgaacctgggaggcagagtttgcagtgagtcaaggtcgcaccactgaactccagcctgggcaacagagtgagactctgtctcaaaaaaataataaaataaaataaaaataaagatgaagaaattgtggcataaagaggtaataacacatgctcacaaaaatttctatcatacattaagtgtctagtatgcagcaggcactgtgctaagcactttacatttgttattaaaaacctgtagctgctctaagaactgaaaggtcatggtataatttaacagaaatgtaagttaactataacatgtgtgtcagcccatcagtgtgttgatttattagcataagagtgtctaggatctatatatgtacatgtggcttttctttataatgttattttattttagagatgggggtcacactgtgttgcccagtctggtctcaaacgcttgggctcaagcgatactcctaccttggcctctcaaagtgctaggattccagacaggagtcaccgtgcctggcccttaattttctgaagaataaatttttatttaatataatatctaatttatagaagagttgtaagtctagttcaaggaactcctggatgtcttttaaaccacattatctatttggttcatattttgtcctctttgctttagcaatctccctgacccatacatatgcatattatttttctgaattatttaagagtaaattggtgatactgtgtctttttttattttttttctttgagacagggccttgctctgtcgcccaggctggagtgcagtggcaggatcatggttcacttgtagcctccatctcccaggctcaagggatcctcccaccttagcctcctgagtagctgggactacaggcacaggctaccatgcctggctaatttttttgatctttagtaaagacaggcaacactttgttgcccaggctgcttctgaacttaactcaaaggatcctcctgccttggcctttcaaagttctggaattacaggcgtgagccacaatgcccggctgcctcttctaaataatttggtgttcatctcctaagagcaaggacactctcttatctatgtgttgttgctttgggtgatgaaacaaatggtctgtaatcacagaatatgtatccccttaatgaatattcctcaccttcatgattataatgattgtgatctgttaaaacacaattttttttttttgagacggagtctcgctctgtcgcccaggctggagtgctggagtgcagtggcacgatatcggctcactgcaagctccgcctcctgggttcacgccattctcctgcctcagcctcctgagtagctgggactacaggcgcctgccactgtgcccggctaattttttgtattttttagtagagacggtgtttcacagtgttagccaggatggtctcaatctcctgacctcgtgatctgcccacattggcctcccagagtgctgggattacaggtgtgagccaccacacccagcctaaaatacaattttaagtaaacattgcaaggtgaccacacagtaggtgctcagtcaaggtttgattacacagctgactcactctgtgtaatcccttccttctctgggcctcagtctcatctgaaatggggcccccagttctccttgcctcacatcctcatgggtggcagtgaggcttaggtgagatgatgaatttgatcaatgcacttttaaaattgtaaagaaaggctggacggcagtagcctgtaatcccatcactttgggaggccaaggcgggtggatcatgaggtcaggagttccagaccagcctggccaatgtggtgaaaacctgtctctagtcaaaaacaaacaaacaaacaaacaaaatttagccaggcatggtggcacatgcctgtaatcccagctactcacgaggctgaggcaggagaattgcttgaacttgggaggcggaagttgcagtgagctgagatcacaccactgcactccagcctgggtggcagagcaagactctgtctcaaaaaaagaactgtaaagaagttctgtgggggccgggcgtggtggctcatgcctgtaatcccagcactttgggaggccgaggtgggcggatcacgaggtcaggagatcgagaccatcctggctaacacggtgaaaccctgtctctactaaaaatacaaaaaaattagccaggcgtggtggtgggcgcctgtggtcccacctaatcgggaggctgaggcaggagaatggtgtgaacccgggaggcggagcttgcagtgagccaaaattgagccattgcacaccagcctgggcaacagaatgagactctgtttcaaaaaaaaaaaaagaagttctatgccctggggagatatcaggccatttttctacccattctcccaacattcctgctccttcccaagtgatgggactgagacaacctgctcacccaaccttctgctttttcttcctgggtttaggtggtcccagaaaatccagccctttggcatctgaactgggcctccccggagttcccactggtggcacaggcatcctctgccacaattcaggacacagggtttagctgtgggttcctagcttagggttcagacacagaggcccaggagccctccccatagacctgtttatttattttatttttatttttatttttatgagatggagtctccctctgttgcccaggctggagtgcagtggagtgatctcggctcactgcaacctccacatcccaggttcaagctattctcctgcctcagcctcccgagtagctgagattacaggcgcccgccactacgcccggctaattttttgtatttttagtagagatggggtttcgccatgttggccaggctggtctcgaactcccgaccttgtgatttgcctgcctcagcctcccaaagtgctgggattacaggcgtgggccaccacgcccagcttcaggcctgtttatatatgctgttttctttccaacaacaatatgccccaggctgggcatggtggctcatgcttgtaatcccagcactttgggaggctgaggtgggtagatcacctgaggtcaggagttccacaccagcctggccaacatggcgaaaccccgtctctactaaaaatacaaaaaattagccgggcatggtggcaggcgcttgtaatccgagctacttgggaggctgaggcaggagactgaacccaggaggcagaggttgcagtgagccgagatcgcgccattgcactcagcctgggtgacagattgagactctgtctcaaaacaaaacaaaacaaaacaaaacaaaacaaaacaaaagatgtgccccagatggtggagacaagctacaggccctctccagagagacccccttcttcctgcaccaatggactggacaccaatttgtatgtttgtgccagaaagccaaggagtcctgctgttcattcacaagaggccctgctgggcgccaggcagggcgctgagctgagcccatttctctctggtatctccctagcctctccccaagctcttaggtagaataagatccagtaagtatagacacttttgcggcatccaaagaattaacccttcactcatttactcacctggtaagagatacagggagaaagctgtggagtaactcagggagctggagcccataaggcaggaaacccatgcccattcattcaacaaacttgtattgagctcctttttgatgcatcccccatccactataagcacttggagacccacacagatgtggtttctgctcccatagtgtgtgtgtgtgtgtgtgtgtgtgtgtgtgtgtgtgtgtgtgtgtgtgtaggggaatgtaaacaggaaaacagatatgcaaaacaatttcagatcgcggtaagtgctaggaacagaatgaaataggataggagtgatggacaggggagacttcaggtggagtcatcgggaaaagcctctccataaagtgaccttctgggagaaaaccgaggggtaagaatctggtcctgcaaagatctgggcaagaaatgtccaggtgtagggaacagcgaggtcaaagtcaccatcacaaggaaacgcttggtgtattgaggagcagcagagaagttggagtgaaggcagagaggggttaaggtagcatataccttgaaaggggaggctcctataggggcttacaggcgatataaatcattcattcattcaacacatatttattgagcatctactgagatcctgtccttagtttactgcgtggagacagaccacaagcaggtaaacaagcaaatatgtaagtcccaggtcagataaattttaggaagtgctgttttccagtggttcaatggtcatcccagggcagaggtggggagacctgctgagggcggcttctccctcagtcagtccatgcctgcagggtctggaacccaggtagccagagacccgctggtcttctttcccctcccctgccctcccctcccttcaagatggctgacaaaggccgggctgggtggaaggaagggaggaagggcgaggcagagggtccaaagcaggatgacaggcaggggcaccgcggcgccccggtggcactgcggctggaggtgggggttaaagcggagactctggtgctgtgtgactacagtgggggccctgccctctctgagcccccgcctccaggcctgtgtgtgtgtctccgttcgggttgaaaggagcccgggaaaaaggccccagaaggagtctggttttggacgtctgaccccacccctcccgcttagggcttctgatcccccagggtgatttcactggcccggggttgggagggcagggggccagggggcggagcccgcggagaggggcggaggggaggctccgagcgatttcaaatttccctcgtccccgcccccccgttccccccgcgcccgggcggggatctgagtggctgcggcgggggcacccccgggcgggggcggggcaagagccgggccggggctacaaggggagtcggcaccgccccctccccacccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggtgagcgccccggggccccggggaggctcggccgccagctgcttcgagggctgctaggggaggggacggcgggggctcccgaagctgccggggagagaccctctccagggacctcccgaggaggggctctcgccgggttggagacccggctgggtttgcggggtgaggaaacgtccacggaccctgcttggggtggaacggggacagcgggtgggacgcgggggacatacgtctgacggggaccggagatactagaggaagggacgcgtctgctgcctccaggagcccgaagaggagagaagcttgctcgcagggagggggacgcgctggcttcccggggtccagactcgaggaggaggaggtgcccgtcgagagcatgaacaggggctttgctcatgggcagggggtgtaattacctggcctctgccttgggaaaagttaaggggcagaggaggtgaggaggggtttctgccatgcaggtgggcgtccgccccttgcaactgggatgtggggtcttcaggcgaggcgctgtcccttcccccaatcccagctttaggaaagagctcgtgagtgtgggcttagactcgcgcgggctggggtgtgcgccgtggagggcgtgaggcagagggcgacctcccggggtgctcctgagctgagccatcaagcgcggggagcagcggggctgccctctgcctgtgcacacctggcccgggaggagccggccggaggggcggcgcctccctgtcccggccacgccgcctaccctggggtcttaccttccattcttagcctaactcccgtgtgcggctggccccacttcccagactcgcacactaaggcctcaaaacctctagcaccagctcctggaagataagcttcccggctcgtggttgcatggggagggtgtattgagctccactttatcggggagaaagtggaagcggagaaagacctaacaagttgtaagactgcgctgcccttgggcccaggcttcccgctggaggatctcacctgtggatggagttccgagcccaggtcttgcccgcgcctccagctttccctgctcccttttcctcccctggtctaggagagaggctcgctgggcctccgtgtttccaccctcccccgaagctgggaagtgtttgaattaaagggaattaagggcagagtatgaactttgagttgcctcctgagttctggatgcggtgggttgtggcagacgggtggcagtttttgggaaacagctgttatctcctctaccaggcctgctggggcttcttgttcacccaccttggaaacgccaggtgcggacttgatttttccagagttgagatgatggtacttagtttatagggttggtatacagtaagcactcaatacatgtttgccattgttggaatcactagctagcacacgggctaagcaagcttccttccttaaggaagcatagttcttagttcatcatgtgtttaaaccctgtctcgccaagttcattgctctccgtgccttaattattacatctgtgaattagcaatagtcctactaatagggttgtgtaaggatgaaaccagtcttatgcgtgaattaacctcttcagcccttgatcttcctcagatgtttaggcataatagcctctaccacattgggcctgggtaaagaggcagtgggatagtgcctgtgtagggtcagcacatggtgagtgttgatgtctgtacttaataacgaatagcccctcattttagggtggccattcctgagatttggggatggagggaggcacccctgccagcctctccttttcctgccttcatgaaggcagctctgaaagcttttctcaatcattgtccacgattagggagttggcaggaagaaccgcctttgttccctttcgaacggagtcttggttttgttttataagggttggggccgtttttaaagccctcccggccacgcatgggggcctactgcaaaggtgtaattgcagaactaagtgagatcctttaccttttcccattggggtggagagtgctgagacaaagggacaaggactggggccagtggcatcctgctcttaaagtcatagacataacccccaccccttgcaaaggatggggggaggggaagacggtagctgggagctgcaggggtctaagggaggagcaagggaggtggggttgagaggctgcttccttcccttcctccagccacgtggggcctgtgatccagaggcgcctgtcgcccctcattattgcagccccatggacctgctgccagtgggggcttgggcaagttcttcaaggaaaacttaccttgggattccttttcctagaccagctcttatgccggctgcctcacctccaggctcagacgccttttccagtttcagctaaatgtgaaacttttcagaggtatgaggttgtgtgctcttcctcacacaccagtccttagcccaggcacatactactaattgagtggagttttttcttttaaatcatgaattttcaggatgatttccagtttcacggaggaccagggctggtgaagtatggaattcatttcatgtgcaggccactcttgtaaaaagagactgagcagatatgtctcccctttgttggggggctcatgttctcactgggacccttttacaggtgatagaactgaggctctggaagatacaggtactattacgtcttggtggtgagcattttctttctctttttttctttcttttttttttttttgagacagttttgctttgtcacccaggctggagtgcagtggtgtgatctcagctcactgcaacctctgcctcccgggttcaagcaattctcctgcctcaaccttccgagtagctgggattacatgcgcacaccaccacgcctggctaatttttgtatttttaattgagacggggtttcatcatgttggcaaggccggtctcaaactcctgacctcaagtgattcacccgcctcggcttcccaaagtgttgggattgtaggcgtggctgttacacccggctgctttttatttatttatttatttattttttctttttttctttttttttttttttgagacggagtctggctctgtctcccaggctggagtgcagtggcgcgatctccgctcactgcaagctccgcccctcgggttcatgccattctcctgcctcagcctcccaagtagctgggactacaggcgccggccaccatgcctggctaattttttttgtatttttagtagagacggggtttcaccgtgttcgccaggatggtctcaatctcctgacctcctgatccacccgccttggcctcccaaagtgctgagattacaggcgtgagccactgtgcctggctatgcttttatatgggtgctgcctcacacccataatcccagcacatgggagactgaggctggaggatcacttaaggccaggagttcaagaccagcctggccaacgtgataaaaccgtgactctacaaaaaatacaaaaagtagccaggcgtgtttgtgcatgcctgtaatccgtgctactgggaggctgaggcacgagaattgcttgaacctaggaggtggaggttgcagtgagctgagatcctgccactgttctccagcctgggcgacagaccgagaccctgtctctatgtgtatatatctacgtagatatagatagcttaagtttttttttttataaggacaaggtcttgctgtgttgccaaggctaaccttgaaagcctgggtccaacgatccttctgcctcagccttccaaaggcttgggattacaggtgtgagctaccacacatggcctctaggtcacttttcactcagattttttcattcattcaaacaaaatagcataggtatgacctctgctctagtttattttttatttacttatttatttatattttgagacagtctcgctctgttgcccaggttggagcgcagtggcggttgctcactgcaacctctgcctcccaggttcaagcaattctcatgcctcaacttcccgagtagctgagactacaggcatgcaccaccatgcctggccaatttttgttttgtaaagatggggtttcacctcattgcccaagctagtctcctgggctcaagcaatctatcctcctcatcctctcaaagtgctgggattatagacatgagccaacacacccaaattcaatttttttttaattatttttattttttgagatggagtttcgctcttgtcgcccaggttggagtgcaatggcgtggtctcggctcactgcaacctttgcttcccgagttcaagtgattctcctgcgtcagcctcctgagtacctgggactacgggcgtggtggtgcatgcccggctaattctgtatttttttagtagagatggggtttctccatgttggtcaggctggtctcgaactcccaacctcaggtgatctgcccacctcagcctccctcccaaagtgctgggattataggcgtgagccaccgtgcctggcccaaattcaatttttaatggggtccttgtcttgttttatgggtacaacatcatttatctgcctgagaatattgtagggtttagtgttccctcgtgttcccgccaatattaagggatactcaattttccagtaccttgccctgtaggtctggctacagggccaggagactggtgaggtctcagtctggtatctgttcctccacttgtcccagtctgtaagctcttgtgtgtgttttttttttaattatttcttttgagacaagtctcgcattgtcacccaggctggagtgcagtggtgcgatcatagctcactgcagccttgaactcctgggctcattccagtatcctcccacttcagtctccaaagtagctgggaccttagtcacgtgccaccacgcccatctaatttttaaaattgtttgtagaaacattaaagtctcactatgttgccccagctggtctcaaactcctcggctcaagcaatcctgcctcagtctccgaaagtgctgggactacaggtgtgagcctgtgcgcccagctgtctcatgttcttgtccagagcctcagcctgcatgtctgaagaagagtggttgtctccagagcagcaggctgagggaggggacttgggagtcaagggtctaactcttcctttggaagaaggcctctctcttagtaggcttttctggattccagcagcatttatgtcctgttgtatgtgtgtgttctggggccagagctggggctggaacccaggctgccactgggccccagctcctgcagaagtgctgatgcctttgtagggcgtttgctgcagccagaacagtgatgggccctggcagcatggcaacatggctcactctgttgcttaggctggagtgcagtggtgcgatcacagcttactgcagccttgaactcctgggtcaagtgatcctctcacctcagtcacctcctgagtagctaggactacaggtgagagccaccaggcttggctaattttaatttttttttttttttttttggagatggagtttcactcttgtcgcccaggctggagtgcaatggcgggatctcggctcaccacaacccccgcttcccgggttcaagcaattctgactcagcctcccgagtagctgggattacaggcatgcaccaccattcccgactaattttgtatttttagtagagatggtgtttctccatgttggtcaggctggtctcgaattccccacctcaggtgatccacccgcctcggcctaccaaagtgctaggattacaggcatgagcctctgtgcctggctaattttaaaattttttatagagataggctctcggtatgttgcccaggctggtctcaaattcctaggctcaagtgtaatcccaaagtgctgggattacaggtgtgagccaccatgcctggtcccttgcctgcctttgattcctaattactatcatggttcctgaagcctagtagaactcatctgaatggatacaggaggctctggagatgggaatggggaggcactaactagggtcccactgagccagctacaggcccccgctcttttgtgaaaagatggttgtgatgaagacttaagtgttcattatattccaggcaagccattttctctgactctgggagttgtttggcaccatgggtaaggaagccctaccccgacaatggcactggaggaagagcctcaagcttaggcactggctttcccaagtccttgggtgaatttgcaaacctcacctgtgtcctcatgttgccctaggatgttacatgctgagctgtaagcaggatgctgaattaggggaattgctcagtactaaatatgattgttactacaaccacaaaactagcaaggagtagaactgcattaaaacactgttgcaaatttttttattttttgagacggagtcttgctctgtcgcccaggctggagtgcagtggcgagatctcggctcactgcaagctctgccttccgggttcacgccattctcctgcctcagcctccctagtagtagctgggactacaggcgcccgccaccttgcccggctaattttttgtatttttagtagagacggggtttcaccatgttcgccaggatggtcttgatctcctgacctcgtgatctgcccgcctcggcctcccaaagtactgggattacaggcgtgagccaccatgccgggcccactgttgcaaatttctttccaaaacctctgccagcacatggctgaacccacagaactggcaggacacacaagatgcgctgggttaagatgctttggtgctctctgtgggttcagctgactgttttacaggcctgcttcttgaccgttggggtgggcagatctgagcccccactaggtaattgtggacagtttttgaaaagtggtttttatgtgagatcatgggcttcttttaaagccatttgtatatatgcagttcccttatctgcaggccttaattttgacatttctgttttccttctcgagatttgttttctgtccctgcagtactgctttttccagaatgtcatataaatggaatcatacattattattatttttgagacagcatctcactctgttgcccaggctggagtgcagtggcacgatttggcacattgcaacttccgcctcctgaattcaagcaggaaccatacattatatagcccttcgagtctgggttcttttacttattgtgagatatttgagatttatttgtgttatgacacgtactagcagttatttcttactttttaaaaaattttttaagacaggtctctggagttcagtactacaatcacagctcactgtagcctcaactccaatgctccagcagtcctcccactgcagcccccactgcccagtagcttcgactacaggcacttgtgcaccactatgctcagttaatttaaaaaaaaattatttttgagacagggtcttgctctgtcactcaggctagagtgcaatggcatgatctcagctcactgcaacctccacctcctgggttcaaacgattcttctgcatcagcctcctgagtagctggaattacaggtgcccgccacctcatcaggctagtttttgtaatttttttttttttctgaggcagagtttttcactcttgttgcctaggctggaatgcaatggtgtgatctcagctcaccgcaacctctgcctcccaggttcaagcgattctcctgcctcagcctcccaagtagctgggattacaggcatgtgccaccaccaccagctaatttttgttggtttgtttgttgttgttgttttagtagagatggggtttctccatgttgatcaggctggtctcgaactcccgacctcaggtgagccgcccaccttggcctcccaaagtgctggaattataggcttgagccaccatgctccgccttactttttttttttttttccttttgagacagagtttcgctctttgcccaggctggagtgcaatggcatgatcttggttcaccacaacctccgcctcccgggttcaagtgattctcttgcctcagcctcctgagtagctgggattacaggcatgtgccaccatgcccggctaattttgtatttttagtggaaacggggtttctccgtgttggtcaggctggtcttgaacccctgacctcgggtgatctgcctgcctcagcctcccaaagtgctgggattacaggcatgagccaccatgcccggcctaaattttttttttgtaatgttggggtctcactttgttgcccaggctgatcttgaactcctgggctcaagcaatcctcctgcctaggcctcccacattgctggggttacaggcatgagccactgtccctggcatctttttttttgctgtgaatataacatttctagcttttctttgtgttgtgatttttaccttttcaatacatagtgtgcaaggacatattttctggttacgatagaaataatttatttgaaagtctatccatgttgaaacaactaaaaatgctgtgcctttatctgttggtagaagaactaagctcccttaaagaaatctagagagcagaagagaacaggaaatgagagaccacaaactaaagggagaaaatgaacttttcaataaggcttgcaggcttgctctagcagttgtagtgattaaaagtagtggcaatggctgggtgcagtggctcacacctgtaatcccagcactttgggaggctgaggtgggcggatcgcctgaggtcaggagttcgagaccagcctggccagcatactgaaaccctatctctactaaaaatacaaaaattagccgggcgtggtggcatgtgcctgtaatcccaaggaagctgaggcaggagaatcacttgaacccaggaggtggaggggttacagtgacccgagatcatgccattgcactccagcctgggcaacagagcaagaccgcatctcaaaaaaaaaaaaaaaaaaggagtggtaaaggataaataccaaacaaaagtgagcctcaaaacatattacatatatatgggaagttcaaataagagatagagttgggatgtattcataggtgtctggctttacttacggggaaaaatattaggtccctatctcataccatatacaaataatcaaataattatgttgattaaacctgagtggcctaattcaaataaatgtttctcagacaggcgagttatgttttccgattgtaaaagttacatgggcttaaggtagttaccccccaaaccttccttctgagtatgaatttttatagttagagaagaaatgctgcagagaaatggcttaaacatcaataattgatgttgcattatgcaggtttcttgttttcactttacataactttgtctaacaataagtactgcactctttgccccctattgtggaagcaggtaatttagtcaaccagtcctcttgaccgtgatttgattgcagtgtttgctatgacaaatgggactgcagcaacccccttgcacagaggccttggcgagagctttgaactgggtggtttctgagcagtagaatcctgtgtaacaggatatagacattaggcattttagatgacacagtgaagattactatcccaaagactgaaccagtatccctgctgtgtaggtatttaggcttaagatgactaaatactgtgtagataggtagacttgagatttaaggcgttcttagttgaagccacaggtgcagcctgctgtgagggaggggccaaggttgagggggtctctttccagaatattgacctcctttgcccccttgggaggggacagggctgttggctctgattttgccaaggggtaggtggccacaggaattgggcatagcagtgcctaggattctgctccaatgctgcccctcattctctgagttaccattgaccactccttggggctgccacacccttcaaggggttctcaaagtggatataggggaaggggctgggtgtttgtgatttctgtataaagggcaaaaagtttagactctaaagttactgtcatatcttttcagatctttatggtcctagttttttttttcctgttacttatctaaaaggtaatgacattattttattccagtgcgttgacaaacatctgagtatattttggtgtcatgcacagtctgcagatagccacttgtctggtttttccctgtttggacacattttttttttttttttttgagatggagtttcgctcttgttgcccaggctagagtgcaatggcacgatcccgagtagctgggattacaggcatgtgccaccaccccggctaattttgtatttttagtagagagcggggtttctccatgttggtcaggctggtcttgaactcccgacctcatgtaatccgccctcctcggcctcccaaagtgctgggatcacagacgtgagccactgtgcctggctttttttttttttgagagggagcctgagcctgtactgttgcccaggctggagtgcagtggctcactgcgacgtccacctcccgggttcaagcgattctcctgcctcagcctcctgagtagctgggactataggtgtgtgccaccacgcctagtttattttttgtatggacacactcttctgataattctgcttactatgccaagggcccagcttctactgtaggatgacagtggtacatgtactcatgacctagaggcactgagcaattccccaaacgcattctgaattgtggagggtgatggggtggatacttcttgattggccctgtggtgtggtgctgtggtgggtagccagatggcacatgagaataagtgacttcaggtatcatgactgtgtcatctatgtaggggtccttggtaccaacttcccagtgaattgggtgggttactttatttcacagattataaaactggggtttgagagaaatattgggctttttttttttttttttataacagggtcttgtgctgtcactgggcctagagtgcagtggcatgacgatagctttactgcagcctcaacttccgaggcttaggtgatcattccccatcagcctccgaggaggtgggactacaggcgagtagctaggactacaggggcaggccgacacattcagctaattttaagaaatattttaatagagaagaggttttgctgtgttgcccaggctggcgttgaactcctgagcccaagctcaagccttggcctcctaaagtggtggtattaacaggcatgagccactgcgcccggcagtggttttttttttttttttttttttttttacgctttcctgtaaatctgatgttttctggaatttagggtaagttccttatcagacagagcaaaagcacagtactgggaccttgtgttctgtcatgtgttctgctgccgccgccagtgtggacagcctgagtctggccccctttcctttggatgtgctgtccctgctgcctggatccttcccgctctctacttcacctaggtgtggtgtccctccctgggcttacttactgcattgttttatggtgtcttttttttcttttttttttgagacggagtctcgctctgtcacctaggctggagtgcagtggtgctatctccgctcactgcaagctctgcctcccaggttcacaccattctcctgcctcagcctccggagtagctgggactacaggtgctcaccaccatgcccggctaattttttgtgtttttagtagagacggggtttcatcatgttagccaggatggtctcgagctcctgacctcgtgatctgcccacgtcggcctcccaaagtgctgggattacagacctgagccaccgcgcctggccttttttttttttttttttttttagattcaagaagtacatgtgcttgtttgttgcatgggtttattacttactggtggggattgggcttctggtgtatccattaccgaaagagtgaacgttgtacctgataggtgatttttcaacccttgctccttcccatcctcccgtctttttggggtctcccatgtcttgtcttgtcttgtcttgtcttttttcttttctattttgagatggagtctcccccttgtcgcccaggctggagtacagtggcacgatctcaacctcactgcaacccccgcctcccgggttcaagtgattatcctgcccagcctcctgagtagctgggattacatgcgcccaccaccacgaccggctaatttttttttgtatttttagtagagactggttacaccatgttggtcaggctggtctcgaactcctggcctcaagtgatcaacccgcttcagcctcccaaagtgctgggattacaagcgtgagccaccgcgcctggcctaatttttttatttttagtagagatggggtttcaccatgttggccaggctggtcttgaactcctgacctcgggtggtccacctgcctcagcctcccgaagtgctgggattacaggcttgagccactgcacctggccctagatttctctaacataggctgtggaggtggaatttttatttattttttctttaaatcaatactctccactgaatgtaggattttagtttttaattttttactgcaccccaggggttggggcagataccaaagtgaccccccttcctgcattgtgaggtttaattaatgcaattaacatttacgaagtgctctgaaacagctctgctgctggtatcagcctggaggaagtgagtgacatcagttctcagcattactgctgggttggggcgagtccctgagcctcctctgagtctaattgggggttgccacctacccctctgtctgccacattgcatttgagtacatctgacctggttcagtcggggcacaggcaccctgctgcactaatgaggaaggcccctcggggagaagcttgtgggtgggcccacccagcactgctgcccactctgaatcacacgctggaccccagcctctgggaaagggtcagagttcacctctcatcacaaggttaggcagccacctcctgtgaagggaaacgctcagctggtatatcatgtcccagccacgaagctcccttcatccctgggatgggtgatgcattcattgttcataacttctgtaattcttgtctgtcttgtctcagttacggcaattccaggcacgtgccctggattgcctgggcatgagatttggcactgccacttctctgggtgacttaactcatctgagtctgttgaaggcagggggataataagacctgccccaggatggggtgggggttaaaggaggtggcagacaggctgggtgcagtggctcacgcctgtaatcccaggccaaggcgagtagatcacctgaggtcaggagtttgagaccagcctggccaacatggtgaaaccacgtctcttctaaaaatacaaaaattagccaggcatggtggtgcaagtctgtaatcccagctactcgggaggctgaggcaggagaatcgcttgaacccgggaggtggaggttgcagtgagccgagatcgcgccactgcactccagcccaggtgacagagacttgatcttaaaaaaagaaaaaaaaaaaaaaatccatggtggtagacagtgttcagcctacagtaagtagggccctgggaactgttagctacttaatgttacagtggcagtgtgggatgatgcagttctaaatccagcatgtctgccactctggataggtcatattagataaagcagttggcttgtgatgggggccatgttatctggaaatgccagccttgaatcatgaagtcagtgagatacatagaaaagaggtgggggagatttgtatccactggtacacacctgatgctaatttaatttctcttgtcctgattctaagaacatgtagttaaatttgtatgttatttactttccctatatattgatcaaggaggtagtatgtcagtctctgtcttggtttctccatctgcaaaacaggaataacagtacttaccacatttaaaggttaaatgagttaagataagtaaagccaaaacagtgcctgacacatagtaacactgaaaaaaagatgaccttattggggggatttttatatatttatatatgtgggaagaaaggcctaggagagaagcttttattcctggattttgagctgtgggttttgaggtctgagaaaggaagcaggaggtgtagggagttggggagggcttccaggctgagagaacacagcagcacatgcctcgaggctagattgtcttggcctgcgtgtagactgaagcggggtgggggaggaactgagctgggcatctttagtcatgggtgcaggttctgaagttggtgtgcgctgtctacacagctgtggctataaggcaatgagggtagttaatttcactacaaacgtagggtcgtgataaaaacagaaggaattttaaatgaaatcacattgaattatgcaacgagaagaaagcatatataagtgctcagcttgctcctgggggacacccaggtagctagtgccatttattgtgggttttcttcctggactgtctctccagtacccacaggtcttgttctaggggcttgaggcttttcctgaatgttgagatatgggttttggaaggtgtgctgcccacacgttgggtaggctggtggccagttggcactgctgaggccctgggggaaggcccagggtggttaatcattgtcagcctgggtctgtctaggaggtgagactcctgtctggcttcttgttgacccagttagggcctgtctgaggaatggggttcaatgttgcctgcgaaacccagcacacattagaaccccaggccctggatgaaggcgaaggaggtcacatccttcactccaggcctctggtctgctaccagctcctggccacaaacaaaccctgtgtgtcctccccccagagcactttggggaggtggaccctcctggagacaccaggtacaccaggtagccccacctcccactctatgccaggcccactaggttacttagttcactgatttggcctgaggtgaaacgcttgaaattaatgattattctgaaccgacaccgcagcagctttcctgggattctgactgctttgtctcataggaactggccataggtcagccagcctgttcttccgggtcagggcttgggagaaaaagggctgagaagcagctgattggtctgattcaggcacgtcccttgtccttggtaggggaaattccttaacaggtgctgatacacactctggatcatgtgaagcacagaaagcctatgtgttatgtatcagcgcacatgtttataatctgaacaatgctgctttaacatgcatattaatcacctaggcatgacttgtgtgtgttaaaatgtcttgtgaaaatcccgcttcaggccgggtgtggtggctcacgcctgtaatcccagcactttggtaggctgaggtgggcagatcacgaggacaagacatcgagaccatcctggccaacatggtgaaacctgtctctactaaaaatacaaaaatcagctgggcgtggtggcgcatgcctgtaatcccagctactcaggaggctgaggcaggagaatcgcttgaacctgggaggcagaggttgcggtgagctgagatcgtgccattgcattccagcctggcggaggtcgcaccactgcactgcagcctggcgacagagggagactctgtctcaaaaaaaaaaaaaatgaaaaccctgcttcaggacatctagcttagtggtggagatttctccagccagctcccacttccaacagttcttccaagcagctctcagttcatggtactgtagcctgcgtggctcctgggccacacagggagtagcagcagaggtccagttgccccatgccatgggcaggtgcagggtctggaattgggagctctcaccacagattgcacctctgcctgggggcgccactgggctcatcagactgagctcacggtgccccctggtgggcgatgccagtggcgccagtgcagcttggagcccgcaatacaaggtgtggcttctagaaggtaccctggtttgagatgctgaggtgggaggatcccttgaggccaggagtttgaggccagcctgggcaacatagccagactctgtttctacaaaaaattagccacacctggtggcacacacctgtgggcccagctggaggatcactgaagccctgggagttgaagcctacagggagccgtgatcacgccactgcactccagcctgggtgaccaagtgagaccctgtctctaagatagatggatggatggatggatggatggatggatggatggacagatagaagataaactgcgaggctagcacgggttgtctggcaggggctggtatgtctccacgatggagcccgaggcagggaggcccggtgcatatggcagcagcttattggggaagcttttcccaggcacggttccaggacacaagggtgtggtgtgagtgacctggagctgtttgtggttcagggatgggggcctggaggtctcattatgcctaggcttttataatatttttgccaaccaaaggtggaacaaaaagcaaaggcaagtgacttggaaaactcggtttcagcggggatttatgccctgaagttttttactcgttctctatctaatcctggccctacctcttagatgggctatatgaccttggagaataacctagtctggatgtcagttttctttttctagaaggtgagctccccagtctccctagggggagatacaggttgttgcatccaacaaaatctgtgtgcccataatgttgcaggcaatgggccagcccagaggttatagcctgccaacccatccgtatggccctggccctgtgtgttagctgatttacctgaccaggaggggcagcagtggggaggccaagtcccagaggtgagggtgaggctacaatggatctggggagtccccctcctggtaactgcccccaggctttctgcctgtgcctccatccttccctccttgggaacttgggactctgagccccagctggtgagggaggaggggagtgagcgacaggccagcagaccaatgggccctggaggatggggtgaggcggggcttgtgctgccatggagaggagagaagcggttctgtgggggaggagggggtgggtgggaagaggacctggagattgaggggaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaaagccctgcattgtcctctcagctgtgccatcccatggaacttcctgcgagcgtgaaagggttctatttctgcattgttccccacaatagccacactctacatgggagcacttgagaagcggctgacacagcaggcagtgaattgttcctggaaatgtagttagtggtccctggatgggcagcaccctgctggaaggaatcggagggctccccttggtaacttcagtgttggtttgggtcctgtcacgtgcctggcccagggctctgttgtcttaggaataaaatcagtggagaagatgaacgatactgacggactgagagcaaatccctgtggctgacaatagtgtaggggagatcccaggccacgccacggagaaaagcccctattagcaaggccgttccccagactggtgcctgcccccacaaaacagactcctggctgtttcctctacaggccgaagatcaagctcgcgactctccaagagggaggtgtccagtctgctaagctacacacaggtatggtctctgctctccctttttcagggctcagggactttgtctttggctttcatcacgtgggctgcctgaggcccataaaaactggcatctgcaaatgtatggagggttgccgagctagatgctttctgcatatatttggcattattttttcaatctggacgatcagttacattgctaaatctctaatatggtagtcccctcttatctgtcattttgctttccacgatttcagttgcttgcagtcaactgccgtctgaaagtattaaatggaaaatattaaatggtaaatcccagaaataaacaatttatacattttaaattgagtgccattctggtagcatgatggaatcttgcactgtcctgctccgtcctgcccaggatcagtcctgtctttgtccaacatctctatgcttaggtgctacctgcctgttagtcacttgtagccgtctccgtgatcagatcagttgcagtatcacagtggttgtgttcaagtagtgcttgttttacttaataacggctccaaagtgcaggagtgatgacgctggcaattcagttatgccaaagagaagccatgaagtgtttcctttaagtgaaaaagtgaaagttctcaaaaaggaaagaagaaatcatatgctgaagttgttagatctgtggtaagaacaaatcttccagccgtgaaatcatgaagaaggaaaaataaatgcatgctagttttactgttgcacctcaaactgcaaaagttatggccatgttgtgtgataagtgtgtagttaagatgggaaaggcattaaatttgtaggtggaagacatgaacagaaatatgttctgattgacagcagtgctttgtgccagggagcattgagcctatagcaagggatcccctgacaccaaaccatttacttcaagtaagggatggttacatagattcaagaataggtttctactgaaaactataaaaatgactggagaggctgcatttgccaatgaaaaacctgctgctacattttcagaagagttgaagttgattgagaaaggaaacaatccaaaactaagactgcagtgaaaccagactcctccagaagatgatgtctaatagaacctaccttcataaaagtgcaaaggaggaagacactaggtcataaaccatggaaggacagattaaccctgaatagagtacaagaagatattttgagagagaaaccacattcatatggcttttattaacagtatattgtaattgctctattttattattagttgttaatctgtgcctaatttataaattaaactttatcataggtatgtagatatagacaaaaacagagcacatatagggttccatcttccaaggtgtcaggcagccatggggggtcttgcatgtatcccccctggataaggggagactactgtatagcaaactgtctttttattcctggaatgagtccaacttggttatggtgcattttgaagttgattttattcatgtattcatgaatgaaatgggtatttttttttattcatttatttttgagatgaagtctgttgcccaggctggagtgcaatggcatgatctctgctcactgcaacttactgcctcccaggcccaagcgattcccctgcctcaggctcccgagtagctgggactacaggcaatggaccaccatacccagccaatttttttgtatttttagtagagatggggtttcaccatgttggccaggctggtctcgaactcctggcctcaagtgagccacctgtcccggcctcccaaagtgctgggattacaagtgtgagccaccatacctggcccattttatttctttaaatatatctatggttttgatgttaggattaggtgggctcaaggaattttttttacaagctggaagaaacttgtctaagcttattttaatgaatttcaaacaattatatcttctaagacttgctacattatcaagctttctacttcatttacttttccaaggttggatctttcccatcttgttttgtgttccttcctttactgacaccgtctgtttcctaattattcttagtagagtttgtcaattgggttggttttgctcagagccagtatcagtcataaaagtcctgggcaatgaaaactcaccctcagcttccattctcttggtggtggccaacctacttaggggactcagaaggtggggaacctaagccctgggaggaattagggcagctgcaggatcagaggctcagcactgctgttttgtttctggtagctagttaccagaaacagtaatgaaatctcttgcccacacgtttctttttgtttgtttgttttgttttgagacagagtctccagtctgtcgcccaggctggagtgcaatggcacgatctcggctcactgcaacctccgcctcccaggttcaagtaattttcctgcctcagcctcccaagtagctgggcttacaggcgtgcaccaccatgcccagctaacttttgtatttgtatttgtatttttttttttttttgagatggagtcttactcttgttccccaagctagagtgcggtggcgcgatctcggctcgctgtaacctccacctcccaggtttaagcggtactcctgcctcagcctcctgagtatgagtagctggaattacaggcacatgccaccatgccctgctaatttttgtatttttagtagagacagggtttcgccatattggccaggctggtcttgaactcctgacctcaggtgatccacccgcgtcggcctcccaaagtgttgggattacacgcctggcctaatttttgtattcttagtagagatggggtttcaccatcttggccaggctggtctggtgacctcaggtgacctcagtctgccccagactcccaaagtgttgggattacaggtatgagccaccacaccctgcatattatttgattcttgatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgtgccatttctttcaggtggtttttaagttctttcttgtaacactcttggaggtgcctaggggtgatagagtttgcagggtggatggctcagctgctaatgacctagggagtccaccatttctgtgggtggattttgtgcctcagagttttgaggtatggcaatgggaaggcagttattgcttatggtcacccagccctttagagaccagactgacagttactatcccaggtgtgggttacagtcttcccttcccaggatatggtctgtatcatcccctttgtggagatgagagaagattccagcaacttaactgaggttaaacatcaactcttctatgcataatttggacacaggttctgcaacaaccaaattcatgccatttttgacaatgaacatggagcctaaggaattctattccatcttgatgatctggtgccttcctgaacccagtaattggccttatgcttctttgacataaaagtttattttagagtgaacacgaatttttctttctttctttctttctttttttttctttttttttgagatgcagtctcactgtgttgcccaggctggagtgcagtgacgtgatctcagcacactgcaacctctgcctccctggtccaagtgattctcctgcctcagcctcctgagtagctgtgactacaggcacccaccaccatgcctggctaatttttgcatttttagtagagatggggtttcaccattttatccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttgggtaggtaaaggaaaattacagtcaaagggggtttgttctctggcgggcaggagtgggggtctcaaggtgctcagtgggggagttttttgagccacgaggagccaggaaaagggatttcacaaggtaatgtcatcacttaaggcaaggaccggccatttatacttcttttatggtggaatgtcatcagttaaggtggggcagggcatattcacttcttttgtgattcttcagttacttcaggccatctgggcttaaacgtgcaagtcacaggggatgcgtgcaagtcacaggggatgcgatggcttggcttgggctcagaggcctgacaatacatattgtgattctgttcatcagagtgcacatactgtatatattgtacgtatgatacctttgtagacttgcttttttcttctattaagaactagagttgcctgaggttcatgtctggataataaatccagtggtctgggtcatagcttaattaaccgattcaggttgtttatgcttattcaagcattgctgcacgaagactccttacacatgtatgtatttatgtgttgttaggatcccttttttctatgtccattattacattttactttgtatagaagggatctcactatggtgcccaggctagtctcaaactcctggcctcaagcgatcctcctatctcagcctcctgagtagctaggactacaggcgtgcaccaccaagcccagctactttataaattcttttgtggaaatggagtcttgctgtgttgcccgggctggtatccaactcctggcctcaagcgatccccctgcctcggtctcccaaagtactgagaattacaggcatgaaccacggtgtctggctacatcttgcattttatggcaagctttttgttgccctcagggacagtggagtggacaggacttggcccaggatggcctctcctcactgggatttcttcatgtgggttttcttccaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtgagtccggggaagggcaaggggttctgcaggcctgaggctgtgcctgcctgcctccctttgaagacaaaggcctgggattgtattctgcagatgtgtgagcctatgccttcacactgtctgggaggaaggacaaaacttcctgtgttaaccagctacagcagattccactcacacgggggacaaaagtgctagaaagttctggatccatgggcagttggattttatgttatttcttagatttatcttttgggggcagaatcatcagtgtggactctgaggggccaggagtggccacgtgagcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagctggggaagagctgtgttgggcataactaggctgttttgattcttacactctttcaacaaagatttttttgggggcggtgagaatggagtctcactctgttgcccagactggagtgcagtggtgcgatcttggctcactgcaacctccgcctcccaggttcaaacaattctcctgcctcagcctcctgagtggctggggttacaggcacctgccaccgcaccctgctaatatttgcatttttagtacagactgggtttcaccatgttggccaggctggtctccaactcctgacctcagatgatccacccgcctcggcctcccagtgctgggattacaggcgggagccaccacgcctggcctcaacaaagattttaatcagacagacctatcctgtgatggtctcttagaagtaaatgttagtcctaccctcagagccctgagagaggctaagttaggtgcctaaggtcattgggcaagttgcagcagaagcaagccaggcaggattgaaggaaggactgtacattcctgggattcagctcaagcagagattctgtttttcccaggaattgagctaccatggggccatttgccatgagctaattgaagtttcccaagggctacaataatatattgggtgtggagtctcctttgtaggagagcccctgcatgcagttgcctgctgtgaccagcagagggaggacaagtcctgggcccatgctggcagtgaggcagctgcttccagggatgggagagcagtaactcaagtgaaggaagatggattgtttgcaattgctttgccccatcgagacataaaatgcactttgcaagatagagtctgaggctaatacaatgcagtgtggggctgtcagcattaggggatgagatgacaatatgggacctgggtctggcctgggcaagtgcctgctcagcatgtgtacgctgtttgggttgtattggagctattgggcgctggaaccagcacttgtgttggagcggtttccccccaccagagccacagtgttttctccccagtggtggtcacacccccatataggaaatcaggcattccgtgataaaatggaggtttgcatgagtgtgagcactctttacggagactagaacattccctgtgtctttcagttcctttttttttttaagagatgaggtcctcactgtcacccaggctggagtgcagtggcactgtcttggctcactgcagcctcaatcacctgggctcaagcaatccttctgccttaacagagcagctgagactgcaggtgcacaccactgtgtttggctcttaaaagtttttgtagagatggggtcttgctgtgttgtccaggctagtcgaactcctgggctcaagcgatcctctcaactcccactcccaaagtgctgggaatataggcctgagccactacgtctggcctttcagttctgattagcatccctgaatggccattttctctctcactggcaactcagtcagttcatgcttggtccagggacttggtacatcaggagacttgtggaatatggattaaatcacaagaactaaagttaaataatcacaacaagtgaaaggtgctgtgtcgagcactgttttctaaacacattcattaggtgaactcattttaataaaagggtaaagagtaaacaattatcatgcttaggaaagaaggaatatgtgcaaaccctcaatgctggagcagccacagagaatattaggactgagcctcaggggtccacaccagggacacctgcttggaaaatgtatacaaacacagggttcgcctaattgccttcattcagagtatcctccttttccacagtggaagtgtcgtacctaacaaggttctggatatctgtgtgttgagactctgccatttctatttttctgcttttttctttccttcctttcaaatagatgtctgtggactttatccccaggaatggtctcttggttaaagtgtgtgaaaatcttctgcatctgatggacaacattgtgatagacatggcacctgggacacacctgtaggtggatgttgatgatgtctttctcttttaggtctctgcagacaaactggtggcactggggctgttcagccagcactttaatttggccaccttcaataagctcgtctcctatcgaaaagccatgtaccatgctctggaggtaacatgggatgagggaatgagggctaagccctgagagcagggatgaagcaagagacccacagaaacctagctcagtgttgccaagggtggtttggaggggacagggtggccagggaggaggtaaatgacaacataacatgatggccaccggattgggcctcccaacaaagggatttgagacatcccagctgccacttattgggaccactaactgaatcagaaggaaagagcacgggcagttaggggtgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacaggatgtaaccctgtttctaagagaaatacaaaattagctgggtgaggtggtgtgtgcctgtggaggctgaggtgggaggatcacctgagcccaggaagtcaggctgcagtttgctaagatcatgccactgcactccagcctgggtgacacactgagaacctgtctcaaaaaaaaaaaaaaaaaaaaaaaccaaaacagaaacaaaaaagaaagaaaaaaacgaggccaggtgcagtggctcatgcctgtaatcccagcactttgggaggctgaggcaggcagatcccttgtggtcgggagttcaccagcctggccagcatgatgaaaccccgtctctactaaaatacaaaaattagccaggtgtggtgctgcatgcctgtaacaggctgaggcaggagaatttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgccaacaacaagagcagcctggaaggtaacgttctctccctcccagtcatccccctcacaccctggctagggctctaggcctgccttgtcctggctcatccaccctgtcagggtttaacccagagctctgttccttaacctcaggccaaggcctatttctggaccctgcatcttagttgctagtttatggaatgagttgccaattgtgccccttaagagaaaggtacaggaagggtatggtgaggaacaagggaagctgggccattttggccgggagagccataacctaaaaccaagattactggtatcatgaaccttcccaaagaagaactgcaactaacaagcttttagtcacttgcctactgtcaggctaaatactctgcttgccctggctggggattgccactggattggatactctgatcagaatatacctcatggaatacagaatgtgtgaggatgaagtctcccttgcttccttaacccctagttactcaatgttgaataggaaaacaccacatccctgacccagagaacccggggaagagcttcggtttagaaatcctattccccaagactcactcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacgttcctgcagtctgcagacagctgtctgttgaatggaatcctaggcatgggaatagggagctaatttgccctggaagcagcacacagggtttatattttgtggtggctgtggttgtagcataattggagtagaactcatgtatagggaacggctcttttttttgagacagggtctccctgtgttgcccagggtgtacagtgacatgatcataggtcactgcagcctccaattcctgtgctcaagcaatcctcccacctcagcctcctgaacagcttgattataggcacatgccatcacacccagctagttattcttttttttttttgaggtggagtcttgctctgtcacccaggctggaatgcagtggcacaatcttggctcactgcaacctctgcctccagggtacaagcaattctcgtgcctcagcctcccaagtagctggaattataagtgcggagcaccacgcccagataatttttgtgtttttagtacagacagggtttcaccatgttgaccaggcttgtctcgaactcctgacctcaggtgatccacctgccccagcctctcaaatcccagcactcccaaagttctgggattacagtcatgatccaccgtgcctggcctattttttgtaataaataaaaagtgtaataaacgctgcctcggctggtctcaaatccctggggtcaagccattctcctacctcagcctcccaaagccccagagttgtaggtgtgagccaccacacccagctagaagtgctcttaataggccaagagcatgagggaaggggatgagtagggtgtcagggaaggctaattccctggtttgccagttggcctgtaatccaaagtgtccatggaatgaagtaggttgtcgggagagcatttctgatcagagagcctgtgggattaagggggttggggcatccaaggaagacgtcagggaagcccgtactgcacagggccccgcaggctatgctgttaagcagccgatcctaggtaagctttcaggagggggttggcatttccctgtggaagtggtaagggggtggcacaggagaccagctctgacaaaggcatcccttctccctgccactgggtccaggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgtaagccacaggctcccgcctctaccaccacagatcccaggggcacagggtgttggaaagctctggaattctcagaaagagtaatagaagtaaagacacgttgtacctcttggagcctcaatggctgagagacctggcgaattgccagctcctctgcacggttttcagccgtgccagggttcattcactccctccttgccggcttctcagcgtatggattttcaggggcctgatgaagaaatggttgtatgtagccttctgagttagcagagctgagagggaaggaaacagtagaaatgaattttctagttcttagagggaagccctaggtcattcctgtctggggtgataccttttcatgtgtgcctctgtgcatacatatctggctcatgtccaaggataaattgaccattccttgccaaatgcaggctcgtgtggtacacacttgtctccccaatccccatcaagccttcagtgggctttttgcagtggctacggcaaggtttgaagccctctgagcagggtcagcctgcccctccctcagagcttgagtctttgccctgtgccttcaccaccatgacctccttccttacctggcaggaagcccccaagctgtaccctgccattcccgcagcccgaaggcggcccattcgagtcctgtcattgtttgatggcatcgcgacaggtgagttcggggaacacctggagacactgctatcgtgtcacaacagggtagccagggagtcagaaggcatggttaaggtgtctgacatcagtggcaagaaaggtccctggggattaccagccctgaaaaaaaccctgtctccttgtttctctccaccttctcaaccaccttgcagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagtacagtggcattattacagctcactggagcctcaaacagctgggctcaggcaatcctcctacctcagcctcccaaatggctgggactacaggggcacaccaccgtgcccagccaatttttgtatttttggtagagacagggtcttggtatgttgcacaccctagtcttgaactcctgggctcaagcaatccgcccacctcccaacgtgttgggattggagatagagatgtgagccaccatcccctgccagtacaaggaaaataattgatctctaatctcagcccaactctttgaagtcagaaatgatgaaacaaaccatcatctgctgttaaggactcatgagatttgactcaattttttactctagagagttttctcatttttgatatgaaaactgctttagaccaggcacagtggctcatgtctgcagtcctagcattttgggaggctgaggttggaggatcacttgagcccacggtgtatcatattttgtaataatctggcgtatcccaggggataccgtctcagaatctgcaggtttgaccttatctctttagctaccattagcatagtatgagggcatttaccatgtcctctagccagcctcctgatggcagtaggtctttcctgttttggaggatccgtgcctcatccatagtcagggaatagccctgtcacctgcaaaggtctggttgacactgaaactctaataataggctcctaacagtaaccttctttctccccacagtgtaatccagtgatgattgatgccatcaaagtttctgctgctcacagggcccgatacttctggggcaacctacccgggatgaacaggtaacaaagggctcttagtgggtcaggtaacagccaagttaaatatgtgataacaagctctgacattcaagccttcctagaaagacctggctctgctgagaaatagttatacttggatttcagaccacctgtggtcgtgcgggttgatctctgttaagatgttcagcaagtacctgggaatctctgtaggagtcccactcttacctgttgtaagctgctgatggacctgatcctaaaagtcccacgtggctgggtgtggtggctcacgcctgtaatcccagcactttgggaggccgaggctggaggatcgcttgagcccaggagttctagactagcctgggcaacaaagtgagaccccgtctctacaaaaaaataaagaaaaatacaagtctcatgagctgtggccagactgtgtacctccttcctgccagggatctctcaagacttgagcttgttgatgctcctgcccttcacctctcctccccgttgatgtagtgacagccgtctggaaatggaagtagattgttgttaccggtgcctttcctcctgccctggagatgaagcgatcttggccaggctcatggtgaccaaccaggtggcagagctgctatgacaaacaatagcccaaagactatgtccctcagattctcatcaccaggagcatttcatattttgttatcgtatactaaaaacagtcttcttcagacactctgaaagccacaaagcagctttgctgaggattaattatttcttctatatgtggtttcaaggagaagaacttgctaattaagatgtaaaatgttatggtaatgtgacatcccagacttgcaaatgagttgagcttaaaacattctcctgtagaaggaggcatggaaacataataaccttctgccacttagtgaagtgtggacagaggtgagggtcctggggtagcttggaggatttttgttggtcaccttgcccgtgtacttggctaagcagccagtcttagggtgccatgtctgtgtctggaattaaatgggttaatgctttcaacatttgaactcccagtaggccaggcactgttacgctgttgccattttcatggttaaacacatcatgtcgatagtgacatgccgaagggggagggagagaagacaatgatttggggtttattgctggcggatggacattggaagggttgatggggaaggcttctcattctagcgaaggtcctaagtgaagggatggacccatgcagttattagagtactccaggtgggaagagggtctgggatgatgggaaacatccccagaccagctcagagcaccctaggtggggtggctgggagagaaggaccaagtaacttgggccttaatgtggtaccgctgaaatcactttggcatgggaagttacagatgagatgaattgtgctttggttcatggtagtttctgggtggattatagacaataacaggatggaggcgggaatggggagacaagtgaagggactagactgctcaaagaaggagagatgactgattatgatgttatgccccaggaggtgccatccatagagaacacagtgtgagtggtggcccctggggtttgcagcacagcaatcctgtgacttagcaaggacggatcagattcaacatatgtggagggtaggacatttgctgatgcattggatgtgtaggctatgaggtggaaagagcagtgagacctgatgcagatctgatgctgtgactaagctctgcaggcttataggatgggtgtgtcaggcatcatttaggggacagacccaagtcatctggcttgtttagagcttaatcttatagtcagcacaaggcggggctgtgcagtgtccttttcttctgggccctcagctcccctgggtccatgtcggaggtaggaatggggatagaggtagcatttgaagcctggcaggtgaggtcaaggaaatctatcagtctaggggaaatatgtgttgtgatttcctcagcccctcttgtaggcacggttcccgttctcatgtctgagttgtttggccttgacgttcctaacacaggttactatggccgtccctgcgtccagtcctcttgcaccagtttctgttctggagctgctcaactactttcagttctagcccttgcccttcttagtcatctgtttgcctctctctgcatttgcaaaataattttcaagggtgaaagttaaaagggtgcttagtctttttttttttttttttttttggaaccttaagagacagggtctgtctcccaggctggagtgcagtgttgtaatcataactcactgtagcctccaactcctaggcttaagcgatcctcctgctttgaactcccaaattgctgggattaagggtaggaaccactgcaggcggttgccattcacttttaaagcctcctgaggctgtatccccagcagtgagccaccaaaccgtgggtgtgatatgataattgtatcaggtagacccacaaaaatctattccaagctcctcactttaaaatagacaggaagcccaaaggggtagtgtgactcgctcaagctcagtcagtgagcagtgtggagctgggacctgaggtttctcctgccctaccccatgcagtgttcctgctcaatgggaacctgactttgaagtccaggcaggggagcattacctcctggatgctgggctgtcccctctagcccatccttggctttggcacacaggcttgtgctcatgccaggatcattttcatcatttatttgtagccaagttcactgccagggcacatctctgcaacatagaccctcactcccaccttgtgcctagcagaggaccctctatagctagtaagaagtaatgggttttggctgttcccaggcccgtgatagcatcaaagaatgataaactcgagctgcaggactgcttggaatacaataggatagccaaggtaagacgagctgtggccctctggaaaaatgcacttggtgacctccaagtggggacttgggagatgaccttggtgtttgattggttcctactcctccccccacgtgacttcctggtgttgggcttccctctcccacatgattgttctgtcccatcctcaaatacagagactaggagacattcgtgataagtaatcacgacgagaaaaggcaactagtctttttaattttagtactggatacataaagacaaagagtttcagctggccctctcagggagaaaggaatcattaatccttttgccaaaaaattaatttgctgtcaagtcatagaatatgaagacctccataaacctaaatctcaatgtttgcatcaagctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcattttgcttatactattttttaaaaatcattatttgctatagtgattatggctttgaacattcctctttacatgtattctgtattctgaaggctttgatatagagtattttcattccagatatttcacttctataactcatttaatttcttctttgacttaccaacagttttctgagtataaaagtaacttctgattagtatttatgctgtagattattctgtatggacctaaacctaaaatggttggtgcagatggctgacattgtgtagacgctaagaccaagcaagacacaggcctgaggtatcacatctttggcatgtttctgaataacccacgcagccattggcctgttgggatgacttttagtattggattgtatacctgagtaacactgaggctcagcctctgtagcctctttccaggcctggtagaatcctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctataactgtctgatgtcccttttcttctgcaggtcagatggatgggacatgggggagggcctggctaacatgtcagggtgggagtttggaagtaggtgattcattcattcatgtattcaaacgcaatgtgaccccaagctgactggagcttacttacagtgtaatacactggttctgcaccattggctcacgcctgtaatcctagccagggtgggcggatcttttcagtccaggagttcgaaaccagccttgccaacatggcaaaaccccgtccgtacaaaaaaaaaaccaataatccaggctgggcacggtggctcatgcctgtaatctaagcactttgggaggccaaggcgggcagatcacaaggtcaggagatcgagaccattctggctaaccctggaaaccctgtctctactaaaaatacaaattagccaggtgtggtagtcccagctactctcaggaggctgaggcagaagaatgtcgtgaacccaggaggcggagcttgcagtgaacctagaccgtgccactgcactccagcctgggcaacagagcaagactccgtctccagaaaaaaaaaaaaaaagaatccagcacatctgcttcccttggagggcttgtcagggctgtggttgctggcccaacctccagagtttctgactccaagtggaccctaggaattttcagtcacacggtggcacaattactgctcattgcagcctggacttcccggactcaagtgatcctcctctgtcagcctccaagtagctggtaccacaggcatgcaccaccacacccagcctgaccctaggaatttgatgccactatccagggaacacaccggactagtgaatgggtatctaactcatggttcccaaatatggcttgagtgtctgaattcatttaaaagctccatgtgtgggacacctgtttccagacatacagatattggggaactgatcaaggtgataatcacctctagcaaaagatcctaatgatgattctcacagtttgtcgcgcttcggtgggattctataccttattccacagctcccaagttgatgtgttgcaggtcaaccaccttccgtgagggggctaattgggagtggccctgtggtcccagcctagcccgtgtcctctaccctttggagtgtgattctcagcatgcccccaactaaaatcctggccttcaatgagcactcacgatgtcggttgcccttctaagcctaatattgcaacaccagtaatcccattttactttacatggggttccccaggcagaagtcccaaggccagagcccatcgggccacactcatctccagcctttggtcagggaaaaaggttaatgctggttagctagcgcatttagagagggaatagggtggtgcacttggggttcacccactgaacaccagtcagaccgagcacctctgagcctcccaggccatgtgtgagttgggctataatcatggccatctcttaaataaggtcaggtttctaaagggcctggcccagggtttggggagggaagaagcttccagagtggaaggatgaacatgttattagaaaggtgcttcaggactagaacagcccacgtgcaggttgccatggtgagataactggcaattagcaagctagccccacacaacctcccctgcctccccgggtattgagaccccagggacctgggccacccaattaagccatcttgtgtacaatgctgcaccaaataccaggacaggatgaagccagctaaacagccctggcctcgaaaccctaagacagacgggcaagccctccagatgaggggtccttggcgtcctggcctgcttgttggagttgggggactcagagggagtatgggggtaattcttgtgttttctcaagatgaggttaggctggtatctgagtgatcccaggtgttgaggcagggggagaatgcagtgagtgttctgatctggggaaagaggttggagtttgaatcctatgtgggcctttgctgaagcagtctttgggtttgcttggatttgtgtctggggtctggcatgtttctgtgtcacttggagcaagcagatgacttaacctcttggggtttttcatctctcacctaaaaggtggagataccagcccggtcaacatggtgaaaccccatctcgaccaaaaaagacaaaaattagctgggcgtggtggcatgcacctgtcatcccagctactgggtgtggctgaggtgggagaatggcttgaacccgggaaatggaggttgtcgctgtgagctgagatcgcaccactgcactccagcttgggcgacagagtgagactctgtctcaacaacaaaaaaaagtgataaaatggaaataataaatcctacctacttcatagggttactgaagttcaaaggccagatctaggtaaagtgctttgcctgacacctggcaggcaataaacttcacatatatgagatggcattattgtaaaaatgagacctattaatcaatgcagtgctaatgacaatgaagactggatgcacgtagtgatagtaacacacaatgtttatcaataataatagccataggccaggcacgctggcacacaccttgcaatcccagcactttgggaggctgaagtaggcagatcacttgagttcaggatttgagaccagcctgggcagcacggagagggtttcacacccccctctacaaaaaaattttaaaattagccaggtatggtggcacgcccctgtagtccagctactcgggaggctgaagtgagaggaccacttgacctcaggaggtggaggttgcagtgagccgagattgcgccactgcattccagcctgggcaacagtgagaccctgcctcatacaataatagtaatactttttaaaaggcagggtaatatttccccagatgttgtcagcagctaggctgactggtgtcaactgtagcaacagtggcatcgggtgtggaacttgtgcccctcaccaccccccacatcctgtagagatcccaatgctccttgcgagggttcccatcctgtctccacttccctgctaatttgtgaccttgggcgtgcttgggccttgtttacccaactataaaatagggataatatcaacatcacagagctgatgcgcggatcaaacaattcagtatatgtgaggcacatgggatggggactgaatgctgagtaaatgacagtgacaaatgacccaaaaatgcttttttattactgttagagaattctggcaaccctgtgaggcctgattaccatgattataagtaagagaactgactccaaggaggtctcatcacatacccaaggtcacccagctagcagcaaaaggagttgtgcattggaatctgctctgggaagccagtctactttttctccttggtctcacctgcatctttgttcttgtttgttgttttgctggagcttgaaattacctgctgccctttgtagcattttgccctccttcctagcttccttcccttccttttatcctgcctacttctcccctttctttctttcctttttgtgtaactttattggttttttttttgagacggagtatcgcttgtcgcccaggctggagtgcagtgacgtgatgtcggctcactgcaagctctgcctcctgggttcatgccattctcctgcctcagcctcctgagtagctggaactataggcgcccgccaccacgcccggctaatttttttttattttttagtggagacggagtttcaccgtgttagccaggatggtctcgatctcctgacctcgtgatctgcccgccttggcctcccaaagtgctgggattacaggcgtgagccaccgtgcctggccactgatccaccgcgcccggccacgtaactttattgatttttaaaaactttaaattatgccaggcacggtggctcacacctgtaatcccagcactttgggaggcaaggcgggcggatcacgaggtcaggagatcgagaccatcctggctaacacggtgaaaccccgtctctactaaaaatacaaaaaattagctgggtgtggtggcgggcgcctgtagtcccagctactggggaggccgaggcaggagaatggcatgaacctgggaggcggagcttgcagtgagccgagatcatgccactgcactccagcctgggtgacagagcgagactccatctcaaaaaaaaaaaaacaaaaaccccacaacttttaactaaaaaatacgcaggccaagtgtggtggcacacgcctgtagtcctggctacttgggaggctgaggtgggaggattacttgagcttatgagtttgaggctgcagtgagctgtgttcctgccattgactccagcctgggtgacagagcaagactctgtctctaaaaaaattactaaaaattggtaattttggacttacagaaaacttgcaagaatagtagaaagaattcctaaatactcataacccaaattccccagatattaacatattgtcacatttcctttgtcatcttctctatatattaataacatttttctgatctcggctcactgcaacctctgcctcctgggttcaagcgattctcttgccgcagcctcccaattagctgggattacaggtgactgccaccgtgcctgactaatttttctatttttattagagacggagtttctccatgttagccaggctggtctggaactcctgacctcaggtgatttgcccgcctcagcctcccaaagtgctgggattacaggcgtgagccaccatgcccggctaatttttttgtattttttagtagaaacggggtgtctccatgttggtcaggctggtctcgaactcccgacctcaggtgatccgcccacctcagcctcccaaagtgctaggattacaggcgtgagccatcatgtccggcctgtttttatttttaaggctcccaattaattgtgaaatatgcaaacagaacagtgcataaagcctggtgctttaggctttgtaacctatctttgttctctaagctttggttcatcccaaggtctgagcattgctgaaagaaaacagaggttggcgttactggagttggtaactgctcattctgagtctttgcacatgctgttctccacctgtaacagccttctcccctttccaggctggtcctccagttcttgcctcttccaggaaaatttctttgcacctattctgagcagaattaggagcccttctccaatctgaatcctccttccctatgtatagatagaagaatcgggctgggtgcaatggcttatgtctgtaatcccagcactttgggaggctgaggtgggcagatcacctgaggtcaggagtacaagaccagcctggccaacatgatgaaaacttgtctctactaaaaatacaaaattagccgggtgtggtggcacatgcctgtgatcccagctacttgggaggctgaggcaagagaatcgcttgaacctggaaggcagaggttgcagtgagcctggatggcgccattgcactccagcctgggcaacaggagtgatactccatctcaaaaaaaaaaaaagaagaagaattggctgggcgctgtggctcacacctgtaatcccagcactttgggacgctgaggtgggcagatcatttgaagtcaggagtttgagactagcctagccaacaggctactacctgtctctactgaaaatacaaaaattagccgggtgtggtggtgcaggcctgtaatcccagctacttgggaggctgaagcgggagaattgcttgaactcaggaagcggaggttgcagtgagcagagatcacaccactgcactccagcctggttgacagagcgaaacaccgtctcaaaaacaaaacaaaacacaagaagaatctatctcaccacaaagcactatgtattataatttctgattttttttttttttttttttttttaggcagcgtcttgctctgttgcctaggcttgaatgcagtgtggtgatcacaggctcactgcagcctcgacctcccaggatccattgatcctcccacctgagcctccagagtagctgggacttcaggtgcatgccaccacgcttggctgattttaaaatttttttgtggagtttgaatcttgccatgctgtctctccttggcctcccaaagtgctgggattacaggcatgagccaccacatctggcctataacttcttatttttgtagtcttctcctccatgagtttgtgagattctcaaagcagcttgatctcccaacatcattatttagttcaataaagttgtcatacatttgtaaaactcaggccttgaagtacaattattttgtttgttttgtttttggacaggagagtcataatttctatctgtgataatgagattgcttcacatattaaaacagttgctttaagatacatattacatctccggagccatttctcttacaggatggagattcttttttctttttaccctctggccttttgctgtcaaggcttaatctgacccagataaccttggccagctttttcctcagtgagaagagtggatgctagcaggttacctggcccaatgtcagttttttgggagctgtcttgggagggtagatgagttgtactttagagggccttgctcctctaaaatagagttatctcctgtaacttcctgtgtctccagaattaggtccaaactttctaggctggctttttttttttccccacctggagacagaatctcactctgtcgcccaggctggagtgccgtggtgtgatctcagctcactgcaacctctgcctccctggttcaagcgattctcctgccttagcctcctgagtagctgggattacagacgcatgccaccatgccctgctaatttttgtatttttagtagagatggggtttcaccatattggccaggctggtctcgaactcctgacctcaagtgatccgcccaccttggcctcccaaagtgctgggattacagagccatcatgccactgcacccggcctagaggcttttcctgatttggttttctacactgatctcatcccccatactaatgtcctcactccagaccaaaatggcctgcaggtaatgctgataccaattaattgacataatttaataactgactttagacgaaaggactcagaaatcacatttattgagcacatactatgtgctaggcgcagtctgataactttatacacttcccatttaattctaacagaatttgaacccagacatactggcttcgccgtttattatttagcctaatgaaaagttaatgtctttgtggataaaacagaggtggctgggtgtggtggctcacgcttgtaatcccagcactttaggaggccaaggtgggcggatcacgaggtcaggagtttgagaccagcctggccaatatggtgaaaccctgtctctactaaaaatacaaaaattagccgggcatggtggtgtgtgcctggaatcccatctactcaggaggctgaggcaggagaatggcttgaacccaggaggcggaggttgcagtgagccgagatcacacaattccactccagcctgggcgacagagtgtctctgtttcttcgttttttaaaaagaatataaataaataaaatacaggtaacagatgttgcatcaaagcacttataaatatctttagttgattatctatgcttgacatcagctcaccataatgttcatattactgctgtcgctataatcatttgttacatggttttttattctttattgttgcctctttttttttctttttcttttcttttttttttttttttgagttggagtcttgctcttttgcccaggctggagtgcaatggtgccatctcggctcattgcaacgtccacctcctgggttcaagcaattctcctgcctgagcctctcgagtagttgggattataggtgtccgccaccatgcccagctaatttttgtatttttagtagagacggggtttcaccatgttggccaggctgttctccaactcctgacctcgtgatttgccgacctcagccttccgaagtgctggaattacaggcacgagccaccgcgcctggcttttcttgcctttttttgctcaaactctgttttttttttttctttgagacagagtcttgctctatcacccaggcgggagtgcagtggcacgatctcagctcactgcaacctccacctcctgggttcaaccaattctcctgctccatcctcccaagtagctgggattacaggcgcgcgccaccacgcccaactaatttttgcatttttagtagagacggggtttcaccacgttggtcaggctagtctcagactcttgacctcgtgatccgcccacctcggcctcccaaagtgctgggattacaggcatgagccaccacaactggccttgctcaaactcttttgccaaggtaactcctcatctttcatggtaagtgtcatttctgggaagcttttccacactacctaggagaggtcatgtctcttgtggtgtgctcttggagcagtactcgagaccgaagtattgaaatgcctctagacctgctgataaacagctcctgccccagcttccccacccattcttccctgaacgtcttactgggtttcagcaactaactgggtgagatttggcctagagggacctctaggcccctgctccacacagtggaagtaccatcagcccaccacataatgtccctgcctagcattgagcctgatttgtaatttaacaaggatttgtgtcattagttgtgtcccctttgcctcccctgccagtctggaaactttaagaggtcagaagctgtgtctagttttcgtttttatctcttagagatggagtttcactctgtttcccaggcctggagtgcagtggcgtgatctttgctcactgcagcctcgaactcctgggctcaagcgatcctcctgccccagccttcccagtagctggaactaaaggcacgtaccaccatgatcagattgtgtctttttttcaccagggcctgattggtcagggaaaatatttgttgaatacttgaataaatgatacccagacaaaaaaagtcagcttgaaatctggatctacctctgacactgagtgagtcaattggcctctttgtccctcagtttctttctgctgtaaagtggtgcagttcctctttttttcttttttagacgaagtctgactgcaacctctgcctcccaggttcaagtgattctcctgcctcagcctcccaagtagctgggattacaggcgcccaccaccatgcccggctaagttttgcatttttagtagagatggggtttcgccatgttggacaggctggtttccaactcctgacctcaggtaattcatccgccttggcctcccaaagtgttgggattacaggtgtgagccaccacgcccagcccagttcctccttcagccaaggctctcttgagaatgtaagggccaggtgtggtggctcacgcctgtaatcccagcactttgggaggccgatgcgggtggatctctcgagcccaggagaccagcccagcctgggcaacatggcaagaccccatctcttaaaaaaaaaaaaaaaaaaaagagggagtgggcaagagagaatgtatgtacagccattgggaaacaacccggaacaggactcaggaggtccttgctcctgtggactttacaggagacagacagtaaaggcacaagatgccttcttatggtactaagaagaaaatatgccgcatgatattgcagatgggggggcgggggcgtcacagaacgtgactttttttttttttttttgagacagagtcttgctctgtcgcccagactggagtgcagtggtgcagtctcgcctcactgccacctccgtctcctgggttcaagtgattctcctgcctcagcttcccaagtagctggaattacaggcgcccaccaccacgccaggctaatttttgtatttttagtagagatggggtttcactatgttggccaggctggtctcaaactcctgacctcaggtgatcctcccacctgggcctcccaaagtgctgggattaaaggcgtgagccactgcacccggcccagaaagttgacttctaagcgtttccccaaagtgtctattaggtatctttatgattcaataacccattcttacagaaattaattgtaagcctgggagcggtggctcacgcctgttatcccagcgctttgggaggctaaggcgggaggatcgcttgaggccaagagttcgagaccaccctgggcaacacagcgagacctccatacatctctaagcaaaaaaaaaaaaaaattcattgtaaaagcaattttctttttggttactgccatagggattttgtaactgagtcacaccgggccgaggcgggacctcattggctgcgaccgaccacgtgccgcagtcgccccggcggtcggggccccgcccctcggctaccgttctgtggatcaggggccgagctccgcccccggcgcgcggctgagaccctctctataaaaggagccggcggaggatggcgagcctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccggtgagccggctagcgggcccggggggtgcggctgggggggcggccgcgtgggccaaggccgggcgtgcgcgggcaggccctacgggcagcgccagggccgttccacacggcggtgctgttcgagccgggtgggggaagggcggggccgtcacccggcgcgcgcgggctgggcctgggggcgcgcgctgcgctctgctcagggggcggggtctcgggccggaagtgggctgctgctacgcggggtgggggtttctgggccgccgctgaggtgtggtccctgcgctgcagcgactggaggtcccagggtggttgggccctgggagggtgtgggcgaggtgggccgtcctgggagctctggggacgcacattgtgggaggccgtgttgcctgagggccgagagatcgggtggtggagtcagacctgggttgggttccgtgcggtgtgaccttggacaggtgctttaaccgctgtggatctcagcttcctcatctgtaaaacggggacagtaatactacccacattaaactcttagcgcgatgtatggcagaaagtaagccagctcttggactccctcctttcttcagtgtgtgtttattgaatgcccactaggtgttgggcaccgtgctaaaccctggctgttttcccgggaacaaagatttgctctccaggaatccacattatgatgagcaggaggacagtataacgggatggtatcaacagtgctagttcagtccctacttcacagttgccctcggatgctgcagggcagagcttgacctctgccccattttggggatgaggatcctggggcccattgagggaggttatgctaggccgggcatccgcttctccgatggcatgtctctaacagtagtaatgataatagcagctctttgttagttgggcacttgttttgtgtcaagcactgttaagtgctccatgtggctttgtgtcttttaatactaacactgtctttaagagagattctcttcttccttttttttttttttttgagacagagttttattctgttgcccaggcgtgcagtggcaccatcgctcactgcaacctccgcctcccgggttcaagcgattctcgtgcctcagcctcccgagtagtcgggattacaggcgcgcgccaccaagcccggctaattgttgtattttttagtagagacgaggtttcgccatgttggccaggctgttgtcgaactcctgacctcaagtgatctgtccgcctcggcctccaaagtgttgggattacaggtgtgagccaccgcgcctggcaagagagattactttcattttacaaataaggggtctgagactctgagaggcggagtgtcttatgcagcccagcaagtggctgaacccccacctgggacttcagtgtctaggctcttaacctctttattacactttctccctgaggtccagagctacacatccagatgtgccctttgtggtggtgcgtcaaagtgcctagcacagtttttggcacagagggaagcttaggacgtgatgtgccttttgcttaagtgttttcatgtagatttttgtttaatccttaccaccactttgtgcagagatactgttttacccattttacaggatgagccatttgtgatgcaggaagattaagtgacttgcccacggtcacataggtcctttctggtggcacctccttcccccactttacatagggcttattgtggtgccttgaaagtaatagagtgctttagagccagcgttgaatttgtataggtttgggatcttgctaggagagctgctgaaggaagagagattcctgggtaggtttgagggagctttttcatggtggtggtggaaacctggatcaggaagccttgtaagggtgagatttgtgtggtagtcatgggtcttccatggctgccaatgatggaattgtgaaggaagggtgagctggagctctgttttgattgtcaggaggagccaattaattgattgagtcggtggatgttcattgtacatccacagggtgcctaatccatgtatttagtggctgcagcgtttgtggagcacgtgggaccaggtattaatgtactgctaatgaaagttttaaattatatgatgatgaaaggccattaatgttttttgagctggggtgtggtcaggagacacacatggctttaccagctgcttagattttatagcagcatgatgcacacgatacagtatatataggaatgtcgccataatagattacaattgctcagctgggaccatgtcttttttgtttgaatgtctctggtacctgattttgcgcacagtattttgttcattcaaggattttaaacaagggaggcacttgctgtgatttgtgattcaggaaattctctctggtttgctgtgtaagaacagattgacacagacaaatttgaagactgttgcagtgcatctccgtgcaagatggtgctggcaggtctcaggcgcactgtttttggcattggagataggaggatgagtgagacaaggtccctaccctacatcttgtttgttaaatacctcttaaatttgatgccatgccaaatattttatgtaccttatctaatttaaacccttctatgacccttttcagataggtggctttaacttgtaagggaactgaggtacattgagtttaagtaacttgcctaagatcacacaactaatgagtgactgcctcacattcaaacccatgtcctcctggcttgaaatcctcagctgtttgcatcgagtggattgcttcctggcccaaatctggctcgagaatggttcagaaataacgagataatgacaattcattgtgggacttcctatcataaaggtttgaatgaattgctctggaaacatagggattaatttcccagtggagtcagtaactaaattgtgttggtgtcttgcataacatggttttatcagctgatttggggagtgtaacagtgttgatgatttgctttctgacaagtttatatagacacatttttctctctttgacgctgttctgccaacctgaaaataagtagtgagtgcttgctatgtgcaagatactatgaggtgcctgggagatgtgagggcacgcagacctggcaagttattgacctctacagacctcagtcaccccataaaaaggggactggatgggtggatttgcctcttctggctgtcacattctgtggcttggtgagtcaggaggcttgcagcagcttagtgcaggagactgatgtggaaagaccaactctagtcactaggtggagggaacgaagtaccgtaagagagcaaggggctgggatctcaggattgttccagattgctctgcatctttcccctgcccctccccactggtaatgttgctgtcttatgaaatgaagaaaattgttaagtgtctaggtcactatgaagtctctggtatttcatagtgtgtcctcatggtgactgctcagggatttgatttagatctggattagcctgcctttatcttgagtcttccctccctactgtctgttctctactagtagtcaatgtgatctttttcaaactgtaatgagagcaagattctaccgcacttaaaacctgaaagtgcctgggtgtggtggctcatgcctgtaatcccagcaccttgggaggctgaggcggaggattgtttgaggctgggccgcaaaatgagacctggtctctacaaaaaattaaaaaattagctgggcttggtggtgaccatctgtagtcccagctacttgggaagatgagtcaagaggatggcttgagcctgggaagtcagggctgcagtgagccgtgattgtggcattgcactccagcctgggtgacagagtgacaccctgcctcaaaaaacaaacccaacagtggatttcttaatagaataaaatcctaactccttctgttcccacctcaggctctgctctccttgctcactgggctggagagccctatctctagagcttcatgtggttgcttctttctctgatccttaagctcaactgttcatctcagagaggcttcctctgaccacattccgtaaaccccgttgcataagtggttggtatgaaatgatgtttgttggtgtatttggtcagtgtcagactttgcaccactagaatgtgaactccctgtggacaggcaccttgtctcttgcttttctgtatcctggtccctagaacagtgcctagcacgcggtagagctagtaaacatttgtagaatgagtgacggttgactacactggtgctcatagacaataacgcccacatttactagcatttgaaaattagactcattgctgtgtgtttattgttttgaatttgaaagcctagcagaaaagggagggaagagaatgtggaggctggggctgggcaggcttgcctgccaaccccagggcctctcttgtcctcacctgtaaaatgagggacatgaagtgaaccttgcagagggctgtcagggttaaacaacaagtgtctgtgaagtatctggcacttaggcccacagatgccctaccattgccaggtagctctgcagagaattaactacaaggattcttcacctgtaaggtcatttgatactgcctttttaatatctaggtattgaaaagctgatttactttttcaattatgaaagaatttatagttttttttttttttttggaaataggatctcactgcctcaacctcttggactcaggcgctcctcccacgtcagcctcccaaagtgctggtattacaggcatgtgccagtgtgcctggcctaggtatagtctttaaggaaaatttgggaagtagtgaaaactataaataggaattaataaaaacccatcgggccaggcgtggtggctcacgcctgtaatcccagcactttgggaggcctaggtgggtggatcacctgaggtcaggagttctagaccagcctggctaacatgctgaaatcctgtctctactaaaaatacaaaaattagccaggcatggtggcatgcgcctgtaatcccaggtacttgagaagctgaggcaggaaaatcacttgaacctgggaggcggaggttgcagtgagttgagatcgtgccattgcactccagtctgggcaccagagcaagactgtctcaaaaaaaaaaaaaaaagaaagaaacaaacaaacaaaaaaccattatctgaagaaaattgtaacattttgatatctttatgggtaactttgggctgatgttttctaaacagaaagcattctcgtttatgcatctgcctcccatcataaaagcacttactcatccctttatttagtgcctcttatagtttagaattgtatattaatcacattaaaatggggcctcaattttagtctggctggtgttgggcagttcatttcaggtcatgtttgtatgtggaaatccagattctgtggctggaatcttagtgtctctcgtttggcctcatggggaagaaggtgaggcttaaaaagtcaatgtacctaggctgggcgcagtggctcacacctgtaatcccagaactttgggaggccaaggtgagtggatcacctgaggccagtagttcaagaccagcctggccaacatggtgaaaccccatctctactaaaaatacaaaaattagctgggtgtggtggtacacgcctgtaatcccagctactcgggaggctgaggcaggagaattacttgaacttgggaggttgcagttgagtcgaggtcgtgccactgcactccagcctgggcgacagagtgagactctgtctcaaaataaaataaaataaaataaaataaaattgagtgttcctacaggtttgcttttggtgactctctaggaaacacttgaccttacttgcatgcctaatgtaacacaggcccttctcttttcttcccatgctttagaagatggcagtgaacgtatactcaacgtcagtgaccagtgataacctaagtcgacatgacatgctggcctggatcaatgagtctctgcagttgaatctgacaaagatcgaacagttgtgctcaggtaagagaaatctgctggatcatttttctaggaaagcctgtaggtttttcaggaatgtgaaggcctgtatctgactgcaaagccacacacagaggttcagggtctttgttagggccaccctgtttcttcctctcagccctgcctttgcttctgcttccaaaggaacttttttttttttttttttttttgacagagtctcgctctgttgcccaggctggagtgcagtggcgcgatctcggctcacttcaagctccgcttcccgggttcacaccattctcctgcctcagtctcctgagtagctgggactacaggcgcctgccaccacgcctggctaatttttttgtattttttttagtggagatggggtttcaccgtgttagccaggatggtcttgatctcctgacctcatgatctgcctgcctcggtctcccaacgtgctgagattacaggtgtgagccaccacgcccggcctttttttttttttttttttttttttgagatggggtctggcgctattgcccaggctggagtgcagtggtgcagtcttggctcactgcaaccttcgcctcccgggttcaagcgattctcctactttagcctccaaagtacctgggactacaggcgtgcatcaccacacctggctaatttttttgtatttttagtggagacggggtttcaccatgaggtcgaactcgtgacctcaaatgatctgcctgcctcagcctcccaaagtgctgggattacaggcatgagccaccatgcctggttggaactatacttaaataaagagtgtgctctggcctgcaggtccaccatcttctgctctagagactgcattctgaggcctgaagctcagccccgacttcttggtgtctattattgtgcatccagattgcatgttttatttgaggacagtaattgtattaactactgtctgctgttctagttttatgttcatcagtggcatttcttattcccaagaagtacaagatcaaagtctagcaaatatcatttcagccacaattttatggaactactgtttaacaataatttggcaaagatgtaatgatttaaagtctcggtgtggtggctcacgcctataatcccagcactttgggaggctgaggcaggcagatcacctgaggtcaggagttcaagaccagcttggccgacatggtgaaaccccgtctctactaaaagtacaaaaaaattagccgggggtggtggcaggcgcctgtaatcccagctgctctggaggctgaggcaggagaaacgcttgagcccgggaggtggaggttacagtgagccaagatcgcaccactgcactccagcctgggtgataagagcgagactccgtctcaaaaaaatgaaaaataagtagtgatttaaaagaagaacaaaaacatggtctctttctatgtatgctaatcgtatgacgtgggaaactagaaagaagaaaacaaaaaaatgccttataattccactattcaagccggctactgttcactcactaatcatgagccactgtgcctgccctggatcgatcttaaattactgccattgcttggccgggtgtggtggctcgtgcctgtaatctcagcactttgggaggccgaggcgggtggatcatgaggtcaggagtttgagaccagcctggccaacatagtgaagccccgtctctgctaaaaatacaaaaaattagccaggcttggtggcacgcacctgtagtccagctacccgggaggctgaggcaggagaatcgcttgaacctgggaggtggaggttgcagtgagccgagatcatgccactgcactccagcctgggtgacagagcgaggctctgtctcaaaaaaaaaaaaaatttattgccgttgcttataggattttttcttttttttttttgagttcagcttctgcccttccttattttatagctgggtcctagtctcggtcttagtttcattgacttgtcttgttatttccttggtgaggtgtatttaatcttggttttacggatggtcagatggaggctacgtgtgaagctgtacagtaacacagtggtgcccaagagttgtgtttattcagcattaattactttgctgatcatagacaacaggctgttagccttagatctgtgctgtgtcccccccaccattttctattagtttcctcattattcatttccctatccccatttgtgtgaggcttttaaagcacttgtttgacctgtgttctgtgactaatgtgaggatgaggtcatcctagttttcactggagccagctttttaccagcaattccctctaaaatttacctttttctgtaaatatattccaaagtctatttcacttagttaattggaaaatgtgatctttaatgtttagataagttgtatatgtgctgatcgggctctaggtttatctcattcaggcagagagctgttgtagacaggactgggcataaagaggcttcagtctgctctgagccatgtgacttttgacaagacccttaatgtcttagttcttcatctgtgaactggggcagcgatacctggcccacttgttggccagtgtgagaatcacctataataacagctttcagataactgactgtgtgccagaccctggaaatgagtgcaggtcatttgatgggggcacatcctccttttacagatgaggagactaaccctggggcacagcttatgtattacagaacctggttttgaaccagatctttctgagcacacagcccacatgcatcctgctgcatacttgttatatcttttatagaaacatttggaggggattaaacaaatgtaaattacaaatgtaaattacatatagttaattatagtgatactgtttcactataaagtctgtgaggtttgtcagttgttttttttttctttttgagactggaggctggagtgcagtggcgtgatctcggctcactgcaacctccgcctcccaggttcaagcgattctcctgcctcagactcctgaggagctgggattacaggtgcgtgccacctgtaatttttgtatttttactagagacggggtttcaccgtggtggtcaggctggtcttgaactcctgaccttgtgatccgcccacctcggcctcccaaagtgctaggattacaggtgtgagccaccgcgcctgggtggtatgtcagttttgtctcatgtctgctacttttcccaaataaagtgctttttctccctagaaaagggtaagtgcaggacacttaactgtgatttgtaaacaaacttgttcattcataactagtcttcttgaaagccgtataagatgtctcttggagtatgtagatggttgcattgtgtttcacattggtgtttagaaaatgaggtcttgcttccagtatgagagcagacaggatgagacacagacattgtctctctgaagaaggcccgctgccaggggtttggagtcagagaaagtgaggctcctcaactccttgtgcttactgaggcccaaggagaattccaggagcttttgatgctggtgccagatccttcctaacctcatctctgatgagcagaggatctagcagaccagagttctccactaaacacagctttacaaagtaggaatacatttcttccttgagagggcaaagtgctgaggtcctttgttaatctgcctgctgcctgtgaagtggccaaattttgtcagcagtgggctctcctacccccaacagtgagctgagcctttgcttggctctggtagagggagattaggcaaggataactttcagtgaaagatttggcaggttgtttcaagattcattaatacattctgtagtctccgtagtttggagagctagtcatcaagtattttggaaagatagtcatcatgaggaaaaacctggtcaaagagaatgatttttatgagagcttttttttgtcagaaagggagtactggttgcttttgtgaattgttcctgtgttgcattccatattcaggcccctctgcattttctcaagagcacagcttggtcctctgcacatgtagaggggtctcactgaatgtattcggctctccccttctcctccttgtcttctccctccagcctggcttcctttatgggttccttcgcagcaaaggtgttgatgttcccaggcaaatggtagattcctttctcctcagcttaatgtggggccccgacagcccttgagttcatgtaagacagcttggcgatcttgcttctgctgcactgctaatgacatggtcctcctgctctgggagtgtgttatcacacctgtaaccaggcctctcccagctcagatctggtctgatatttctgtttatgggatacttttgccctacctgtcattacttaaaatctcagctttgttttctcctcaggctagctcccttttccaggtactccatttggggccatgattccatctttcttccagtgtcccaggcctgagaagcatcttttgaggctaattcacagttttatttgtcttctgaaagagcttctagatccagccccttctcagattgctcactgctgctgcagtggcctcctgactgaacactaagttccctctaagttcccagcccccaccttcccttttgttatattgcataagtctgcagcctttctgagggactggttttatcaagtcacatttctgatcaaggaagtatctcttcaaactttttttttttttttgaggcggagtctcgctctgttgcccaggctggagatctccgctcactgcaagctccacctcccaggttctcaccattctctgcctcagcctcccaagtagctgggactacaggcgcccgccaccacacccggctaatttttttgtatttttagtagagacggggtttcaccgtgtttgccaggatggtctcgatctcctgacctcgtgatccgcctgcgtcggcctcccaaagtgctgggattacaggtgtgagccaccgcgcccagcctcttcaaacatttttgcctaagtcttcaagcacctccttgatttttcccttgctttacataaagcaaaccaaaacagaagataggaagctcattttcttctgattatgaatagttaggtcttcattaaaaaaaattaaaggccaggtgtggtagttcatgcctgtaatccagcactttgggaggccgaagtgagaggatcacctgagcccaggaatttgagatcagcctgggcaacatgacaaaaccttgtctctaaaaaagaaaaagaaacatgaagagaatcatactcgcataaaagtctatcaggaggactggatgccaatatttatgtaattgattctttctctttttagaaatagggaaataaataagaatgtttctttcttttttttttattcctgtacaattttggtaaccagtttcatgcataagttgttgactttttttttttttaactcctgtgcaattttggtaaccagtttcattcataagtcattgtctcttttttgttgttttttttttgagacggagtcttgctctgtctcccaggctggagtgcaatgaatggtgcgatctcagctcactgcaaccatcgcctctcgggttaaagcgattctcctgcctcgggttcccaagcagctgggactacaggcatacgccaccacgcctggccaatttttttgtatttttaatagagacgggatttcatcatgttggtcaggctggtctcgatctcctgacttcaggtgatctgcccgccttggccttccaaagtgttgggattacaggtgtgagccaccgcgcttggccaatttttcttttttttaattgtgtaaaatagtactgggtaaaataccactgtggatatagttgctgaatagattgtcttctatttgggtttttaaaaaaagttcgtccgtttcaaaaaaaaaaaaaaaaacaaaagaatgccctcagtgtacttttgttggatgagtaaataaatcagtcacctcagaaatcaaggccttaaccttctgaagatcctttcttaattaagaatgtcaccctggtcactgaagtgcccctgctctcgtttatgttgactttccaaaaataacggtaaccgaacatgctggaaccagcagagaactggttcggcctgacctcaagtaagttgaatatgcattttatggcagtcttgaattctgcagattacttattacttaaccactggtttagcttcccaagcttgttcctttggcaaattagccctggaagggcagtaaagtacacagtgaagcctgctgtgaattaggagagttcagtttgtcggcattagagaaataatcttcctggaaagtttaagcagtaataaaacactttttggaaaaaaaaaatgggcaagtgggggaaggaatgaaatgggatgaaatattgcaataatttattacagtagtctcttttttttttttttttttgagacgaggtctctctctgtcccccaggctggagtgcagtgatgtgatcatggctcactgcagtccttgacctcttgggctcaagtgatcctccttcttcagcctcctgagtaactggaaccacaagggcatgccaacacgccaagctaattttggtattttttgtagagacagggtttcaccatgttgcccaggctgttctcgaactgctggactcaagtgatccacctgcttccctaagtgttgagattacaggcgtgagctacggtgcctggccttatcatagtagtctttatttatttatttttgagccagagtttcgcttttttttttttttttttttttttgagacagtgcagtggcctgagagaatcgcttgaactcaggaagtagaggttgcggtgagccgagatcacgccactgcactccagcttggcaacagagcgagactctgtctcaaaaaaaataaataaataaaaaattaatagaggaacacaaaaatgtcttctattcaactttgttaattaaatgacgggttggctgggtgctctacaaaaagaataaaaaactagttgggcgttggtggcacgtgcctatagtcccgctactccagaggctgaggtgggaggatcacttgagcctgggaggcagaagttgcagtgagctgagattgtgccactgcactccagcctgggcgacagtgagaccctgtttcgaaaagaaaagaaaagaaatgataggttaaatgtatttagagatgtaaaaagcccagggagacagacgtcttagggaaaaaaatgttttttaatctagatcaaggatggatcttggaaattgcctcctgaagaggagggtatatctttgtgaaaaatcagaaaatgtcacttttgttattttcttttctgtattttaggcattcatttttgtttctagtggtcattttattgtcatgatgattaccaataaagaacaggagttttaaaattttgtagaaacactccttttctccttgttataggcttctgggttgcaagtatgttgtagaatatatggggtgaaaaccacagtcttgttacaggttttagaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttactaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcgtggtggctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataactttttttttttatggcaaaggtagtaacacccccaattatcttgctggtgtctggtttttatttattttgaaatcagggtttttttttaattttagttttgtctctacaatatataaaataggcatttatagtataagaatatcacttaactttccaggcatagtttaaatagagttcatatacagtaattttgcattcattattatggaattttattttttgaatatggaaaatgtctaaagtatataaaagtaataatagtgtataaacaataaatagtaaatagtgtaatgatccctcatgtaactcaatggttagcatggccaattttgttttatatctaattctatcctatcctatgtattctgggttattgaagtgagtacagaggtaatatttgtgaatgtttcagtatcaagcaaagtaacttttaaaaattatatttgtcagaggggtggatatattattggatatattctttttataatacattgcaactggaatctttggagattaaaagatagttaaaagccaggcatggtggctcatgcctgtagtcctagctactctggaggttgaggcaggagcatcatttgaactcaggagtttgaggcagcagtgagctatgattgcagcataagactccagcctgggcaacagagcaagaccccatctctaaaaaagattaaaaagttaagttgtggccaacacttcagtgatttgaatacttgaaaacacagtattcttgtataatagaaatacttacagggtccttatgtatatttgttattttttgtgtgtgtgtttttattggtgttttttttttttttttgagatgaggtcttgctgtgttgccagtgctggtctaaattcctggactcaagcagtcctcaagatagctaggattgcaggtgggcagccctgcccccagcaagcatgttttaataggatttggaattacttggaaaacatgtcattttgtaaaaatttatcctgagactgattctgcatcttgatctattttcaggttagaattattcttttttcttttcttttcttttctttctttttttttgagacagagtctcactctgttgcccaggctggagtgcagtggtgcaatctcagctcactgcaacctccacctcccgggttcaagtgattctcgtgcctcagcctcctgagtagctgggattacagacgcccgccaccacacccggctaatttttgtatttttagtagagacagggtttcaccatattggccaggctggtctcgaactcctgacctcaagtgatctacctgccttgacctcccaaagtgttgggattacaggtgtgagccaccacgcccggcccagaattttcttgaacacagttcattgtagatgcctttggttggtttgtgcaatggatttttcttcccttttcttaaatggggtctctctctgtcacccaggctggagtgcagtggcacagtctcgactcactgcaacctctgtctcctgggctcaagcagtccaatctcagcctcccaaggagctgggaccataggcgcatgccaccacacctgcctaatttttttgtatttttggtagagcctaggtgtcaccatgttgcccaggctggtctcaaactcttgcccgccttggcctcccaaagtgctgggtttacaggcatgagccactgtgcctggcctgtgcagtggatttcatgctttgtgataggcattgtggccatgcaagttatatagcggacctactctttatagcataatgcacttttgtatcacgtcttacgatgtgcttggatggatgtgtgtatgtgacttatatggtacttgttccttttttgtttctgattccttttcatacatttgagagagtggggaggggttgggaagtgtaggtactcttgaaggcaaactgcatgaaacttgctttataaatttaggggcttagccctaaggtctctaaaatatttttttctccttttggcagagctttataatgaattgatgcatggactagtttgatgcttgccaaaagcctcttttttggggctaaacagttgtttttctctgcagataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcaggtaaaaaaacaaccccaaaacgtttccaaaaaatagcgttccagatattcattcagcgttcaactagaatttttttcagtagccataggcttagggatcttaagaaatataatcccaggcatgtggccagagtatggattttggcatcaggcagataacggtgtgtgtccttaggtgtctgtagccctgtgtaagcaacttcaactctgccccacagtttcctcctctataaaatgggaattttaatacttgccccagagggtttttgaaacttgaacaagttactgtatgcagttttgccaaagctctagaaatccatcaggctagctcatgtaagagagcattagtttgttccaaaacaagggcatttttacagagccctaggatgggaagttataccagagctgaactccttgaaggaagtgtgtaggtctctcagggactgctcttggctgtctgtgttattctctctgtagaccagcttcctgtgtatactcacagcttccctacctgccctagaactttagctgctaggtgactttggcttgccatggtgctagcagagtcaggggcgggggtaggggagaggctgattttacataccttctcaaaagggtatgggcttggtagctttcccaagatgtgtttacattagtatagaatgtgtatattttggggcagggtagatactctacagatgctaatttcttcttttccagaggatggcaagaatattagttaaggtttcataatacctagagagaggcttgttcatctgatagagagggtaggttgagtgctttctaaatagcttaatggagagacaattcgcatgccatataattatatttttatatttaaagtataaagttaaacggtttttaatatatccaaagaattgtgtaactatcaccacaatcaattttagaacattttcatcactctgaaaagaaaccctgtgctgggcgcagtggctcatgcctgtaaatcccagcgctttgggaggctgaggcaggcagatcacttgaggtcaggagtttgagaccagtctggccaacatggtgaaaacccatctctactgaaatacaaaaattatctgggcatggtggtgcatgcctgtaatcccagctactcaggaggctgaggcaggagaatcgcttgaacccaggaggtggaggttgcagtgagccaagatcgcaccactacactgcagcctgggtgagagagacagacgctgtctcaagaaaaaaaatagaaagaaaccttgtacatagttaatagttgtcacttcccactttccccagctttaccccctccctccagccctaagcaaccacttatctgctttctgtctctggatttgccagttctaaacttttcctatacatggagtcatagagtatgtgatcttttgtgtctggcttcttttgctcagcctgctgttttcaaggttcatccatgccctagcatgtatcagtccttcattcttttttattgtggaataatattccattgcatgcctatacctcatttgattcagcagttcatggtcttttgcgttgtttcccactttatggcagataggaataatgctgctgtgaacgttcatatacggcttctgtgtggacctacaagttttgatttctctcagttacagacccaagagtatatactctgggagcagaattgctaattgctgtgccatgtgttaactctgtatttaaccttttgcagaactacctgttttccaaagtgcctcagctctttacattcccatcagcagggttcccgtttctctagatattgagtactttttattctttacctgtttagaatgggaaactacatagataaccccgtgcatttcatatttcagatgctgctaccagttgagtggagacgtgcattaagcatttagtctttgggataaacgtgctagagagagtcatccagaggaaatgcctattactgtgggtgacaggccttgtgattatagtttggggtgttaggaagatgagatattttcaaacctggcatgtaatatgcaaactttacaaaataattgctaagtaggtgaatcatcagtgatatatataccttgaggtttagcccattcttgattaattttacttgtagataggttggctcctttactccttttttcttgtctttgtctgcttttggctgtaaatactgagagacgtctataaatactagtcagtgtgatgcttttctctcctcactcttctaaactccttctaaaaggtaagcagagatgaagattttaaagcaattcatgggaagagcaggctctcctgctcttatggattccctccctcttccactccaaggagtctgaggtgaggagttaggagggacctaactttccagatggggagcagtgggcacctggcaacagccgagactgtgtgctcatgtctagcgtgaagtttgcctttgctctacgaagctggatttggtttgtagatgtgttaactaaatcttagctgttgtaaccaacatgaaacaacctgtttgtggatttggtcagagctgggttaaggtggatcatctctgtgcaccagaatgactgtacccctttcagatggtagtcctgttcaccgcagtggagaaaagacctcactgaaggacttattcccagcatgaaacatcatgacagaaattggtacttaactctgctgccaggatagaaaccactcagtaggcaaatgtgggagcgttgtcttgcatgcgggggctctctagcattggttcccttcactgaacacctgtgcaaggcagatggtcacagcttctccatgttgtcttgtggattttttgtttgtttgggctggaattactccttttcaaaaacctgtgctctctttttcagctccccagaggcccatctcaacacagagaaccgctgcggctcctaaggctggccctggtgtggtgcgaaagaaccctggtgtgggcaacggagacgacgaggcagctgagttgatgcagcaggtgggcacccctgtgtttagcacgtgagtcacctcgggggataggatccttgcggtggccagggtgccttatccgtgttcttaaatgaacacctgccttgtttgcttgccagagcatgtgacacgtgtgagcctcaggtgctgtgcggggagcatgaacgtggagatgtaagagagagatcaggtgtgcctgggctctcttagtgtggcagaagcctgtgctcggaagccagtgcttagactagaatcctgttgaatgtttctggaatgctgccagggacctgggatttggagaatgaaagataaaggaggtctcctttttgaataatttaataaaaaggattccgcagtctctctgctgagtcctagactggggtcactggagattggaattcagagtggaactggtatgaaaagcctgtggctcttctagttctgttcttagtaattgggtgattcgaaatgtcttcttcaggagtaaatgtccttaaggcacctgtcagaggtctctgtggatcaaaacaagttttagacttttagacattttcccactaatccttgtaattggttggtttgcttgctttcagatgattctttttgttaattctattttttaaattttgttttattaaaaaagtttttttaataaaatagagatagggtctcactatggtgccaaggctggtctctaactcctgagctcaagtgatccccctgcctgagcctcccaaagtgctggagttacaggtgtgagtcaccacgcctggctccattgaaaaaatctgggatgctctgtgattccagtgagtttgggattgcatccttttacttttctaaaagccaagtcctgaaacttgagggaattgatttctaatgcagaacctctcatgacccacactcagacttctaagagatcaggacagtgagaacctgcccaaaaatcacatttcacttttttattttttattttctttttttgagacggagtcttgctgtgtcgcccaggctggagtgcagtggcgtgatctcagctcactgcaacctccgcctcccaggttcaagggattcttccgcctcagcctcccgagtagctgggactacagtcgtgcgccaccacgcctggctgatttttgtatttttagtagagacagggtttcaccatattggccaggctggtctccaactcctgacctcagatgatccacctgccttggcctcccagtgctgggattacaggcatgaaccactgcgcctggcccacatttcactttttcgttctttcatttgtgtgtgccccgtggtcttaggtgccttgggagtgtccaggtgactgggtcaccgtcctcatccttggagtgggtgtggctgacttgagcacccgctggggctgttactttgaagtacagaagcctcggagaacaaggagagacttcctgtaactatttcaagacatggatttcaaacacaggaagcagtttcagaaagaaatacgagagagtaaagagtggttaatgttgaggctgggtagcagcgacttgatctgtgctctccgagagagcgtgccaggttctgcagtgtggctgctctctgctcagctcttttttttttttaattattattattattatactttaagttttagggtacatgtgtacaacgtgcaggttagttacatatgtatacatgtgccatgctggtgcactgcacccactaactcgtcatctagcattaggtatatctcccaatgctatccctcccccctccccccaccgcacaacagtccccagagtgtgatgttccccttcctgtgtccatgtgttctcatccgctcagctcttatcctgggtgatggagcccaggcttggggttccatagattgagggagaagtaggagtgtctctgtcagttaacttctatctggacaagtcagcctctctgaacttactgcctcacgtgtgaagtggggctgacacttgctcacagcagttgagcagattatatgagctgaatgttaagtgcctggaatggtgtttgttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagccaacattttatttatttatttatttatttttatttttatttttttgacacggaatctcactctgtcgcccaggctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcattacaggcgtgagccacagtgcccagccatagctaacattttaaaagtgcttatgtcatgcacagtgtaagcacttaatttcactttcgcagcaaccctgtgaggttttacacataaggataataaggcttggagaggttaaataacttgagctaggatttgaacccaggtatacctgtctccagaacctagatcagtcagtccctgctgaatggggaattgaggaagaggttatttgatttatctaaggtatacagatgtttcttttccttgcacccacctttggaaactgtaagtactcaccagataatgactctgggcaaattgctgctaagcgttgatgagagtaccaaggcatgggagatctgtcctagacctagacaggtttgatacacttggagaagatggacttggtgcctgcctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctcatacccagctggttcaaccctgacatagaagtactgtgtttggcctgcacagagttttatttatttatttatttatttattaaatataaaggatttgtctccaggttgtcaaagtccttcccttacctgttaccacctctcttggctcatttacattatctggcccctcctgaaagtttttgcatttgcagccctttgtaaatatggaaaatggagccacgtgggcttgtcaggctgtgggaaaaacagtgtatctgcacacactaccttgtggtattcgtatccttgggagatctgcaaagattctacattcctaagtcgtcctggagaaatttacttttagttgattttagtccaaagcagtgctgtccaatgaaggtagaaggtgagtcagaagtgtgagctacctgatttacatggtctagtagctacattaaaaagaataaaaagaaataggtaaaattaattttagcaacacatcatctaatatgtaaaaaataatactccagcatataatcaaatataaataatgatcaatgagctgttttacatttgaagactctgctaggtctttgaaatcaggtgtgtatgtgatacttgtagctcatctcagtggcactggccacgtttaagtgtttatatagacacatgtggttgatggctactgtggccagtgcaggcctgaaacactgacttggggcttcttaggttataactattgctttacctcaagataaggttctaagagtgaccttaattactagctacaggttttttttttttttttcttttggagatggagttttgctctgtcacacaggctggagtgcagtggcgtgagctcagctcactgcaacctctgtctctcaggttcaaatgatactcctgccccagcctcccaagtagctaggattataggtgcctgcctccacgcccagctaattcttgtatttttagtagagacagggtttcaccatgttggccaggccggtctcgaactcctgacctcaggtgatctggccgtcttggcctcccaaggtgctgggattacagatgtgagccactgcacctggccaagccacagatttttaataacctcatgaatacagacttgaaaggagtgccacgtgaaagccagtgtcttagtatatatttttttagtgatttagtgtttgttatgtgtgtatagttatgagcaatatcatggacagatgcaacttttggcctttataggtgggacccagaaggctgggtatctggtttggccttgataatttgttggacagagaaggttttaaagggtttgagagggtagcattagtgaaactagtgaaactaggtggataccaagctagcattcctttttttttttttttttttttttttttttttgtggcgtgatctcagctcactgcaacttccgcctcccgggttcaagtgattcccctgcctcaacctcctgagtaggtgggactacaggtgcacaccaccatgcccagctaatttttatatttttatagagacggggattcaccatgttggccaggatggtcttgatctcttgacctcgtgatccgcctgccttggcctcccaaagtgctgggattacaggcgtgagccactgcgcctggccagcattccttttcataagctctttcgacttcctttcttccttggtcattaatgccaccaggcatgtgattagaaggccccttccctgccttttggattgtggagctgtagctctgagtctgcttcccgctggggctggtcggctcttggcctgtgtatcccctgctctttggggctgttggtttcaggaaaggcagcaaactgcagcaaaagcagaggtggggacagtgagggaaaatggatgatttagctttgccggccaccaggcagtagctgtactgtatgtatgtatgtatgtatgtatgtatgtatgtatgtatgtatgaatgaatgaatgaatgattgaatgagacagggtcttgctgtgtctcccagactagagtgtaatggtccattgatagcttactgcagccttgaactcctgggctcagacaatgttcctgcttcagcctcttaagtatctggtactataggcatacaccaccctacctggctaatttttagatttttttgtagagacaggttttgccatgttgcccaggctggtctcaagttcctggcctcaagcgatcctctcaccttgacctcccaaagctttgggattgcagatgtgagccacggcagctggcccctctagtactttattgaaactttcaattattttttatttctgcggctggtaaaggaatagtgaaaggctgtctagaactgtgattctggtttggtctaacaagactttgatgatgaactttgaaattcgttttgataaaattgtcctggtggtgtcacctgatcctcatctctggatgctttttgactgcaggttataaagagggtcctttctcctgggatgagacttgatctcctctgttgtgtttggtgtcttcatcaggctgtggggaagctagataagctgtttatttctgtttttaaatttttattatttattttttaaaaagatggagccttgctatgttgtcacaactggcttttaactcttgggctcaagcaattctcccgactcagcctctagagtagctgagacgcgtgcgccactccacctgacatgcttcagtttttgtggctgtgagttcagaaggctggactagatgatttctctggtcccttctggcttgtagaattcccttctgccgaggtcgttctcagtggctgtacctttgattttgttgctttactttccatgctgctctgtggccctgacctgtaaatacaggtttttgcaacttgcattcattgacagttaaatggaattcacttgtcatagatgtgaatacagtacactggaatgaagatgccccatggttaaagtacacacaggactatgagtgttataacttttattggtcttggctagatagagtcctggcctaaggactgagacagatttcttcatagcctcttaatgggaatcagagaccctcagtggggctcatggagggtcagagcactttccattgggcttccaaagagttccattgagccctttccagggtcctttctattgaccccctcatgcaatcagacctggacttgattgtccagtcccttggtaaggactcagtttatgattgtcagctaccttgctaggctgtaattgtctcaggcttccctagttttttctccttaatcctttttcagtccctgagaagcttctacatgtttcaaggggtagtctgctctttctgggagctgttaccgtcaaggttgctataaacaaatccatgttgtttatctgaggctgaagaaaattgacattaaactgatgtggtttttgtctgtgttggggtttgatcaaagaccacatctccttttgggttagaagtctgcctgatattttattgccatactaatgccaagcatctcaccctttttaatgtcttgtgcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgtatgtgtttgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctcctattgcttggatccctcagcttcagttgctgcctccattttatcagggcccggggcatgcccggaaaagcaggcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaacttctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtctgattttacagcagaatagtatagtaatttcctgctctgagtccatgccagaatgccctgtagtgagaatgaggtgtgtgggagtcatgaatctgctttttccttgtgcactcaatttttctgccactgatgttgggtcagtcttgctgttgtgaatattttgggtaaagcatggctcctaagtataacaaaaggaaggcataaaaggaaagctggctgcatagacagtttattgagagaagatgttagagtactgaactttacaggggacttcaggaatttttgagggaaatttttttttttttttagtgacggggatctcactttattgcccaggctggagtgcctggtggtgcgatcatggctcactgcagctttgacctcctgggtcaagcagtcctgcctcgaccccgctggggagtagctgggactacaggcatgtcccaccaggcttggctagtttttttttttttcgagacattgtctcactgtgttacccaggctggtcttgaacttctgggctcaagccttggccttccaaagtgctaggattacaggcatgagccatcacacctggccttctttcttctttaaaaaacagttttattgaagtataactgacataataaactgcacatatttaaaatgtacctttgatgacatgggtgaaattaccaccataatgaagacaatgtaaatatgcatcactttcaaaagtttgagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctggagtgcagtggcatgatctcggctcactgcaacctctgcctcccaggttcaaacagttctctgcctcagcctcccaagtagctgggattataggcacccaccaccacgcccggctaatttttgtgtatttttagtagagatggggtttcaccatcttggccaggctgatcttgaactcctgacctcgtggtccacccacctcagcctcccaaagtgctgggattacaggcgtaagccaccgtgctcggtcagatgtgcttatttctaagctgacttcttttttcttcattcacattatattgtacagcctcctgctttttaaaattctcgttgctgtaagaggtttttcctctcggaagtccaaggcctggcctatctgctgtgaagccttttcagggcatttccttctgagaaatatagcaggacagtgcttggcagatgactgtggggagattttttttttttttttttctgaaggtgtgattctttcttcctttcttttttgagacagggtctccctctgttgcccagtctggagtgcagtggcatgatcttggctcactgcagccttgccctcttgggttcaagcgatcctcccacctcagcctcgtgagtagtggggactacaggcatgcaccaccatgcccagctaaactttgtattttttgtagagatggggtccccttatgttgcccaggcttgtcttgaactcctgggctcaagtgatcctcccaccttgacctcctaaagtgctgggattacaggtgtgagccactgcacccagccctgaaagtatgtttcaaagtcagttaacatgatcttaatctataaaataatctaaaattgtcaccatttttttctcccttataaaattatatgctattagaaatgagttcaaaaggagacttgctgccattttctgtcagaaataaagttaaatgggcagagatagtgtgttgtaggatatgtagagtcatggttatggatgctctataaacccaacctgatgatcttgacaagggttgcacccatagttaatggtatgatacctcccttaaagtgttaaataccttcagaaggaatttgacaccatatgtattggtcatctacaagaagataccttccaggagtgcaaggagtttgtgaagatactgttggctactgtcaattgagaagttaccttggtaaagagagaagccaaaactgtgggtatctgaccaagtgcattgacctggctcttgaatttgaagcacatacagtctttgctgcttggtttgcttggcaggttctgtgtttcatgaaggataggtaaacaaatgggttctctggctcaatttggatcattgttcatgctgatgattctcaaactgatgggcttcagaatcacatggggaacttgtttgacataatgtatttataaaaattcatcaccagagattctgagtttggaggttgaaaacctgcattttaatttgggccttatctacatgtctgcaattttaaataataattctggcaaggggaacatcagacttgagtcctcttgcaggtctctcctgctttgtgagttttgagctatttgacctctcttgttcttacatgcaagacagagatgatgattttggctgacgtgcctccctcactgggtacttgttgggattagaaggagctgatggaccaaaaaaaaacagcaccacaaagctaaaaagctctgtacagacaagaggcattatttatggcacaagttcttcagatctggtctgaaattctgtttatagattagaaaaagcttaggacagggcttttgtatcctcagaattcggaagggcattccttcagacaggctttgggtgttttgtaaaatacacccaaagtatttccttttcagcatggtatatggacaagtagaactcccttatgtcttcaggctcttatgtttatcctgtttttgttttcttttaaatgaagattcaatgtctcagattcattgattaaaaacccatattttcttcaagatttactctctagaatgtgaagggttttgaaaaggaagcatttttcttttgccctagccaaggtgatcctctgtagtttttcttttaaggattgttttagaagattgagtataaaggactccttttgtgatgttgaccatagttcattgcaaagtccacaaataaaaatccaagctttaggcctgatcagcctagtcagattagcttgctagcatgtgggtgacccaaatctgattgttgacaacagagaacattgctttgaaacaagctgaacctcagtctgtgatcagtgttgtgaaccacccgtcatttttctggtctggcactgttgtaatatgtcttttttttttttttttttttttccccagacagtcttgctctgtcacccaggctggagtgcagtggcacgatcttggctcactgcaacctccacctcccaggctgaagcagttcccgtacctcagcctcctgagtagctgggattacaggcctgtgccactatgcctggctaatttttgtattttcagtagagatggagttttgccatgttgcccaaggtagtctcgaactcctggcctcaagtgatccacctgtcttggcctcccaaagtgctgggattacaggtgtgagccaccactccctgcttgatatcatacttttggattcacacatttagtttgtaaaatgtcaaaaccagatgagttcatatttatttctgtatcttcatgacgcttgctgctttttttctcttcattttcacatgcgagggtataactgagtgttcagggttttctctgaaagcctgaagggattgtgtacttttacattgaacttgactgcagttagaaccattaacctagatgacttcagccaaattatgtattgtttttgtttttgtttttttgagacagggtctcctgtcacccaggctggagtgcagtggcacagtcatggctcatgacagcctcaacttcctgggcttcagctgtcctcccacctcaacctccatagtagctgggactgtagtgcacaccaccatgcctggctggctaattttttttttttttttttttttgagacagagtttcattcttgttgcccaggttggagtacagtggtgccatcttggctcactgcaacctccgcctcctgggttcaagcgagtctcctgcctcaacctcgagagtagctgggattacaggcgcccaccaccacacccagctaatttttgtgtttttagtagagacggggttttgccatgttagccaggctggtctggaactcctgacctcaggtgatccacctgcctcggcctcccaaagtgctgggattacaggcgtgagccaccatgcccggccaattttttggtattttttgtagagacggggtttgctatattgcaggctggtcttgaacccctgggctcaaacaatttacccatctcttcctccccaaatgctgggaggtgtgagtcactgtgcctggcccaaattgctatatagccgtgacttgtgaaggtctgttccccctttggtttaatctgatttgggaagtaatgttaccttagtccttggagtgcagaagctttctctgtactctattgaggttgtatccagtagcttcattaatttggttatctaggtgagcaggtcaagccttagagtcaaatttctaggctcctcaatctagaaccttaaatcttgaggtgcgtgtgtgtatcaaaattgtaaataactctcgtttccttgtattggaggctctcaggttctgaaatgtgaaatggaaatagccttcatagacacgtttctgagtgtgaggaggcagttctttgtcctgtgaccatttgaaagcaaaccaggttacccaccaatgcctagaactttgtaagtggcatcaagatataaatttataattgtaaaataacctatcagcagtttggggctgggtgtcatggctcatgcctgtaatcccagcactttgggaggccagtgcagaaggattgcttgagcccaggagtttgaaactagcctgggcaacatagcaagagaccctgtctctatttaaaagattttatatatatatatgatcatatataatatatataagatatatatgatcatatatataatatatatatatatgatcatatatatcttatatatatatatgcagtttggaattctatttgtcttgccttatttgctttttaaaaatttctaccttagttttttcctggtttactttgagtgtttttttgtagtcggaggagattgttggtgcggctgggtgtaggtatgaggcagaggaggaagagtaatttattccatctactgagcctttcatttactttctgttttagcagtagagtgggatgtcggaagcttttgttgggtgagagtcaatctgtcagggtaaatcttaaaaagctggatttgtggtttagttactagttactgtgtctccagtggagacaaagattagtttttaagatttagccttaatggatgattcacaaattgcaatgcagagtattgaagttaagtccaaggtcaagcacacaagtgggtaaaactgaacatatgaaatgggtgtgtggctggcacccacctctgacctttactgaaataaatgaggaagacggtgctgtaagtggaatgccacggaccaggagttaagaccagagtcctctgctaggccctgcatctgaagtctgcagagcatggcttttcattggctcagtgaggagttgagtcctggttcagaaaaagttaccgaggtctgtaaaagtcagtaggataccggaacaagaaagagtgggagagtgtacagttcccagcgaacattgccagtggaggctaattttcaccagtgaagggcgattttgatagaaaagcacagtgtctcaactacttgtggtttttgattctgaaagaggaggctttggcaggagcaataatacacgtggcctaccacctgtttggctttttccccacaggttgcaagctgcagggagggccttgctaattctagtacctccatccccgaatcgtctaaatgtattttacccaggacctgtcatggtttatctgagtgaccagtttcctttcctctcttgcttatttatcatgttcatatttatatttttcataatggggcctatttatatattttgaagtagttctagtgattttaagatccagcaaaacttcaaggtcatctggattttggtgttctatttaagttttctaacttgatacagtctttttttttttttttgtattttgtatgtttttctacaaaatgtgagagagttaagcatgtataattacatatgactgctgttttcactttgaaattttaaatcctgcttgggagaatggaataagctattgtgttttttgcaggcagctatgggatatcccaatttgtccctccctcctccttaattttgaagcctgagagaggaagtaataattttcttttttttttttttttttggtagggatggggtttgactatgctgtgcaggttggtctgcaactcctaagctcaagtgatccgccctcctccgcctcccaaagtgctgggattacaggcctgagccaccgtgcctggtctgaagaagtaataattttaagattcagtgttgagtgaaataaatgtattcttaaaaatttctaagagtgtttaactctctgacctaatatttaatattttccccaatcattaggaagtgcttttttgttgttgttgttgttttttttccaggcagggtctcgctctgtcacccaggctggagtgcagtggcatggtcacggctcactgcagccttgacttcccgggctcaagtgattctcccacctcagcctcccaaggagctggaactgctcagctaattttatttttgtagagacagggtctggctatgttccccaggctggtctcaaactcctgggctcaagcagtcctccaccactcctggccaagaagtgcctttttttttttttttttttttaaagtagctgctgaacacaggagaatctgcctttttcttgaatcgtggtttttttgtttttttttttttcaagacggagtgttgctgttgtcgcccgggctggagtgctgtggtgcgatcttggctaattgcaacctccgcctcccagattcaagcgattgtcctgcctcagcctcccgagtagctgagattacaggcacgcaccaccgtgcctggctaatttttgtgtttttagtagaaacaggatttcaccatgttggccaggctggtctcaaactcctgaccttgtgatccacctgcctcggcctcccaaagtgctgggtttacaggcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattggatgaaaaatggttctgtgattatggtttgtgggacgggttctgatgcttcatttatgttcttcatacggaattctgtctcatttccctagttctaaatatgaccagcagacccagagttccatctcgacttcataaaggagctgtcttggactgggaacagctgccaatgtctttgttgagatgggagttggaaagtgttagcactttgccagactttgccagcaagattaactgaggagatcaaattgagtcagggtgagtgagggttttaggtgaaagttgctctccaaaagattggatacctctgctgaagacctctgcctgacctccaaggctggagagcagctcttatctgtgtcctggctggctttcaatgcatgtatccttaagtcatctgcctctacaaattcgtacaaaccactcgttcccctctcatccctagcatgttcccctagtggctgctctgaattctcacccctgttctggatggtactctcccacctgccttgccctgcccctcttccgtcagctccggacaggtcaactttagggaatagattgaggcagatggatgtgacttctgatctgacctgttctccaattctaaatatcaaccgagttttacatctcagccttcccttccttcccttcagagttggaggaatggtacttgtcttggcctctcccctcttgcttttgcccttttcttttgggtggtctctgttggcagcaaccagcactttttttcccatttggcgttttacctctgttcatgaacatacatagaaccactttctcctggtgaaagacatttatcttacaaaatatttagttttgaaataattaaaaatatataaatagttgtaagactactacaaagaacttccctttgtccagatagactaattgtgaacattttgccacatttgtgttattatacatgttacttgttaaaccatttgagaattacagacatcatgcccttttacccctaaatacttttcagtgtacatttcctgaaacaaggacattctcataaccacaatacagttatcaaaagcagaaaacattaatatgctatctaataatatagagtccatgttcaaattttacataatttcaccaaataacagcccttgcagcatttttgttttttcccaatcggattcaattcagaatcgtgcattgcctttagttgttgggtctcttgagtcacctttcatctctaacagttccttagcctttctttggtttacatggcattttattttggccaggcgcggtgactcacgcctgtaatcccagcactttgggaagccaaggcgggcggaaagcacttgaggccaaggagtttgagaccagcctggccaacatggagaaatcctgtttctactaaaaatacgaaagttagctgggcatggtggcgtgcacctataatcccagctactgaggaggctgaggcatgagaatcatcagaatctgggaggtggaggttgcggtgagctgagattgagccactgcattccagcctgtgacagagtgagactctcaaaaataaaagcaaaaaaaaacccagttattttgtagaatatcctgtaatgtgggtttgtctgtttccttatgattagattcagatcatgtatttttttggcaataatactactgaagcattgtgccctgcatgtatcggatcaggaggtgtgtgatggatgtcattttgttccatcgctgatggtggtaactttttttttttttttttttttttttttttttgagatggagtcttactcttttgcctaggctggagtgcaatggcacagtcttagttcactgcaacctccacctcctgggttcaagcgattctcgtgcctcagtctcccgagtagctgggattacagacgtcagccattgtgcccaggctattttttcattcttttataaaaattggcatcatagtgtgcacccttttctgcatcttggtttttttatttatttatttttttgagacaaggtctcattctctcacccaggccctggagtgcagtgttgtgattacagttcactacggcctcaaacttctggatgcaggtaatcctcccatctcaccctcttgagtagctgggactacaggggagtgtcaccatacccagataattttttgtatgttttgtacagatggggtttcaccatgttgcccaggctggtctcaaattcctgggctcaagcgatcttcccaccttggcctcaagtgttggcattacaggtatgagccactgtgcctggcctgcatcgtgcttttcttattagtacttcatggaaatctctcttagctgctggaagtcagattcatccttctgatgtttgggtgacgtcctaggtgcagatgcactgatttgttcatttctgtgtctataatggttcacttttggtttttgctcctatgaatgatgctgcagcaatcactcttcaacagtggcctttcacaaaggagtcatttaaattactacccaccatcctacccactccactgaaacacattttattttatttttttgagacggagttgcgttcttgttgcccaggctggagtgcaatggcacaatctcggctcaccgcaacctccgcctcctggattcaagcagttctcctgcctcagcctcctgagtagctgggattacaggcatccaccaccacacccagctaacgtttgtatttttagtggagatgggatttctccatgctggccaggctggtcttgaactcctgacatcaggtgatccgtctgcctcggcctcccaaagtgctagaagtacagatgtgagccaccgcgcctagccgttgaaacacatgttaaagattgccatgagcctggtgtggtggcatgtgcctgttgtcccagctacttgggaggctgagatgggaggatcacctgagcccaggagtgcaaaaccagcctgggcaacattgcaagaccccatctcaaaagatcgccatgaacccttttttaattaaaataaaaatcagagaattgcatgatttaggctataaacatcttccataatctcacctaccagagatgactgctattaattttggagtatatgtttccaggctcttttttatgcatgtgccaatatgcacatgcatatattcttaacagaaatgaacttaacattttacatacactttagttttttcactggtaacctcttaattgcctttttcagtggctgtttctttcccttatcaccttaggtcactttgtagcgtcccattctcctagctgtcttgtgtgtttctccctctttctgtcctctaaatgtagccactcctcaagtttcagtccccagatttccagatacttgtttttattatttcttttcttttttttttttttgagacagggtctcactctgtcatccaggctggagtgtagtggtatgatctcagctctctgcagcctcaacctcctgggctcaagtaattctcccacctcagcctcctgagtagctgggtgtataggcatgtgccaccacacctggctaattttggattttttgtagatgtggggtctcaatgttgcccaggctggtctcaaactcctggatgcaagcgatcctcccgcctcggcctattttttattcctaattggacagcctagtatcacatgcattaaaaccactttccctctttgctcctttttctgaaagtggttctggcatttctgttagcttgcttcttggcttccaaatctccttcccttaggctgtcctctctcctttggtccttaggtgtgagctgttgccaagacactgctagattagagcattcttgggtaccgttcagtcttctccctccagcttgtactgatgaattttattttttatttttttgggacagagtcttgctcttgttgcccaggctagagtacaatggctcgatctcggctcatggcaacctctgcctcccaggttcaagcaatcctcctgcctcagcctcccaagtagctgggattacaggaacctgccaccaaacccggctaattttttatatttttagtagagacagggtttcaatatgttggccaggctggtctcatttgaactgttgacctcaggcaatccttccgccttggcctcccaaagtgctgggattacaggtatgagccactgcacctggccactgatgactttcatagttgcccttcattttgttcagactgtctggccaggtattcaagattctactttttgctgccaatttttttttttttccttctctgccatgattcctccctcccctctgcctccaggacccttcagatcaagccaagctggctcagttggtctgccccctgtgcgtgtcttgggcttaactatttcttggctgtccccctgccatcctagagtgccctctggactcttgcctggtgggacttgctgacgaggtggattggtgctccaaagaccctaacaaaacgctgtcatccatctcatatggaggccttgctgacccaatagaaacgttctctttatattcccagagcagagctctgttctgtctgctctcccgaagtcctggcttgcaagggcactggaaggtgggtggggagggtatatgcagtggaaatgaggagccctcatttttctaatctgtttattgtacttggactaccacatggcctcctaagattcttctacttctgtagaaagtgtgatcccctttaggaagcctctggcattaagtcaggagtaaagaaacttgtgaaaccccatggcttctgcaggacaactcctctctatcaggggaagaaaggctcaagtgcaagcttggcaaaagctttttgctggagaaatctctgggaaaaggaatgctcatccactgctcgctgggagtgtccatgggcaaggggaagccaccctctcccttgaccttgacttcttttccacctttctgtgacctggctaagtcagccttccacgtggtccttacaacgactggagttaagttgactatgattccctattctaggtcaaggctaatgtcttctgaagacttagcagagatccctcaactccaaaaggtaagaaagacaattatctgaactaataaagggtggggcattccagagtcacccaaaacctcacttaccagcatggaagtataggtgtttctgcatcggggagggggttgcatactcagatatttactgggcaggtaacttaagtgtattttttttttttgagacagagtctcgctctgtcgcccaggctggagtgcagtggcatcatcttggctcactgaaacctctgcctcctgggttcaagcaattctcttgcctcagcctcctgagtagctaggattacaggcatgtgccaccatgcccagctaatttttatatttttagtagagatggggttttaccatgttggccaggctggtctcaaactcctgacctcatgatctgcccgcctcagcctcccaaagtgctgggactacaggcgtgagccaccacacctgacctaagtgtacttttaaagggctgcctgagactgggtatggtggctcacacctgtagtcccagcactttgtgaggtgaaggcaggaggatcgctgagcccaggagtttgagacctgcctgggcaacatagtgaaaccccatctctacaaaaagtaaaaaataaattaggcatggtggcacatgcctgtggtccccgctactccagaggctgaggtggggggattgcttgagcctgggatgtcgaggctacagtcagccatgatctcgccattgcacttatcctgggcaacagagcgagaccctgtctctaaaaaaacaaaacaaaaaagctacatgagtcaaatgcaacacacccgagccccctgatgtacggtctgtacgtggactccacttctctacttaattttgtccagcaggttgtgataatagtgggatgggctgtaagagtttttatcaagccaggtatgtatcaattgtctgttatgtgcttggggctggggagtatagagataattaatacaaattagattaagttaagttaaacatgcctttgtctttgaagagctcactatgagacaaggagtaataacaagagctgtcatttattgtgtaattacagtttactggggcttcacatgtattcaggtgtcatttaggtctcaaccacagccctgcagggtagggactgtggctctctgttttgcagatgaggaaacctgtggctcagggaagtgatgtgatatgcctaagttaaaatagcctgtaagtgagggagccagacagaattccaacccagagctctggggctctgcagccgtgtgcttcccctcatgccttgctgcccacatgtatggacagacaagcacacttactatgccttgaggggcagatatgaacaaagacctgggaatatggaggtggcagtgatgactgtcatctgaaagttatggaagagctccttgggggaggttccatttgagcgagagtctgaagagtgggtaggggttcacctctaggggagatgggttggactgtgtatgggagacacacgtgagtaagcaccgaatgcttgctgggcttggggatggtggggagcaggtggtgtgcctggaacatggtgcatgcttgaaactagaaagataggtcagagctggttaggaagtactttgaatgctacactccggagttggggtgaagagtgtcagaagcagggtaaagtcattgatcagatttgctgcctagaagccaggcgcagtggcccatatctgtaatcccagcactttgggaggccaaggcaggaggatcacctgaggtcaggagttcgaggccagcctggtcaacatggtgaaaccctgtctctactaaaaatacaaaaaattagccaggcgtggtgactcatgcctgtagtcccagctacttgggaagctggttcacgagaatcacttgaacccaggaggcagaggttgcagtgagctgagatcgcaccacgctccagctgggtgacagagtgagactctgtctcaaaaaaaaaaaaaaaaatttgctgcctagaaagatgactggtgccagtgttgggaggtggatgggaagagagggtcaaactctggtcttagtggtggtcattgtacttgtcccagcaaaagactacagtttggggcgagcaggggtgtgggagaggaggcttatatgtaggagatggatcccaggaataattaactggagggacggtagaatgcataggaagaagagggaagagctgaaggcggtgctgagatttctaatttggagtctgggtgtgtagtgagagccttcacgtgctcctctgttgggctccgtggaggcagggaccctcactatgttcacggtgtatccacagtgctgtatccacagtgcctagcactcagtcaatgtgtgtagacgctgggctaatgaatgaaaggtcacaggaggatgagcacatttgctctttagttggggctaagtgggggagagtgagcaatttaatcccttgtcttttggctttttgaactaaagtgttttcaacttcccaaggcccaaagcaatgtgtctcagtgagcaggactgcctgcctgccactcaggtcatctaattatccacgttagagtcttttagggaaggcagcctttgatggcctgagctttggtgacctgacacattatgctaagtatctgtatcagtctcatggaggggtgaggagaggaagcatcatgaggcctggaggggtggggaaggcttctggggggatttgggaaggatgagtagaagggggaagtgagggagaacccccagtggaggggtctgtatgagcattggtgtgttggcagggaggccaggggtggggcaggtgagctcatctgaccgagatgggacatctgggctggtcaggaccaggtcaaattagggaaaatggagctggattccctggggttttcttccttccttccttccttccttccctccctcccccttcttcccttcctccctttcttccttccttccttccctccctccctccctctcttccttccttccttccctccttccttccttcctttctttctctctctctttctttctttccttccttccttcctttctttctctctctctctttctttctttcgtttctttcgtttcttttttttttgaagtcttgctctgttgcccaggctggaatgcagcggcacaatctcagctcactgcaacctccacctcctgggttcgagtgattctcctgcctcagcctcctgagtagctgggactacaggcacatgccaccacacccagctaatgtttttgtatttttagtagacgtgggtttctaccatgttggtcaggctggtctcaaactcctgacctcaaatgatccgccctcctcggcctcccgaagtgctgggattatgggcatgagccaccatgcccagccccctggggttctgaattctgaccactgaagatttgaaatgatatagttactgaactgaggtcccttataaatgaacaccccattatgagtaaggtaggacttggctgtatcctccctgagcctcagctgtggcatctgtaaaaagggaacaatggttccctctccaaagtcggaagagtctaggtttttctttatcttcttaggtgtaaaaatggttaagaattctgtatttctgtcagtgacatcataacactacttaccttgttctttctcaaagagtctctctttaaatcatgtgctgaaaatgtttggctcaggaaattgaaacgctcagtccctggttcttgttatattcgttccagctgtccatcccacatggcttccagaacaaggaggctgctagctccccaacaccatccatcacccttagccaggtgcctgacctccagcctgggtcccagctgtttactgagatacacctggccaagatagagaaaatgtttgaggaggacatcaactcgactggaggtaaggccgctctgtaggctcggtttttgtgtgagttctgcaacagggcaggaccgagtacctggggtgtgtggagggttcagacataataagcattttttttttgtttttgagacaggatattgctctgtcacccagtctggagtgcagtggtgtgatcaccacggcagcctcaacctcccatgctcaagcgatcctcctgtctcagcccccagagtagctgggactacatgcacataccaccactcctggctaattaaaatttttcttttttttttagaaacaagggcttgctattaggttggtgcaaaagtaattgcagttttgctattaaaagtaatggcagaaatcacaattgcttttgcaccaatgtgatatgtggtccaggctcgtctgggactactgggctcaagtgatcctcctgccttggcccccggagtagctgaaactacaggcacatgccaccatgcctggctaattaaaaaaataataattgtagagacgaggtcttgctatgttgcccaggctggtctcaaactcctgggctcaagcagcgccttctgccttggcctcccaaagtgctgggattacaggtgtgagccactgtgcccaaccctgatcagcatctttgcatctagtgtctcctgtaaaactttcaagcattatgtaggtattgcaagcatattggaggctatttgggatctagaaaatttttaaaaatacccctagtccaaatacccacatgtaaccactgttagcattttggtgtatgtattttcttccagtttcatatgtatggtttattatctgttgctgtgtgataataccacagtcttagtggcttaaaccaatgcacgtttatcacctcacagttctggtggggcaggagtctgggcatggcttagctggcttctctgttcaggctctcacaaggctgcaatcaagttgttggctgggaccggtgtggtggctcacacctctaatcccaacagtttgagaggccaaggcgggcagatcacttaaggtcaggagttcaagagcagcctggccaacatggtgaaaccccgtctctactaaaaatacaaaaattagctgggcgtggtggcacgggcctctaattccagctacttgggaggctgaggcaagagaatcgcttgaatctgggaagcagaggttgcagtgagccaaggtcatgccactttactccagcctagaccacagagtgagactccatctcaaaaaaaaaaaagtcgtcagctggggctgtggaatcatcttggggttgactggggaagaacccacttccaagctcactcaggttgttggcagaattcagttccttgcccctgtgtgactgagggcttctgtttcttcctgactgttggtgggaggctacctacagttcctggccacgcaggattcaccaacagagctgtttgcaaggctcaagccaacaacagggagaaaaactccagcaagatgggtgttgcaatttttttttttttttgagacggagtttcactcttgttgcccaggctggagtgcaatggcacgatcttggctcactgcaacctccgcctctggttcaagcgattctcctgtctcagcctcccaagtagctgggattactggtatgtgccaccacgcctggctgtattttgtatttttagtagagacggggtttctccatgttgggcaggctggtctcgagctcccgacctcaggtgatccgcctgccttagcctcccaaagtgctgggattacaggcgtgagctgctgtgcctggccaggtgttgcaatcttatataacaaatcatgtaatcatgtgcacatagtcctgcacaccctgtcacctgtgccatattctgttggttagaagcaagtcacaggtcccaccacactccaggggaggggatcgaaggagggactgagcaccaggaggcacacagtatgggggctgcttaagtctctctactgcagatgactgtgtatgttttcatatgtctttaatcatactatatatgtaatttcagactacttttcacttaatgctaatatcctaaggaattttccatattgctacataatcttccaagtcatcattactaacagaggcagttgtttcactggctaagctattcctctgttttcagacgtttaggttttattgagttgaatgttgtaaagatatcctttgtgcctcaagccttttctctgtttagagcttgatttttccccctgagataatactcctgtaagtcaaataataggaatacttaaaggcatctttctttatatccactagaccatgctagggtcctatttacctgccctgtgaatttcttttgagatttacaaccacactgtgatgtgggcaggaaaggataagaaatctccagtttacgaacgagtaaagtgagacctaggagggacaatttgtgtctggtctgaagatagggtgattcctgggtggtggtcttcaatgtcattgtttgcagccaggaagtgccaccactgtgtctgggaggactccattggtactgaccttggccatcgtttttattgtgtttgtgtatgttttgaataggtaatatacccacacagttcaatatatccaaacggttcaaaatccaaaaggtacttttttcatgatacttttttgatatacagagaaaatgtttttctcccccaccacccatgtgcccaggtatgtccctttaagttattactgttttctgtttcctgtgatctttatttttaatttttttagggacagggtctcgcttggttgcccaggctggagtggagtggtgtgatcataactcactgcagccttgaactcctgggctcaagtgatcctcctgtctcagcctctggagtagctagaattagaggcatgtgccacaatacctgggtaatttttaaaaactttttggtagagatggggtcttgctatgttgcccaggctagtctcaaactcctggcttcaagcaatccttctgcctctgcctcccaaagtgttgggattacaagcgttagccactgcacccagcctcctatgacctttggaaataaatacagaagtatctttagtcatttctacttcttcttcttttttttttttttcctgaaatggagtctcactctgtcacccaggctagagtgcagtggtgcgatctcggctcactgcaacctctgcctcccaggttcaagtgattcgcctgtctcagcctcccgagtagctgggactacaggcacgcaccactggctaattttggtattttcagtagagacagggtttcaccatgttggtcaggctagtcttgaactcctgacctcaggtgatccacctgtctcgcctcccaaagttctgggatttcaggtgtgagccaccgtgcccggccctctctacttcttcttttaaattttagtgtccagtcatcagtttcctccctttttttatatgcagtggcagcctattgtccacactgttctattctttgcttttattttttttaatttttattcttttaaatttcttttagagatagggttttcctgtgtagcccagggtggagtgcagtggtgtgatgatagttcactgaagcctcgacctcctgggctcaagcaatcctcctgactcagcctccagagtagctaggactacaggtgcatgctaccacatccagctaattttttcatttttattttctgtagagatggtgtcttgctatgctgtattccttgcttttttaaaaaattaattttaacaagtttacctcttgctttttactgaatgtatcttgcagatattttcatatcaatattaaaaaccctttctcattttaaaaaaccaactttggctttaaatgggagaaaagaaaattcaccttttgttgatgtaggataaaggaaaataggatcatttttctcttttgaaagtcttttaaggaggtggattatgagtgcgggctccataccgtgtcttaggcaccccaactgtcactgcgtgccttggagggaagaggggacatgccagtgtccttcttcctgttctgtaagttcccttttcctagcttcagtccaggttgtgccagatctttgagggaagtcagtggttcttaaagaggaaagagtgcctttcagtctccccaggaggttttgaaagcacacaaaggcagtttgactcccagctctgtctggaaggaggccgcagggctcatggcctgccccctggcatctatcttctacctggaaggaccattaagtgcttaagcaccttggctgtaactccagataaacaagatgggtccctcttttagcaaggcatgatttcttcaggctttccatttattccttgatccagcaacaaatataataataattactgttgtatcattgtgctgggtgttgtataaggagaatagaatggggttaagagcatgagttctggagccagattgctagggttagtatctggtgctaccacttaccagctgtgtgaccttgggcaagcaaccacgcctctctgtgccacattttcttccttatgtaggtagtcagggtgcataaggcacagagaacaatgcctggcatgaagtgccatcaccggcacatctcagtgcccacagaaaccctcaggggaccaatgtttgttgaagccaggacccagccctggggcaacaggctcatgcctgccatcccagagctctcaggctggagtgggagatagaagacagacagacaagagtgaaagcgagctgggcacggtggctcatgcctgtaatccctgcactttgggatcccagcgagctgaggtgggtggatcaagaggtcaagggttcgagaccagcctggccaacatggtgaaaccctgtccctactaaaaatacaaaaattagctgggcatggtggtgggtgcctgtagttccagctacttgggaggctgagccaggagaatttcttgaacccaggaggtggaggttgtagtgagccaagatcatgccaccacactccagcctgggcaacagagcgagactccatctcaaaaacaaaaacaaaaggccgggtgcagtggctcatgcctgtaatcccagcattttgggaggccgaggtgggcggatcgcctgtggtcaggagttcgagaccagcctggccaacatggcgaaaccctgtctctactaaaaatacaaaaattagccgagtgtgatggtgggcgcctgtaatcccagctacttgggaggccgaggcagggagaattgcttgaacccaggatgcggaggttgcagtgagccgagatcgtgccattgcactccagcctgggcaataagagcaaaactccatctcaaagagcaaaacaaaacaaaacagaatactaaaaacaaaaaacaaaaacaaaacacaaaacagtgaaagccagtgtgtcagctgataatgtcagcaagaaccatggaactgggcaatggcgggggtggcctccttagacagaccctaggaaggcttccctatggaaggagccccctgaactctgaggatgttggccaggatggtctccatctcttgacctcgtgatccacctgcctcggcctcccaaagtgctgggattacaggtgtgagccactgtgcccagcccagaagcactttttaaagattgtgattattaaaaaaaaagttgtagacaggggttattgacccatttgcagacagatccccttatagacccagccagcacgtggagaattttctatccttgcctgttcctcctttcttctccccatcttttccttcagccaaagtttatattttgataattgcttttagaagatgcagtttggctgggtgtggtaggctcacacctgtaatcccagcactttgggaggctggagagggcggatcacttgaggtcaggagtttgagagcagcctggccaacatgatgaaaccccatctctactaaaaatacaaaaattagcaggaagtagcttgaacccaggaggcagaggttgcagtgagctgagattgtgccactgtactccagcctgggcaacagagcgagactctgtccaaaaaaaaaaaaaatgcagttcacctctccttctagatgtctgaatttattaatgtctatttgttgccattatatacttttgttctgctgcttcttttcttcgtttttattttatttatttatttattgagacagggtcttactctgttatccaggctggagtgcagtggtgaaatctctgctcactgcaacctccgcctctcaggctcaagcaatcctcccagctcaacctccccagtagttgggactacaggcatgtgccaccatgcctggctaatttttgtattttctgtgaagatgcggtttcaccatgttgcccagcctggtctcaaactcctgggctcaagccttctgcccacctcagcctcccaaagtactgggattataggtgtgaacacttgcttccagcctttattttatttattttttagagacaaggtctgtctccatcacctaggctacagtacagtggcaagatcatggccaacttcagcctctgcctcccgggttcaagccatcctcccacctcagtctctcgaccagctgggactacaggctcacgccactacacctggctaatttaaaaaattttttttgtagattgggtctccttatgtttcccagcctggtcttgaactcctgatctcaagtgatcctcatacctcagcctcccaaagcactggaattacagacatgagccactgtgcctggccttgcttctacttttattttctttcctttttctttttttgagacagtctcactcggtcgctcaggctggagtgcagtggtgcaatctcggttcactgcaacctctgcctcctgggttcaagtgattcttgtgcctcagcctcccaagtagctgggattacaggcacacgccaccaaacatggctaatttttgtttttgtttttaaaaatatttaaatatttattttctttcttcctttctttctgacagagtctggctctgttgcccaggctggagtgcgttggtgtgatctcggctcactgcaacctctgcctcctggattcaagcgattctcctgcctcaacctcccaagtagctgggattacaggcatgtgccaccatgcctggctaactttttgtattttttagtagaggcagggttttgccatgttggtcaggctggtctcgaactcctagcctcaggtgatcttcccgcctctgcctcccagagtgctgggattacaggcgtgagccaccgtgcctggcctggttctccttttctttggagagttttctttgtctcaatccttcctctttgttaattgtatggaaatgggagttggtcttttttagtgcctcccctccccacactgctgtgggaccaacacagtgctcccatatggcgggttttcagccaggacttgtggggtggttgaatgttgagcagataagatgcaaaagataaccatgtgaggacagaagcgtccggaattggcctagcctggggtggctggggtggatgctgagatgtgaggaggggagacagggccaagaggggctggatttgaggtttgaggggctggaggaggcagcctcctaagggccccgtctttggctggagccatctcccttctgtgccccctgcagtggaccagctgaggaccgtaggggaggcagcaccaagactgccttgaactgagcacacctggtaaacatggtggttttttttttttttttttgagacagagttttctctcttgttgcccaggctggagtgcagtggtgcgatctcagctcactgcaacctctgcctcctgagttcaagggattctcctgcctcagcctcccaagtagctgggattgcaggtacccaccactgtgcccagccaatttatttttgtatttttagtagagacagggtttcaccatgtggatcaggctggtcttgaactcctgacctcaagtgatccacctgcctcagcctcccaaagtgctggaattacaagcatgagccaccgcgcctggccgtagatgtggtcttcagtgtgtccccctcagcacccagacacttgagaactccgtggcagtgatgggccgagggacttgtgaggaaggggatgatgctctctgttctctctttgaagccctgggcatggacgccttcatcaaggccatgaagaaggttctgagcagtgtgtcggacgagatgctaaaggagctgtttttgaaggtggactcggactgtgaaggctttgtcacctgggtgaggagggtgcccctgcttcctcaggtgctggagggaggctggagggtccagtccttgaccagttggtggggctgaagatgggaggccatcacgatgtgggaaagcctccctgtggattctggccccagtcgggggacttgcctggtggagacgtccctcctaagacctgtgtgagctgagttcctggcagctcattccccagggacaagtgtcgttggcccctgtgtgagacctactgagtgtgcagcggtgaccccacctgccacgcggctgtggtgcccaccaacctcccatttggcttgggggattcaagctggtaccacgaccatctcatgacccttcactgtcactcaggaataggccagcctgtggctgttacatctaaaagtgtcaggcttttacagcatcataataataatgctttcatgtttttctggttctaaacgttcgacaatgggaatatacagctttttaagcatacagaaaagtaccaaggatagtctgacaaattgatgtagcaaagatgacaatgataactagcatttacaccaagcactgtgctaagctctctatgtattattttacttaaacctcataggaatcctatggggtaggtgctattacttacctctatttcggccgggcacagtggctcatgcctgtaatcctagcactttgggaggccaaggggggtggatcgcttgagctcaggagttcaagaccagcctgggtaacgtggtaaaaccctgtctctacaaaaaataccaaaaattaaacgggtgtggtggtgcacgcctatagtcccagctatttgtggagctgagctgggaggattgtttgagcccaggaggttgaggctgcagtgagctgagattgcaccactgtactccagcctgggtgacaaagtgagaccatgtctcaggaaaaaaacaaaacaaaacaaaaaacttacctccatttgacagattgggaaactgaggcatggggaagttaggagtttgcccagggcttcagactcatcagcactggagccagtattcaaaccagggagggtgccttgagagtccctgcgttaactgccgtctcatagctctcctcagcataggtatacattctgggttttcttcttctcaattttcttgtttttatttatttctttctttttttttttttttttttgagatggagtcttgctctgtcgcccaggctggagtgcaatggcacgatcttggctctttgcaacctctgcctcccaggttcaagtgattctcctgcctcagcctcccgagtagctgggattacaggcacccaccaccacacctggctaatttttgtatttttagtagaaacggggtttcaccatgttggccaggctggcctggaactcctgacctcaggtaatccacctgcctcagcctcccaaagtgctgggattacaggtgtgagccattgcacttggcggtttttatttctcttaatgttctataataaacatttcctttagaacaatgaggccaactgaaagaaaaagaataaaaagcaatttaaccccctcgcattcctagcattctcagggctttacccagtggtccttgtttacaaccccgtttcttgttacagcttcatatggtggctgctttgggccttggccatgttttccagcagctgggcagtggaatggagtctggagttgcgccagtggccctggtgtgggtgctccctgctgttaacttgatgtttgagcatgggcatctcacatccttacaggggcctgagttttattatccataggggagagtgaataaagagctcccagggtgatgccagttgtgggggtgatctgaggatgcacttagcgcctcaggacggcgagggagacgctgctgtgctctttcagtgaatgctgcgagtaggcccttcccatactcaggattcaagaacaggtctgctgtccaagcgcagtggctcacacctttaatcctagaactttggcagaccacttgagcccaggagttcgagaccagcctgggcaacatggcgaaaccccatctctacaaaaaatacaaaaattagctgggaattgtggcatgcatttgtggtcccagctactcaggaggctgaggtgggaggatcacttgagcctgggagattgaggctgcagtaagctgtgatcacaccattgcactccagcctgggtgacagagcaaggccctgtcccaaaaggaaaaaaaaaaggccgggtgtggtggctcatggttataatcccagcactttgggaggctgagcaataaactgtgatcacaccactgcactccagcctgagtgacaaacagagaaagagcaggtctgttgcttggccacctgccctggccagtacttgggaagcagccaccagagcctatcggaagggcctgggagagatggggtggtgagggggaccctgggaatcaggcttgagttcttttttttttttttttttttgagacggagtctcgctctgtcgcccaggtcggactgcggactgcagtggcgcaatctcggctcactgcaagctccgcttcccgggttcacgccattctcctgccgagttcttgaaactgaaggctgagaccattttgccaataccctgcctcccttgtgctttctttcgaggcagcaaaagtatgtggattacatgatgcgtgagttccagggaaaagaggacatgcgaaagagccagtaccgcctgcacttctaccttcccatgacggtcgtccccctgtaaggagcctcttcctgggccttggtgggtggggtgactggacaagtgctggtgccagcctgcagtgagcccctccctcaatccgtgaccttgctggtgctgaccaggggctggcatcagcctgctgcctgatgtcctttggctcatttcaacctcacagccctgtaagtgttaggactaaggtacgtgatttgtccccattttatagatgaggccactgaggtctggagaggtcaaatggctggccccaggccaataggtagaaagtggcgggctgctgtgtttggccctctcagcccccattccccagtatacagcattgcttcacctgcttcctgtgctagttggtgcagagtgggtctggcagtttcatcataggggcacaggtggcacaggtggccagcacaggcaggaataggagtttcctcccaggcaacaggaagggaattgctcctcaagcccccagccaggccctggaggcctcagagtggctggccccgggagtaggtccctctgttactcctggagctggtggcaccaccctgccttggcttctgcctgaccgctctgctcactcctcctcctcgtggctcctccacccgctgtgcccactgaacccttgctttgcaggggaggaaaactgtcttttccctctacccatctgaggttcattggcagggacctctctaagcgaagacagagtcacaaggacaagcatacaagtttatttaatataagttttacatgacacgggagcctctgtaggaaatgaagcccctaagaaacagataacctgagggttttcatgctaggttcaatggagggtggaaagctgtggaaaaataagataggacagaggggcgatgagccaagcgtaatacatggcggaaatagcaaggacgttagttcagattcttgtccgtgtccctgtgtctttgggcacccctcacatgagtcttatgaccggcttcaggggaaggtcagacagtccttcctgaacatactgcttctcaaattcctttagtttaacagactcagtatgctgcggtgccctatttgggggtagcatctctcagacccctcaacctcttctgtctgtgccaggggttgatctgcctcgctgtgtgttcctccccctggactccctaagcatgaggagcattgcaggggctctgacctgctgggcctgggctgcccgggtcactggatcccttcctgcagtccaccctggagcactgctgcctggggcaggtggccaggcagggagctgggtcctgagatacaaggtgtggcagcctacatttgtgaccaggtcaggagggagctgtgggtgggtctgtcctaagaggaccagacccagaccaggccacggggaagtcaaagagctggaaggcagccccggtcctcaggcagcctggggtttaatagagaaggcggcttgaatgaaagtcacccaagggtaacttttttttttttttgagacagagtctcactcagttgcccaggttggagtgcaatggcttgatcttggctcactgcaacctccgccccccgggttcaagcgattctcccgcctcagcgtcccaagtagctgggattacgaacgcctgccaccatgcctgactaatttttttgtatttttaatagagatggggtttcactgtgttggctgggctgtttgtgaacttggggcctcaagtaatccgctcaccttggcctcccaaactgctaggattataggtgtgagccactgtacccggcaataacttaaaacaaaattttggttgggatttaattgagaaataaccaataaatatgaatgataagagatttcataactgtattttttaaacatttactggtttattataaagaatattacaaaggatacagatgaacagatgtgtagggcgaggtatggggagagggatgcacaagcttcaggaacctccgtgtgttcagccatagggaagctctcagaacccagtcctctggggtttttagtggaagcttcatgacatcagcattcctgcccctagggcatagggcaggactctggggctgtgggagttaggaactgtgggcaaaacatatatatatataaaacaccacaggcccccactcctggtttttgaacatagagaacacagctcccttatagcaaaagaatacacaactcaaaagatactggcacattcctagagtcccatttagtcattaataattcatcccatccatcatagtatatgaatgtctcccaggctgaggccattcaggtttgtaggcttcctttcaatcttgtcaggttccaaaagccggagttggcttggcaaataaacctctcaggcatctggaatcattgagctaagagacaatgtcatctctcttttctttttttcttttttgagatggagttttgctcttgttgcccaggatggaatgcagtggtgcggtcttagctcactgcaacctctgcctcccgggttcaagtgattcttctgcctcagcctcccaagtagctgggattacaggcacctgctaccatgcctagctaatttctatgtttttagtagagatggagtttcaccatgttgaccaggctggtctcgaactcctgacctcaagtgatccatccacttcggcctcccaaagtgttgggattacaggcgtgagccaccgcatccagccagtcatctcttgctctgagaactccttcgagttgttggtgtaatactggatttctctccatttaatccatttattaatctttaccctcagctagtattcctccttttctccatttgtcatttatttttacccaaacttttcctcctttgcaagggacatcgggttcagccactgtgcctatctggatcattggtagcaaagctactgtagcgagtgcctcccctcagtccattctcattcatagagaatagggttacacgagttccaaactcgcgagccatttttaccatgagacaatatagctgtatttatttttaacccccattttgccagatgggatgaaggcgcaatccacccccatcaggcccttagggaattctgacaacgttttaaaacatggtgactgtttcttgcttagaaattatccctgcccaggcatggtggctcacacctgtaatcccagcactttgggaggccaaggtgggtggcttacctgaggtcaggagtcctggccaacatggtgaaaccctgtctctactaaaaatacaaaaattagctggatgtggtggcaggcacctgtaatcccagctactcgggaggctgagacaggagaattgcttgaacccaggaggcagaggttgcagtgagccgagattgcgccattgctgtccagcctgggcaacaagaatgaaaactccgtctcaaaaagaaaaaaaaaaacagcatgcaaatgcaattcagcccactgaggctgatcagtttctaccttctttgctgcaagtggcagccctccaaacagaatatcgtccattcactttgaaactgtaaacccagcatttcctcgttggtcacttgatagctgttcacggcacactgtccaagtgtcgacagaacccagcagcacctcacacagttccggaatcagtcctggggtaaagaggctcatagcctgtgagtatctcttgcttgcattccccaggtagcaagatgctgagtaaaccatttccattttattgtatttattttttgggattttatttttgagacaaggtcttgctctgtggcccaggctagaatgcagtggcatcatctcaggtcactgcaacctccacttcctgggttcaagtgattcttttgcctcagcctcccgagtaactgggattacaggtggccgccaccacgcctggccgattttttgttgttgttgttgttgttttgagacagagccttgctcggtcgcccaggctggagtgcagtggtgcaatctcggctcactgcaagctctgcctcccgggttcatgccgttctcctgcctcagcctcccgagtagctgggactacaggcgcccaccaccatgcccagcgatttttttgcatttttagtagagacggggtttcaccatgttagccaggatagtctcaatctcctgacctcatgatctgcccgcctcggcctcccaaagtgctgggattacaagcgtaagccaccgcgcctggcctagtttttgtatttttaatagagacgggatttcaccgtattggccaggctgatcttgaactcctgatctcaggtgatccacctgccttggcctcccaaagtgctggtattacaggtgtgagtcattgcgcctggccaaccatttccattttattatggaatttctggcctctgtaggccccattagagcatttctctgatatcacccaagacatctgggtatttcaggtttcaagataattttatatccttcagtcgtaggggtagcttcagttaatgtcccataacaaggtagtaaatgcccctcaagaggacattccctagtccaaagtcccagtagctgttgccgggaggcgcttacaggcttttgtcgtaagccccaggaaatgctccacagagggctatccagtggagaatttgtccctgccagctctctagcttctactctgcactgtgtgggcctgggcaatcttactggttcccatgtagcatgtccagttcatatagcttgaatggcgatttacatacctctgttttatagcagtaggaaggggagacattccctaattagatatagtgttcattcccatgatacaatcagataaaagcaaccatttgaacatgaagtatgttcaaatacataactgtacattttggcatgaacacattgcttaataaggtcaagccttcactggtctatttctttttttttttggagacggagtctcactctgtcacccaggctggagtgcagtggcgcaatcttggctcagtgcaacctctgtctcccgggttcaagcgattctcctgcctcagcctcctgagtagctgggactacaggcgtgtgctaccacacctggctaatttttgtatttttagtagagatggggtttcaccacgttggccgggctggtcttgaactcctgacctcaagtggtctgcccgcctcctgacctcaagtaatcctcctgacctcaagtgatccactcacctcagccttccaaagtgctgggattacaggcgtgagccactctgcccggtcaggtctttctatttctttgggccatttagatctcaagggtgtttaaaggtcctgaaacagaatgtcaagaggcttgttcctatattctcctatttatttgttcaacctacaaacccggagagcatttccaacttggtggggaaaataaatgagtaatatttaattaccttcatgaaagagtaacttaaaacattggcttacctttactgagcctgggccgggtgcaccaaatgcagcctctcatctgatcccatcacagccctaggaggtgcaggtgctgtcatcatgcaggtgaggaaaccaagtcctccctgagatggcctgtccttagggctgtcttcccttttcctagctgtcacctatcatcccattctgcacagtctttggccctgacagaagtggcagggttggaagagatgagagggcaactgagaatattcatcacaatctacccagagccatgggctgaggataggagagaggagaaccgtgtccagacacgtttcccttgctcttctgcagagatggtaatggcagttgaattttcacagtggcttgggttatccttaagcccagggtcagaccaggcctaccggatttggaaagggccctggaggaggggtcacagtgcctaggttctagttccagccctgctagtaaataggacataactccaggcaaatgattattccctgggcccctgtaggatgaggtaatatcacctgctctgccagggctcaaagattgggcagatcaagtaggagagtgtgtgccatgccatgccatgttgggaagctggagtggcagggactctcaatggccagatagctggcttagcccacttgggtgcagggaagcaacccacagaggggagcatcaaagcctgtatgaatgctcaagggcggcctcctgcgaggccaggcctgcccccggagctgttggctgtaggtttggtgtgtgggaccctaattccccactgctccttgtccactttgatttcatccttcggttctgttcccccctctaccccagagcactagagcagttgctagaaagtgctgtttctcagttttcagcctcaggctccactctgctcaccctctcctgggcagtttttcctatgatagaagctttgcgaacaacctccgttctgtctcctctgtcccatcacgtcgcgaggaggctggctggctacttcgcaggataagcctgctgcttctcacttctggagccccgcctcatatcagcttctacgtggggccctttttcttttggccactgttgatgatccagtagaaacccgcttggaagagccagctatgggtttatggcgtgcgcatgtgcgtgcgtgtgcgtgacgctccgccggcttttgtccctcctcctcggtggctctctgttctgccgcaggtgccccctccctgagctgtttttgcttgggctcttctctctttcatcgcctcccacaggaaccatggctgtgaggtggtgaaggtggtgtttttaatccaccggttcaagaagatcgggtgtttcctgactgtcaccaaagacgggatcctgcagttctggtctgagtccttctcgctgatgagctcctttagggtgagtggggcccctacacatggtgcacacatgggtgattggagagcctctgccttagcacccccatggtgaaggtgacctggagccaggcagattcatggtctaagcagcctggacttgcagtcacagcacctgggtcctgacttggcttcactgtgggagccacacatttcccttctgctaagcaggattccacctggatgtccattccctgtgggtgtctcacaggcccctcaaatccattagcccaaacaggtgtccctttagctgtccctgcccaccaggtttccttctcttgcgtccccatctcagtgaatggcattgtcatccccaagactcctgtgctaggggtcagccactcccacgctgtccccacgtcctaccgattcaggccttttgcctagtccaggcaggaaatcatagtggttatgagcatgggctctggagcccaaatcccagggtcagagtcctaactgtaccacctgcaagctctgtgacctggacaaggtactatatactccctgtgcctcagttttcccatctgtcaaatggggctagttacagtgcttctttacagtccttttgggaacacatgatgacataatacatgtgtagtgcttggggcagggcagggcacgcagcaagtccctgctggatatattgtctttgtgctgccagctcttggctgagagtagtaagtgagaagatgctcaggagaacccactgtgtacttggtcgccagggccgtccagaatcctccagcagacgaggaaagcactgctctccagggctctacagaaaggttgattgagaacacagcccccagatgaagggctttctgagcctgtgtaactgcagagtgattcacagttgcatcagggctcatcctttggggaagaagaggcctgggtggaactagggtctgtggggtcccatggctctccttggtgcaccaagggggagtcacgatcaccatcctgaggctgtggcttccatagccatccaccttacctttctgtgtgtggactggggcagggtgtgttgcagacagagctcctgcttgtggctgctacatggtcaccaaagcacctccaaaggctgaaggggacagaggaaggctctctgggaaggcgcagcaggcctggattcttcctggaggggccgctttggcaggagtaggcctcccaggaccacacacccactgtcatgcagatggagacacctcaagtttgaggcggggcctgagttccactcaagagctatgtgatcttgggtgcaggtcactgaaactccctagggctcttggtttctctgaatagtgcaagggttgggagttaccaagctactggtgtgtgggggttagactccagccctgggcaggagagaggggcttaggagggttctggtccattgtcttcaccgccagaaccacctggggagcccgagagcgcagtcctctgtgctcttggtgctctctgagttctgatggaacaggctcctctctgcccctgccttccctatcccttctgattatccatctagaggaattggtttacgctcctccctgctccttcctcccagcttttcagatcgtacttctttctgctttcttcagttcagagcctgtggtgtcattcaaagagtaaaatacagcgccaggcgcggaggctcacgcctgtaatcccagcactttgggaggctgaggcaggcggatcacttgaggtcaggagtttgagaccagactggccaccatggtgaaaccccgtctctactgaaaatacaaaaattagccaggcgtagtggcgcacccctgtaatcccagctacttgggaggctgaggcacgagaatcactggaacccggaggcagaggttccagtgagccgagatcgcaccactgtgctctagcctgggcgacagagcgagactccgtctcaataaaaagagagtaaaatacagattccttaggtggccacacctacctcatctctggttcctctccaactctaagccgagtgggctggcctccctcttccccaggacacagcagctcatttctgctgacctggctctgctcgtggctttccctgcctggagtgccagctcacattctgtctgtgcacatgctacacgagtgcaggatgcaccagtgctgagctcctactgagtgctgggcaccaccctcaatgcttcaactttcattattccattcattcctcgcaactttgcagaacaaattatcggttagtaagccaatttgaccaggtgacatctgcagatggaaaataggattcagacctatggaggggcagacaggggaagtcagtcttccttccctgagttcctacttcctctccctgcaggcaaatgctatgaccagttttggggtgctcttccatggctatcctctctacatatcccccttttctttctttttttttttgagactgggtcttgctctgtcacccaggctggagtggagtggtgcaatcacggctcactgcagcctcaacctcctggggtcaagggatctttccacctcagcctcccaagtagctgggactacaggcatgcaccaccgtgtccagctaattttttcttttttgagatggagtcttgctctgtcacccgggctggagtgcagtggtgtgatctcagctcactgcagcctctgcctcccgggttcaggtgattcttctgcctcagcctcccgagtagctggaattacaggtgagcaccaccacgcccagctaacttttgtatttttagtacagacggggtttcaacattggccaggctggtctcgaactcctgacctagtgatctgcccaccttggcctcccaaagtgctgggattacaggtgtgagccactgcgcccagccttttttgttaattttgtagagatggggtctccctatgttgcccaggctggtctcgaactcctgggctcaagtgatcctcccaccttggcctctgaaagtgctgagattacaggcgtgagccactgtgcccttttctttttaaatgcgataatggaagcatattataatgttgctttttaccttggtttgtcacttaatcatgtctcttggcagctctttattggcatgggcacagttcctttgttcttaatgtctgggtggtgtccatggtgtgggttgataatcagctgtgctttccaggtggcttctggcctgttgctctaatagcagctgcagtgtcccctttgagtaggtgcaaacacacccatagaaatgtcttggaaacagatccctggatcatgagctatgcatattcaagagtttggttggttttttttgtggggggcggggggcggacagggtctcactcttgcccaggcttgagtgcagtggtgtgttcacggctcactgcggcaagactttgatagaactgtgagactgctccagaaaggggttttaaagaaggtgttctttaagcccattttacgaatgtggaaactgagacccagggaggctagggagtttatccaaggcccctatcactagacttagtggtagtgctaggctccatgccaggtctgtggtggctccaggccttgtgtggcaggagaggttcatggggagctgcactggcctgagtatgcgtcccagcccatctcctctgctcttcctctggccagcttaaccagacccagcagctctacaaccagccgatgtgggtcattgacatggtatgtctgcacaatatgaacctcgttgcagttgcgtctaccaggcaaaagataggtgagtccctgggggcttcccagctctgctctcagccactgggagccatgcatttgtgcctgggagaagtctgttggctgagcaactgtgaacatggatcagagccccctgggaggatagccaggtggagaggccttagtgccaagtaggcagggggtggtcggtgaatgctcgaatgaatacagtgatgttgaacagacccaaatttacaagccagaggccatactggtccatctctggtcctgattctacctcctgcctcttgccactcctagtccaggcccccttcactgtcacttaaatagcctctcctggccgggtgtggtggctcactcctgtaataccagcacttcaggaggccgaggcaggcggatcacctgaggtcaggagttcaagaccagcctggccaacatggtgaaaccccgcctctactaaaaatacaaaagttacctgggagtggtggcacacgcctgtaatcccagctactcaggaggctgaggcaggagaatcgcttgaacctggaggtggaggttgcagtaagctgagatcgcgccattgcactccagcatgggcgacagagagagactcagtcttaaaaaaaaaaaaaaaaaaagcctctcctgcatgccgcgcttccctgatgcccccaaaggcaggatgtgcattacagtgccctctgcagaaagccttcaccctaccccagtgttcttaggatggaggtgggatcctcagtgtggtctgtgaggccttcagaggtctgagccctgccgcctccagtagtctccacctgtcccctccctgtggtgctgaggccactgtggtctcctctggtaggtgctgtggcctgggtctctgtgctctgccatccctcctgcccctctctctgccccaacagcctctgcttttcttttggctctcatctcagaagttacttcctccaggaagccctccctgaccctctagtccaagatcctctgttaaaaagaccccatgagattgtacctcttcccttcaaggtcccctttcagtgtcatctcacatgtattagtttgcttctgtttagcacatgtctcctcctccagactggaaggtcagggactgcatctgttctgctcaactcagtgtctcagtgcctggtaccttctggatgctcgatgactattgaatggatggatgatgaatgaggcctctgactgagcagacctgtaaggtggtcagggagagggaattagtacatgaaatgacagctggtgatgtgaggctgaatgggaggagagagagtggctgttctggaacaagcagggactggaataaaaaggacctgggttcagggcctggtcccactgctctgtagatgtctgcctatgagcaattgctttacctcccagtgcctcgctttacccagaggtaaaatggggcctatgatacatgactccagggtgagtgtggcttagtagttaggtgtgtgaagctgctggcatagtgcctggcacatagtgggcagttaatcaacactgacatcattatgaggctaaattgtgtgatacagagaaagtggtcagccgtcagcaagggctagagcaatctatctgtgacccgcctgggctttccactgcaacatctgtttcctggggacccagtgctgtcccaggcttcctcaccctttatcctcagacagccctgagaatttggtgttaaaaccccatttattttttatttttttgagacagtctcactctgtcacccaggctggagtgcagtggcacaatctcggctcactgcaacctctgcctcccgggttcaagagattctcctgcctcagcctcctgagtagctgaactagggattcatttattttggttgaaaaaaaaatattgaattctggttcgatgatgggctggacctggtctgctgggcccgtgtttgttggctcatcaggtgtctgggattacaggtgcgcgctaccacacccagcaaatttttgtatttttagtagagatggggtttcaccatgttggccaggctagtctccatctcctgacctcaggtgatccacctgcctcagcctcccacagtgctgggattacaggtgtgagccattgcagccagcctagaaccccattttagagataattatgtcatcactgctgtcctgatggagcagctgtcatctgctcggaggtactcagacaaggccaaaagcagaggtggaagtggcaacagtgtgatccccggcctttgtggccccagcccagtccagccagtgctccttttgtgacctacagccctctggggtggccggccacgtagagaggcagaggagggcgagaggctgccgttcagatgcgggagacaacatgacggtgaggctgttgctcatcagaggctggaagtgaggctggatctgttggaaggagtcagtttttttttttttttaattgagacagggtcttgctctgtcacccaggctgtagtgcagtggtacaatcactgctcactgcagtctcaaactcctaggctcaagcagtcctcttgccttagcctccctaagtgctgggatcatgggcatgagccactgcacctggcctgggattttattccagctgcagttggaagcctttggggattttcagtggggttcccggtgggtgggtttactctgtgaacagctgtctgtggttgccatgggggaaaaagggctgaaggggccagagattccttgggatagcaatgaggctgctcactgtgactgaagacctcccaggcatggctgtgggctctatgtggccttctgtctttcccccagatttctttgatattagtgaccacaaatgtgtccgggccttcacctttgttgatctggacagctgtgctctggtcatggactactggtgagtctccactgggtgttcctcacatgaaccaggaggcccaggcctcctgcagcagccgcatcactgactagggttggggcccccagaaagcctccttggaaagatctggaaatatctccccactggctccaaggcccctgtgtcttcctccccaccaggctgcttctctctcagggtcacctctcatggtcactcagagcttggagtcattgtcactcccccacccaagacagccaccaaatcccagcagaggcttgtctggctgtggctgaggactctggggacatcacagtctattgcgaggggtgacttaacaaagggcagctggaggactagggattcatttattttgattgagaaaaaagttgaattctggttcagtgatgggctggacctggtctcctgggcccgtgtttgttggctcctcaggtgtctgggcaaggccggaaagtgttgttggaactgcccttgcttccaaggaggagggaagctgttggggggccagggagggagtggaggctccacagcctcttttttttttttttttcttttttttatgactcagagtctcactctgtgtcccaggctggagtgcagtggtgccatcttagctcactgcagcctccacctgccgggttcaagtgattctcctgcctcagcctcctgagtagctgggattactggtgcccgccaccacgcttggctaatttttgtatttttagtagagatgaggtttcaccacgttggccaggctggtctcgaactcctgacctcaggtgattaacctaccttggcctcccagagtgctggtcttacaggtgtgagccaccgcgcccagcccacacaacctcttccgtctccatctttctgcaggtctgactatcacagaggtgtgttctgctatggagacgccaaaggcaacgtcattgtcttcacctccgaaaacatgaccagtgggctgttcaacccccgtatcctccccagggcctccaagtggggtagctaagatgctggggaagggggcagaggcctgggcatggcctagatgtgggtgctgaggtcatcctggtccccgagccccccactccctgcctctgctctggagtctctgggaaggcgtctgcttccaagcgcagggtgcatgccgctcagctcagcacagagggagaggcgatggggggcagcagaagaccacgagggctggggagaggggtggcctctctgaggatgggaggctgtgcgggtgcggtctgggggtgcaggacacttctcaccccagcatgatgccagtggtgggaccctggggaagtccttcatccactctgatcctgggtgagagcactgatgctaactaacttcctcggatggtggcgaggaggcatgtgctctccttggctctagtgctgcctttgggtgggcaggggctgtcctggatgtgggctctgtggagcctgggcatggcctggctggcatgggtgagtgggcacagctgagtctggagcaccccttgctgagcgctttgcatgcatcacctcccataatccgcccctactgtcaggagggaggagccgctgctgcagcccataataagaggcagaaagggtaaggtcacctgtacacgcccctgcctggtgagtgggggctaagatctgaagtccggctgcctgccctggagtctgtgcttttagccttttgctgggctgcatcccacactgattaatagcaggaggaagtcattggagctgttctgcccaggtcgctagatccccagaggatacggctcagggccgcctagggaactcatctgaactggagcctgtctagaatccagccttgcatgcacagtgctggctctccaggttgcctcacatccaccaggaggcccaggccaccaggggccccatgcagggccaccaaccccctcttccagccagagttactaagcaggacactccaggggttcccaggccttggtaacaggcccctggcaggcttgttggggcagcgtcccctgctggcagagcagggacagatcctgtcctggacacagcagtgggctggcaccctgcttgcctcattggcctcgggtgcctgccctgccctgagctgcccacttagctgcttgagcctagtcactctgcgccaccgtgggaactggcacgggaggttgtggtggtctttgagccacatggtgaatgggatattgagagaggcagatgatactgtttgggcaggagtccttccatgccaacaagtgattgaaggctagggacaaacatgacgatgaggtgggcccagtgtatggacttgggaggagatggacagacccaggtatgtaccccagctctgtgtgacctggagccagttgcttaacctttctgtgcctcagttcccttattcaaatagggatggccctacttccctgatagctttggtataagaaacgtggaacgttaggcacctagtaagtgcacagtgactatgctatgacttcttccctgccctccctcacagcctagtaggagagacaggcaggtaaactgatgattaaaccacagcgcatcataaagctgacttctgcctgtgcctgtgcacaaccagccccactctggcagtcttgggcaactttccacccctccctgggacttactttgcaagcttcctcctgcccttgcaagatggggctggtgactttgcagcagtacaatgtttggcatgagccgccagatccatccttgctgtctcttccctcctccatccctgggagggaacctgagcctagactgccccagcatttgtgaccgcctccttaaactgctctgacggaggacccatgtttgtccctgacggtgctggctctactcgtctgtgtcagactggctttgctttccctgaagatccatcaactgctggccttgaatggtttcagcagccgggagatgctaagccccatgagggctgcacctggcttgcctgaattcctccagacaggcttgttttattttatttaagattttttttttttttttttttttacattttgagacaaggtcatactctgttgcccaggctggagtgtagtggtatgatcatggctcactacagctttaatctcttgggctcaagtgatcctcccaccttagcctcccaagtagctgggaccacaggcacgccaccaccacttctggctaattttttatttttttgatttttttttgtagagatgggttctcactgtgttgtccagactggtatcttttttctttctttctttcttttttttttttttaaggcagagtcttgctctattgcccaggctggagtgcaatggtgcgatcttggctcactgccacctctgcctttcgggttcaagtgattctcccgcctcaggctcctgagtagctgtgattacaggcacacaccaccatgcccggctaatttttgtatttttgtaaagacagggtttcactatgctggccaggctggtcttgaactcctgaccccaggtcatctgcccgtctcgccctcccaaagtgctgggattacaggcgtgagccaccgtgcctggcccaggctggtctcttaactcctggcctcaagtgaccttcccacctgagcctcctaaagtgctgggattacaggtgtgagccactgcgcctggcccagacatgcttattttatgatgcatgcctggaacttctactttttggaacctgtgctttctggacaaggggtgcatgtagtttgaggcatgatggcaaactcccaagtgattacttttcagaacaaaaagagcctagagtctcaattccttctccactccagcaaagatggagctccctaatgaagaattagcttgtttagattgcagcacctaggaagcgtgaggtgccctgaaatctggttctagttctgccatgcactggcaggggcactctgggaggcagcagtgatctgcctgagtctttttcctggggtgggggcactccgctcagctcaccaggacacagtgaggtgccagtgagggtttgggtggaaaagccttttgagaagcacaggagttgcaagccaactcaagacgtcttctgaggctttgcttgccaagcgaagggggaaagctgctgatgtggaccttggttttttcccctatcagatcactggatcaaagtttccttgcagaaactcttaaatgagaagtctgctttgcatagaagctaccggctgaaggtgagttttttctttccttggcctgttacaatggtaattatctgtacacacacaccactcaaaataaatgcaaaaagtggatttactccctgggttcagtcttagcccttggggtttggtctctggaaacaggttgcggcagctgttggatcccgtcagctctatctgcagaccacatctctgtggccatgcccctctcactaccgccattgctaagccctggtcctggccgacaccgcctcgctcctggatggctgcagtggcctctagctgggttccccacttcctttcttcatgcagcactgtctccattcagggccagaggaatgatgagttagaaatacagttgagtcaccccggtagcttctcatcacatttggaacaaaatctcaagtccttaccatggccgtcaggacgtgaggtgatctggctcctgcttgcaagctctgggcttgttttcaaccttccttctccccatctgctctcctgcagagacgcaggctcctctgctgttccctgaatgggctcagccccttcccgcctctgtgcctcggcatgtgctgcgccttcaggccgcggggctctcccctaaggtacctgtattccccctatctacttcctgtggtcccaagcagccctcctaggacaaccctgtgcccacctctgctttcatcccttcacccgcagtgtttaccagctcccagctttgtgtggtccgaccattgattcctcatgctgtcaccttcacgagatcgacagctcctcaacggcagcggcttcgtgctctcggttgtctccagtgcctaaaatagtaccctgcgcttggtgggctcccaatacatttgctgcacaaatgaatgaatgaatgacgcactcagggcggtctgggtgatccaacaggcctgcactgactttttttttttttttttggttgagtcagggccttactctgctgccctggctggcatgcagtggtgcgatcatggctcactgcagccttgacctcccgggcttaggtgatcctcccacctcaggcccccgagtagctgggaatacaagcaccacacccagctaattttttaattctttttttgagacggggcctcactatgttgcccaggctggtctacctaccttggcctcccaaagtgctgggtttacaggtgtgagccactgcacccgctcttctgtcttctgtgggaagctcatcttgggcttggttttccctccaggtctcactcagtgtcttggattcggtgccttcattgcgacagatgcttggtgacagtgtgtgtaaaacccagctcagggtcttgcatgtagaaagcaccaaagaaatatttgatgagccaatctctccaacccgccttttccattctcgtcacagagaggaaaatctctagattgggaggccaagcactggtccaggtcacagagttggcgccggagaattcagagcccagccagccccttcgactgcgcgtcatcttttgtggttcaagttgccgtgaaatgcacattctcatgccctccgcgcttccttgagcactccacgctatgacaaacatggagggtggcagtgggctgggagcacagcccatctgtagagggggctccctgtggataactagattgtggcctggacagacttgaattcatcctttctctcctcgtgggagatgattagtatgggcctgaccttccccatcctctaactcacaagatttcaaatgaaagtaggcttgtgtgcttttaaaaattttcagtgacgagagatggccagtgctggtcataggacctgggctaggattgcggggccacatcactttgtgatcactaggagaagggcattagactccgtgatctctgggcacctccagtcccagcacctggtcatgttctgggggctgggcctagaaagttgtccttgggtggagtctcccaccattgctactgtcttcccaggctctccatcccaactggtgtgagcaggtcaagttcatcccccagatgaatgtggtagtctcctgttcagccatcgagaagtcctctctggtgctgacaatattgccagccaaagcctctaagaaacccaggtaagaagtgcttctctcctggctaaggcggtggggctggaagggaggggggtggtgagtggaccatgggggctgacagtggcagatggtggttggtgtatggactctggggtttagtttttccagcattgccagcagcagcacggtgagaacacagcagcctcttttatctcccaatctatatgcaaaactcagcatagaagccagcacagagtgattggcagtcagtgaaatgttttctgaatgaagggatgactgtgagttactttctcctctgtgaccctcagttccctcatctgtgaaagggtgtgaaagcacgtacctcacttcctgaagggttgcatgagggaatcctctgtggtatgtgttcagtaactggcagcattggttctttgcagatggttccaatctgtttccttcagtctagattcctctaccctagagtgaagttttttcttttcttttgaaaaactagttagtcaccgggcgcggtggctcacgccagtaatcccagcactttgggaagccgaggtgggtggatcatgaggtcaggagatcgagaccatcctggctaacatggcgaaaccccgtctctactaaaaatacaataataataataataataataataattagccgggcgtggtggtaagcacctgtagtcccagctactcgggaggctgaggcaggagaatggtgtgaacccaggaggtggagcttgcagtgagccgagattgcgccactgcactccagcctgggggacacagtgagactccgtctcaaaaaaaaaaaaaaaaagaaaaaccaattaatcacacaagtatgtattaaatgcattgtccatgtaaaaaatgaaaacattataaagaaggttggagtcctgaggggccccctccttattcaatcgccattccctgacccagttatcaaaagccaccacttctggttttttttctttttttctttttgtgacagagtttcactcttgttgcccaggctggagtgtaatggtgcgatctcggctcgccacaacctctgcctcccgggttcaagtgattctcctgcctcagcctcccgagtacctgggattacaggcacgcaccaccatgctcggctaattttgtatttttagtagagacggggtttctctgtgttggtcaggctggtctcgaactcctgatctcaggttatcagcccgcctcggcctcccaaagtgctgggattgcaggcacgagccaccgcgcctggcccacttctgttcttttactgtgtggcttctactgtgccgtttactgtggataaactggtaggtatgttctctcgcggagtcttcctgctgggtggctcttgcccctgcagttttcctccggcccctagtctttaccttgagcctttggggctctgacattttgcttctgcacaggctgaagattgagccccaggagagtctttttgggggaacagcaggagatttaaggcctgtattggggagagactgggtgaggccagggtggggttggggcagaaacagagggccatttagacccatgtctgtccctttctgtcctggttgtttttcaggggaaatttcaatcctgagatgataaggctaatttcgtccaactcctcattttacagatgggaaacccgaagcttagggaggggaagtgactgtcttagagcagacacttgagctggagttttatcttgggcctcattatatgtccagtgcctttttttgttttgttttgtttttgagacggaatcttgttgtgtcaccaggctggagtgcagtggcgcaatctcggctcactgtaacctccgccttccaggttcaagtgactctcctgcctcagcctccctagtagctgggactacaggcacgtgcccccgtgctcagctaatttttgtatttttatttttcattttttaatttttattatttttattttttgtttttttgtgacggagtctcactgtgttgccaagctggagtgcagtggcacaatctcggctcactgcaacctccgcctctcgggttcaagcagttcccctgcctcagcctcccaggtagttgggactacaggtgtgcgccaccatgcccggttaattttttttcatattttagtagagacggggtttcaccatgttgtccaggatggtctcgatctcccaaccttgtgatccacccaccttggcctcccaaagtactgggattacaggcgtgagccaccatgcccggcttaatttttgtatttttagtagagatggggtttcaccatgttggccaggatggtctcgatctcttgacctcgtgatccgcccacctcggcctcccaaagtgctgggattacaggcatgagccaccgcgcccggccgtccagtgcctttttaaccaaacagtgcactgtgtacatttctagacaagtcctggagctccctgcaggccggaaaaaggggcctccgggaatgtctgacgtgaaggggaagtttcagtcttgggttcagtgctttgaatggggccgtgtggcagaagtttgcttggagctgtttgctgaggctatctgtctgcattggtggtggtatcacttagtgtatattggggtgtccaatcttttggcttccctgggccacataggaagaagaagaattgtcttgagtcacacataaaatacactgacactaacaatagctgatgagctaaataaaaatcacaaaaaagtctcataatgttataagaaagtttatgaatttgtgttgggccacattcagagctgtcctgggttgtatgaggcccatgggctgtgagttggacaagcttggtgtataagatatgtgtttcattcagatcttgttttattgagtcctgatggcaggaggatatcagggggtcacctcaccagggccaggagggcctctgtgggccgggcctgctgccttcctgacctcattgcctccacctgcccactcagctccactggccttcaggctcaggcgtgctcctgcgccagggcctttgcacagctccgctgtctgtggtatgctcttgttattgattgactgattgattgattgattgattgagacagagtcttgctgcagtgcccaggctggagtgcggtggtgtaatcttagctcactgcaacctccacctcccgggttcaagcgattctcctgcctcagcctcccaagtagctgggattacaggcacgcgccatcatgcccggctaatatttgcatttttagtagagacggggtttcaccatgttggccaggatggtcttcatctcttgacctcatgattcgcccgcctcggcctcccaaagtgctgggattacaggcgtgagccaccgctcctggccttgttttttaaattaattaattttaaattaatattttcattataaaatgtttcaaacacacacaaaaatagataaaatggtataattcttccatatcacctagtagctagtccacgttaatatttctctaagtacctcagagtatcttcttacaatatttggaactagatataagcacggttctgggatggttttgagcagagaactggtgtggtctggcttatatgttgcaggtggagtgtccatgggcaggggtggtggtgaacacaccagtgaggaggccattgcaatagttgaggctgcataggatggtggcctggagctgggctgtgttgtgggatggagggactggagatgtatttttggggtagggtagagaatatatttacacacacaaacacagagacacatgttcccttccttcagcctgggtgacagagcaagaccctgtcttcaaaaaaaacaaaagactccattcaggtcagacacggtggctcacttctgtaatcctagcacttagggaggccaaggcaggaggatcccttgaggccaggagttcaagaccggcctgggcaatacagcaagatcccatctacacaaaatatttaaaaattagctgggagtgttggcacaccccatgcattcttgtctgcatgcagtgcaatgtacaggccggcaggtggcacaattgaccacttgctggtctcccgttttggcgatgccatcttagggcatatcctctgcgggtggggcctggcattggcaccccaacctctgcctctggagtcagcctcagcctccaaggcagtgtgggcctgagggtctggcttccttgcagccagcctcacctgagttctcagatggttcgagccaggagcaaatctgacggagcgggtgtggtagcaggagccggtgctgagtgtgtggactgacccccggcgtctccccgactgtcccctcttccttcacttctgccaccaccacctagttgaagccaccgtcatctcccacctgaactgcttgccctggccctcttagcagcctcaccgtgtcccctcaggccacatttcctgacccacggccatcaacaaatctgatccagccagggccctgtatggagccttcaacggctcctggccagggctgtggattgggccctgcccatctcgcccatgtcctctcatgccctctcctcctggcccacctggtgcccaccacaccggccttgcataggctgctccctccggctgaagcctcacccctcccctgggctccccggggctgactccttctcacccttcaggtctccgctgccctggaccctcctcagagaggccggcagaagtgagcctccttctgttgtcctccgtcaaagccatgtgcttatgtcccttgcaggactcgccatgatttgtaaatgtccatctcccttctgtgtgtccacttcctcctgttgtttccctctagaaggaaaaccccctatggcagaagcctcgtgtctgtgcccctggtaatcctggcaggagtaggagccaggaaatctttgttgatcaatacgtgaaatcggcctgaaataatttctactaacattttggtgaccattcttccagaacatttttcggcagcacatatacgtgtggagggaggaatatctggtttggcaataaatgaaatatgtgtactgccatctgttctctttgaagctttgatttttagaggaatccttgtgtctctggacagatgatttaaaggggagcaaggctggagatgaaggaactggctgggaggctgatacggcaaagtcaggggcctgggctagcagtggccatgggagtggagggaagtaggcaaggaggacttggggccaggctggataatgggagccacagtgttgtccaggttgatgcccaggcacctggcttaggccccccgggagtggtggaggagccgggtcaggggtgacttcagtggagggcatactgtgtcagggggtcgggtgccctactacagatgcctttgaatggattttttgggttttttttttctgaggcagggtgtcgttctgttgcccaggctggagctcactgtaacctcaaactcccaggctcaagtgatcctcctgcctcactttcctaagtagctgggactgcaggtgcaccaccatgcccagctaatttttaatttttttgtacagatgggatcttgctgtgttgcccaggctggtcttgaactcctggcctcaagggatcctcctgcctcgacctgccaaagtgctgggattacaggcgtgagccactgtgtctggcctgaatagagtctttttgtttttttcgtggacaggttcttgctctgtcccccaggctggagtgcagtggcatgatcacagctcactgcagcctcaacctcctgggttctagcaatcctcccacctcagccttgcaagtatttgggactgcaggtgcaccatcacgcccagctaatttttgttttttttgtacagatgggatcttgctgtgttgcccaggctggtcttgaactcctggcctcaagggatcctcctgcctgtgcctgccaaagtgctgggattgcaggtgtgagccaccacacctgaatggagctttttttttttttttttttttaaggcggtggcggggtgggggtactgagtctttctctgtcacccaggctgggagtgcagtggtacaatcttggctcactgcaacctccacctcccaggtccaggtgattctcctgcgtcagcctcctgagtagctgggattacaggcacataccactatgcctggctaatttttgtatttttagtagaggcgaggttttaccctgttggccaggctggtctggaactcctgacctcaggtgatccggccgccttggtctcccaaagtgctgggattacaggcgtgagctactgtgcctggccagaatggagttttgaagagtgtagtagaaggagctggcggggcaggatgttgtggatgagaggcatgggcataggcacagagcatctgcggttcttaggcctgtgagggctgcagggccctggccttcctggaactcctgtctgggcctctccagccctctgagcctcacccggccctaatgagcctctcctctcctggatcgctgcttactgagcttcctgccacctcctgccatatccaccctaggtctgaatcctgacccctgtgcgggaggagtaatattttttcttcacccattgtaaggtttatggctgagaccctgataacaaaaggcagatgaacaagagaaaagcatgcacatttaagtttcatgtgacatgggagccttcagaaaaaaacccaaagagacagggacgcctgtgtagtttcatgtgaagtttgatgaagaatggacggtcatgcaggacgactggactagtaccatctgatggcagtaaactgtttgtccagatccccctctgtgtccctgtgtcttcagaaataaggacattggggctgggtttggtggctcatgcctgtaatcccagcactttgggaggccatgggtggctcacctgaggtcaggagttccagaccagcctggccaacatggtaaaagcccatctcttctaaaaatacaaaaattagccaggcgtggtggtgtgtacctgtaatcccagctactctggaggctgaagcaggagaatcacttgaacctgggaggtggaggttgcagtgagccaagatcgcaccactgcactccagcctgggcgacagagtgagactccatctcaaaaaaaaaaaaaaggacattcctttcccctaggtataggtatagagtgggcacctatggaatcagtgttctatgacctgcttcagggagaaggctaggggaaggcaagcgtggccctcctgctgcttctgctgttgtctcaaatgccaagatgccatattttggggtagcatgtcctaaaccccataacccccattgtttgcaacctgtgtgaccttggggaagctccttgacttttccttttggtgtctctatccctagcgcagggcagttctattcttgggcattgtatgagatgtccagatgatgcaggagacagcaccctgcatggggaccacacgtagccagggtggggcacccgggagcttcctttctgtccctcccttggaaccccgcttttttcttgatttgtatcatggatgggaagatgcctgtcccagtacagttgatgtgaaaatcaaatttgcccttggaatgaggccaaatgctttacaaatgtcaggagtcgctcctgcctgggagctgtctctacctggaaggtggcatctggcctgtgggctgttggtttggggccaggactgggctgctgctttgcctgtggtgctgagccctgacttggctgcagggtgaaccctgggtggtctctggggctactcctctcctaggatggagaggtagtgactcctccctaggcctcctgggaggctctgcctctagctcctcccaccccaggctcagtctcagacgctctcttggggccactgctcccggccctgcagccctcactcctttgatattgtaggttgtcagtgctgcgtttaaggaaagggattctttgctttgattactgcccagacaggaacttcctgggtaagtcaccttcatgtcacccagaagctgctggggggagggctgctggggatggggggaccaccagagctcaggagagggctgcacagcatctggcctctgtctggcttcctctcctgctgctcttgtccccacttctgggcaccaccttcaccagtgggtgaaggtccccagtggaggcccctgggactgacacccacgtcttgaccacagtgactggtggctacgatgccttcatccgcctgtggaacccctttgtctcaaagaggcccgtgtggctgatgaagggacaccagacctcagtgacgcacatccttgtggatagcaggaacaacagcatcctcatcagtgtctccaaggacaaggtccgccccgacggtccgcctgactccttctgttcctcagggaaacacactggccagagaaatggcatgacctccctgcccacggccccacatctggccaaaggcctagcaggaggggccccgggtgggaggaaggtgagggtggccatggacctctgagcatgtccccagagctgggttcccaggtagcccagcctggcttctaactttgtgaccctggcaagtccttcccttttctgagcctcagtcctcagtctccctatccatagaatgggctgttgagtggtttagagaaccagcagcaaaacagcagtgcagtgtctggcacaggggagttgtgcaatgcatggcagccgttcccctgcgctgcccctgccctcgatctgcacctctcagttgctctagtgacccctcctcggctgcctggccatgagggctgggcttggcctttcccacatgccagggctcccacttgggacccgccactgtgctcctctgcagctgtaggctcaggatactgccccgtctgctgggctgtgggcccacagtgctgggggccctcctttaggggacaggttacgttttctggaactctggagatggagaattgtcagggccctcagggtcacctggagcaccctctccaacatatccacacaccctcctgtctggaattttcccagaagccctgggagctgggatcatcgcctctgatgaagggtctgagtctggggcatggggacagggacagtctcgctgaggtccccagtcggccatgggcagaggatgcctccaagaagtcagggtcttggagggacttctgtggggccctctagggaaagttcctccacctgggaggaatgggaggggcccctctggggacaggcaggccactgtggcaactatgttggtagccactaccggactgtgtcccaggctggagtggcagcaagggagggcctggggccagcatgtgctgcctggcttggcttttgtacccagccagtgaattcagctgctccaacagggtggaggcctgggggcaggctgggggtggagctgtgcccggccctcactcactgtgtacctgggttatctgagcacaagagtagcctctctgctgctgggtgtgacggtgccaacaccatgtgtgtgtgttagaagtgcttggacggacgatgtgccctggccttgttcgccggaggcacccccgaggcttcaggagccggctacatccccgagacccatgctcagcgtcttgcctttttcccatcccccagaatattcgcgtgtgggacatgctggactacatatgcctccagtccttctgtgggaagttttttgctctgggaaactgccccatcaccagtgcctacttcttcgagaaggacaataccctcatctgcagcacctactcagtgagtgctgtcccaggagggagtggggtcaaggccgcaggtggagggccagggtctgaatcccatgggacacccaaggggtggccacgtcctgtccctcctgggactgctgaagcggctagactctgtggcctggcctgtgaggggccgtgtcttgggatttcctgaaatcctgtttctaggcccccagcctgtcaccctctctgcagctgctgctgctgtctgcactgtccccactcaggcgtcctcagcctctccctctgggagccaccctgaacgtcaggcttgttaggagcccttcctccatgttttcttggccccgttccttgtctcagtcatgagcctcataactctgtcctgtcgctattacatgactgtttttcctgctaagtcatgaactttgggaaacaggggccacgtccgagcagcatctctgcaggagagaccctgtgggaaactgagtcacagataggaaggccatctgtgactcaggactcagctggaacccctgtgaggtctgtcctgaccctggaggacaggaaagattgggacaagcacgaggggcttcctgtggaggatgggggtaagggggcccacaagaaggtggaggcttggggagctgcaaggctgagccacaacccacagatgggagcagaagcccagaaaagagatgcgggggccgctcgtgcttgagctccaccaaggcctcccacgctccgtgggctgggccaccctggtcggtgacatgtgtgtcatccttacgcacttggctggccctcccctagacagcagttttcttgagaaggtagtgggttcctttatctccttgctgagtgccagacaggtggtcagcatttgctgaattaaataggcctttgaagttcatttcagagcaccaaaccttatcaaccccctgccttttgtcatgaacagagaatatatgacaaagacactgtcccatctctctaggaacctacagggtagaagaaaaacagataatttcggtagaaagtgctatgtgttatggtagagttgtgctttttggagcacagaggaatccttagcctcgcctggggcaagggggaggcagggagggcttcccggagggaacacctgattgaggcttcagcttctcagaagttataaggtgaaagggaccttggacttggaatttggggttctaggaacactagggtttggaaggctcagtctcggggagcgggggccatggagtagggtgggggtatctgcaggcctgctgaggaacctggagtcttgctggaatcaggcctgcgtgtggtcaggacgtcttgatgtcgtgatttattggaagtttttcccggcagcccatcactgtgagcagagcccttctgacagacaagctctctgcccctttcctcacctacagatcgggatcctaaaagggtacttagaggcccaggggcttatcaaagcaaggaagaggaccactcattgctcacccctgtgtgctgtcctctacagcaagatctttaagcaggtgagtggcccagggctcgcctctgaggctggcgggaacaccaggtgacacggggcagaaccagacctccctgtgtgcctgggtctgtagtcagctcccatggcacattgggaactcttacagccttgatggtggtgctggggcagcgggatagacacagaaagcagctctacagatgggctggcgtgggatcagctcagagctccatccgttagccatgggatcgcctaactcctctgagcctcatgcccttggctgagcgccttgggtcagctctggactgggccttcttgatgtggagtatgagacagagtgctagttgtggggcgctttcctaggttcccagagtgggtgctgttcttgggcatctctttgcagggaagccataacttggcttttttcattgtaggaagggacggaggcccaggcagcaggcagcaccttggtcctgcgtggagtctctgggttgggcagggcagctgggcatgaggagttgcttctgaggtgtgaggataggaggggctgctgcctgaggccctctgctcactcccacccactgggacctcttgtctggcccaggctctggacaggtgcgccgcatcggctgcagaggtggccttgggctgcacaaggctggagctcaccattctgggcttctctcccatcctggctcctgccaccaccctctctcactgcctcagggctcttcagtaccttaaaaaagtttgtttaaaatttaaaaaaattatcaacttttctagatcttctcagtagggagggttggtctgaaaccacctcacttgctacttttttttttttttttttttttgccagggtctcgctctgtcgcccaggctggagtgcaatgggaccttggctcactgcagtctctgccttccgggttcaagcgattctcctgcctcagcctcccgagtagctgggactacaggcatgcaccaccacccccagctaatttttgtatttttagtagagacagggtttcagcattttggccaggctggtctcaaacttctgacctcaagtgatccaccctcctcagcctcccaaagttttaggattacaggcgtgagccactgtgcccagccttacctgctactcttgcattataacaatggtcatggtggcaaaatgtttcattgagtggcatggctgtccttattctcaacagttccctacttagggggcagttagtttatttcttatttttttgacggggtggtcatgattaatgttgtttcagtaatgtcttttccatatagggattattttctttggctagatcctgataagtgccatttctgagttaacaggtcttcaccaaacgttccagtgcgttccagtttgcactgccctgtgatacagggcagaggaggtcctgttttcaaaagtggcttatgctgtagcagggggccctgaacgtctgttttctcagtggatggaggggaggggccaaggcaggctggagaccacccttgggagtggaggccccggcctctccagcagcccccagctgtgtgctccctacaggtggtgagtggctgcctgcgcggcacagtgagtgtgtgggaggtcgtgacgggcaggaagacgatggagtttgctgtgtctgggggccagcacgtggagatgaccgccatggccctggatgagtcagagcggtgcctgctcacaggtttgcgggatggcacaatgaagatgtggaactacaacattggcaaatgcctgttgacctttcccagtccggaacagctggaggtcagtcttgcttgtcaattacagccagggacggcctcttgggaagcaaagcacagctcctttgaccctgggatgcactattttttgtacctctctgaaagggtgttcatcatagtcaggtggcctggcttcaaacctccctgagcctctgtgtcctcatgcatgaaatgaagacaggtaacagtgcctggactaatgggtttccactaaggttagctactgttgctctttaaatttgctagcacttctcattccacatactggagctttggattgcatttctagcagtgggatcagttaattcacagccacccatggtcacccctatttgggaaatgcctgatggtattatagggccagtccatgggagtggcatagggcaaagccagcagttccaccctaacttctgtgacacagtcctttaaccaactcagaaagtgtacttagctggccaggcagtggctcacgcctgtaatctcagcactttgggaggtcgaggcagggggatcacctgaggccaggagttcgagaccagcctggctaatatggtgaaactcccgtctctgccaaaaatacaaaaaaaattagccaggcgtggtggtggctgcctgtaatcccagctactcgggaagctgaggcaggacaagccgggaggtggaggctgcagtgagccgagatcccgccatcgcactccagcctgggcagcaagagtgaaactctgtcaaaaaaaaaaaaaaagaagaagaagaaagaaagtgtacttagccaagatgccaggggttgagtactgctccagatcctatcactcagtagtgacttgaccttagccaggtcacttgcccatttcccagctatcctctctgtaaaatggacatggatgcctaccctatctcactcccctaagtccatcaaatgagggaataggatgtgagaacatgatgacaaatacatggtggtatcacctgtaggtgattttcgtcatccagagatttgacttcttgcttggcacctttaggaagacatttagggcccagagccattttctctgataagttttctagttctgttttctttcatcttcaacagattagtgggattatccatatgaacaaagtgttctatgtgacaggatggagtaagagaatcactcatttcctgtgagtagaaagcatgtatggtgagtaggttccagtagctgcgtgttctctctccagatgggttcctccattcctggctttcctggtggttggaacaccatgcaggaagttagtggtggttaatgactattgcttcatctgctcatccatccatttattcattattcattgaggctaatatattcttggccttttgctaggtgcctgggatgggtataaacaagaatattggagtcttcatcctcctggagtatctatttcagtgggggaatgtcttagtccattcgggctgctgtaacagaatatcatagactgagttgcttataaacaacataaatttatttatcagagttctggagatgggggaagttccagacaaggtgccagcagatttggtgcctggtgagggcctacttcctgattcatagacagctgtcttcttactgtaaacttacatggtggaagggttaagaaatctctctggggcctcctttataagggcactaatcccattcatgagggctccatttttgtgacctcatcgcctcccaaggccccacctccaaatttcctcgccttagggattacgtttcaatatatgaattttgggagcaaaattcagtctatggcattccgtccctgacttcccaaaattcatgtccttctctcatgcaaaatatattcatttcatcccaatagcccaaaagtcttaacttgttccagtatcaactttaatgtctaagtccaaaatatcatctaaatatcacctaaataaaatatgggtgagtctcaagctacaattcattctgaagcaaatgcccctctagctgtgaacctgtgatgctaacacgttatgtacttccaaaatagaatggtggggcaggcataggatagacacaagggagagataggaaagaagaaaggagggacaggtcctgagcaagtcaaaaatccatcagggcaaatgctagtagaccttaaatctcaaagataatcctctttggcttgctgccctgcccttcaggcctgctggggtggcaattctgcccctgcagctttgcctggcaagtgactggaaccctaagactctgggcagccctacacctacagatttggggagccttgcccccatggtggctctatgcctgggccctgcccctgtggcacttccctgcatgagccccctggccctgtggggctgcaattccaaggctgtggctctgctgggagaccctgtcctttgaaatctaggtggtggaggcagccatgtcctcccagctctgctgagtgcagtccatgctgtaccatggtccacaggagccacacctagagtggtcaaggagcatgaagaatggtgcctgtgaagttaagcgatgatggtagagtgctgtggtcccatgggcactggtggccattcccttgaaaccattctgcccccagagcccttgtactctgggctggtgatgggagggacagtcctgatgatctctgagttgccttcagggtcattctttcattgtcttggagaacagcactggcttctgttgggttggctgatccatactaatctcatcaaacagtgcttggctatgtctttaatgattgtattagtttgttttcacactgctataaagaatgcctgagactggataatttatgacaaaaaagggtttaattgactcacagttgtgcatggctaggagggggcctcaggaaacttacaatcatagttaaaggtgaaggggaagcaaggcacatcttacatggtggcaggagagagagtgcaagggaaactgccacttttaaatcatcaggtcttgtgagaactcactcactatcacgagaacagcatgagggaaactgcccccatgatccactcacctcctaccaggtccctccctcaacatatggggattacaattcaagatgaggtttgggtggggacacagagccaaaccatatcaatgttctttcctgaacagcctttctcattcctttctatatggataggatgaatcttttaagttctgcttccattttttttttctttaagacatgggatctcactctgtcacccaggctggactgtagtcatgcgattatcgctcactgcagcctcagctcctaggctcaagagatcctcccaccccagcctccagagtagctagaactacaggcacatgccaccatgccttgctaattaaaaaaaaaatttttttatagagatggggtcttgctatgttgcccaggctggtcttaaactcttggtttcaagcaatcctcctgtcttggcctcccaaagtactgggttacaggcatgtaccactgctcctggattctgcttcctttttgattaacagtttggtctttaaaccatttgtctcttgttgcattttattataagttgtcaggagaaaccaggaactccttcaatatgttacatagaaatttgctcagtcaaatatccaatttcttatcttgcaagttctacctgtctcaaaacactagaacacaaatataattcagcaagttctttgccattttgtaacaagtatgacctttcctctagtttccgataacatgtttctcatttcttcaccagagacttcaccagaatggtctttaacatccatatttctaccaaaattctgttcaggattacttaggtattctctaagaatattgaggctttctctgcatctgtcctcttttctttctaggccctcactggaatcacccttaatggtctatgcatagcaatgcaagctttttctagcatggaccatccatcctctacctattacctactttttttttttttttttaagacagagtcttgttttatggcccaggctggagtgcagtggtgcagtcttggctcactgcagcctccgcgtcccgggttcaagtgattctcatgcttctgcttcccgggtagctgggattataagtgtgtgccaccacacctggctaattttttgtatttttagtagagacagggtttcatcatgttggccaggctggtcttgaactcctggcctcaagtgatccacctgtctcagttcccaaagtgctgggattacaggcatgagccaccctgcccagctgctgttacctagttctaaagccacttcccacatttttaggtatttgttacaataacaccccactcctggtaccagtttctgtctttgttcactcaggctgttataacagaataccatagagtaggtggcttataacaacagaaaattatttcttatagttctggaggaagttcttagattaaagcactggcaaattcagtgactggtgagggccacttcctggttcatagatggccattttctcacatggtagagaggacaagggatctctctgggcctcttatttttgttttagtttttttaagagacaggatcttgctctattgcctaggctggagtgcagtggcataattacagctcactgcagccttgaactcctgggctcaagtgatcctcctgcctcagcctcctgaatagctaggactacaagtgtgtgtcactatgcctggctaattaaaatttttttttgtagagatgtggtcttgctctgttgcccaagctggtcttgaactcctggcctcaaacgattttccttccttggcccctcaaagtgctgggattataggcatgagccaccatgcctagcctaggacctcttttataaaggcactgattccatttatgagggttttgcccttctgtcctaataaccttccaaaggccacaccttcagatactctcacattgaggattaggttttaacataaatttttggagaatatgaatattcagtttgtatcaagaaggcaggtactaatcaaatattaatactttcatttataattataaagtatattcagtgctgtgaaaaaaaagtaggagtttctatgggggttgaatgggtggaaacctgatttcttcttgggggcggtggtcaggaaaggctcagtgagggtgttgtgggtggagtgcaatctgaagcgtgagaaggaagggtctctgtgaagtctttagggtaggatgagcattccaggcagaaggcacactatgttcaaggtccctttctttttagggacctctgtaaggccacaatgtccccccccctttaaaccttaatccttacctaggtgtctgactgggggtgtattacacattgactatctgtaagattagtttatgtaaagcccctacaacagggcctttgtagaaagcatgtagtaagcgcttagtaaatgaggtcaatgggacatggcttcagcccagctccgacacctgagagtatcctcctctgagtcggctcccagaatcctcaaggctccagtgcttccccaatggatggagcattacaggctgagctctcagccctcctgcctctggccatatgcacaggttccacaagaccaagccagtgctcttgtgctaccactggcagacctaccacacggaggacatcctgagcatggccaagtaccggaaccagttccttgggacctcctcctacagtggggacatcctcttctggaacaccggcacactcaagcccatcttcaacttcaatgcctctaggagcccctcgcccttgcagcccaagagggtatgttaacaggagcacactctcctcccacccttctctcagctgtgaaccagaatcctgtggggcagggagggtggggagcaccctgggaagcaggagggatgatggcgacttgttctggatggggtggggagcttggttaggtaggtggtagtttctgtaattatcctcattggacagatgagaaaatggaggcacacggagatgaagcaccttgcctaaggtcacacagccaagaaggagtagacccaaacccaggcagtctgacttcagaggctggcagtgctggtcctccatctttagtagattactcgctcctttcccattgctactacacattaccactgtgggctccccagcagggacttaggaaacccatacagtctccaaattcccatatctcagcagatcaaagcaggaagggaccttaggggccgcctcatccaggggttttccaaatgtactggagagagatgcttggaagctactgcaggggggctctggtaggtggggtttcccccagaatagctcagctttttatctgttttatgctttggagcttccattgagattaaaggtagcctcaaaaatatttggaaaccactgtccattttacagatgagaagacttgagttcctcatgggagcagtgtcctgcctgtgggtactcagggcattgcagctggccaggaatggggttagaagctctggtctgatgcctttaagggggctaggtttctgggaagcaagccctggggggctggagggccctgtggtgttggcattgatctggggcagtcctgaatttacctctacgacattgcagtgccttaggggctgctttcttcttggtacaggtgcaagatgtgaacaactgcctggctgagagccacaggcccagcagaccctatgtggagcgggagaagtggacatacaagacctccaggaagctctccagtctcagccccgagtctgtggccaataccaacctgaggcggagcctggtgtcggctcccccagtgatgcggtgcccgagagacaaggagccagacaggcctgtgccccagcaggtgggagcgagagcccaaccagaaggctaccctcactctctagccgccggcgttcacacaccgtctgtgtgtgtgttttcttattgggatgtactttttccaaagtgcctttaggtccctcaactcacttgttttgagcattgtgggcctgggcagggcaccctctggttttagtcccaatgtatctatcctggagctggggctaggtccctttccagggcatggctaataccagccctaaaagtctgaaagctgaaaggcaggacccaaagagaacacaaccctgaaaacctaaaattggatgttagatcctgggctgcattctcagtcctcaagggcaagtcacctgaccttggcccaggtgcagagggagccatggggtctcacctgcttggagaccaggctgtaagagtctgagacccagacacagacaaaccactttcctcctcctctgagcctcatctctgccccaggactagcccttccaagaatggctgacagttctattttgcggggagtagggagaaagagcaggaggagttactgtttccctacttgcaggggatggcttgcctttgaactttcagcagtgagtacagtattccaacaatcagtgcaataatctcttgtatggggcaggaggaaccagtgagattgttctcgtagtcaaaatctgatttccattcctgggagctgaggcttgagtgagaaacaccaccgtccccaaacacacaataattgctaggcatagggcagtctagacctaaatccaacatggtctgctaggatataattttgctgtaagacgtgtacacttgaccataagacattcataccatctttgagttatcagaggttacaccactgttttcaaatcttctagggaaatgggtgcataggtatatttgcccctctatccttatttttatttttattttttgagatggagtctcactctgtcacccaggctagagtgcagtggcgtggtcttcgctcagtgcaacctctgtctcctgggttcaagcaattctcctgcctcagcttccctagtagctgggattacaggtgtgcacaactatgcctggctaaattttttgtatttttattggagacggggtttcaccatgttggccaggctggtctcagactcctggcctgaaattatctgcccgcctcagcctcccaaagtgctggaattacaggtgtgaaccaccacgaccgacctttatcctcatttttaaccaggatggtctcttccaggacaaaggaagcatcttccccagaggcaaactcaagtctctgccccaattttgctctagcaaaattgctgggagcttaaagtggaggtttccgggatccactgagcgctgcttttcccaggccagtgtacctactgcgggggcttgggagtgccgctcttttatcatcttcctctggtctctggtcccctatggggaagggaaacaccctcatggtgacttgggtgcccatctttctttccagaaaccttccagtgcttctggcacatccaggcagtcaagcaagatccacagcaaacagtccatttacaaagaggatgaaacgagaaaaggagaatggcagaagaatatgttggttcaatccagtgcctcggtggagaaggttggccgtgatcagccagggagagggatatgagctggggagtgggcggtcaggattgggtggtcaggatggggctcgggggcctgggctcggggcccggcctgattctccccagtgcccggaaggcatcttggagaggatggagacgctcaggatactggagtcagggctgcggtgtctggggagagctcctgtattaattcgttttcatgcagctgataaaggcatatccgagactgagaagaaaaagaggtttaactggacttatagttccatatggctggggaagacctcacaatcatggcgggaggctaaaggtgcttcttacatggcagcagcaagagaaaatgagaagcagcaaaagcggaaacccctgataaacccatcagatctcgctgagacttgttcactatcatgagaatggcatgggaaggaccagcccccatgattcagttacctccctcttggtccctcccacaacacgggggaattctgggagataccattcaagttgagatttgagtggggacacagccaaaccatatcagctcccaaggaggtggagttggggtgcctagggaagtgagcagtgtcccctctggattgggggtaacagtgtcccctctgggaggggaggtagggaggtaggagaaggggcatctccagactctagttagaatgccctcctgttaactggaagggtgttttataccgaacacgagttgggtatgggttcatctttgttcttcctactgtaccttcccctttctgaccctggacacccctcactgtgatactgactccccgtcctgaaaatacaaatcatagttgagttagggtgtggctggcctgccccatcacccaggtccagggaccaggacttgagaacaagagggcagtgccctgagagctgggttttgcagtgttgggagggagagcaggagtggctgcacactctcctccaggttctgattatttctctctcctttttttttcttgagacagggtctcactgtcacccaggctagagtacagtggtgtgatcacagctcattacagcctcaactcctgggctgaagggaccctcccacctcagccttgtgagtagctggggctataggcatgctccattatgcccagctattttgtgtgtgtgtgtgtgtgtgtgtgtgtgtgtttttgtagagatggggtctcactatgctgcccatgctggtctcgaactcctgggctcaagtgatcctcctggctcagcctcccaaagtgttgggattacagatgtgaaccattatacccagcctcttccttctctttaaaaaaataccttagataacttttaaaagtaataatactagtttataataaaaaaggaagtgtatgtaaatgaaaaaataaaaataaaagtcccctatatctcactcaccctatcccatcccactctcaacagcagcattcgctgctaacaggttggttttagccttgtacttttttttttttgactagtaatataaaatgatagctatgtcctgccatatgcttttttctgtaagtctatagcatggatatactttcatgagagggatttagattcatcttattcttttgttaccttattctttttttttttttttttgagacggagtcttgctctgtcacccaggctggcgtgcagtgttgcgatatcagctcactgcacctctgcgtcctgagttcaagtgattctcctgcctcagcctccagagtagctgggaccataagcatgtgccaccatgcccagctgcttttttatttctagtagagtcggggtttcaccatgttggccaggctggtcttgaactcctgacctcaggtgatccactggcctcggcttcccaaagtgctgggattacaggcattagccaccacacctggccatcttattctttttaacaactgcccactgctgcataacttggatgcatcaggaactgtgaagctggtcctctatgaataggtctgtgggttagttccagtttttagcttttaggagcagcactgcattgaacattcttgcacgtacatttctgggcactagtgtgagtatattgagaggacggattcttggaaacagaattgccaacagatcccatctctttaaatctgtgaagtcaaggtagatggctcaaagcttgatcttttgggctagtgacctagtgctgtcaggacacaggcattcgctacatgccagccgctggggaaggagcagtgaatgaaagatatcaagcccctgacctctggagctgtcattctagttggggcaagatagacaattaaccagcaaataaaataaagggcatgtcacagagtgagtgaggacaatggaggacaagaaagccgggaagatggcagggagaacagacatgggaggagatggcattgctgttttatgaataggctggtcagggagggcttcacagaggaggtggcatctgcatagagcctgaaggaagcgaggaaacatggcctgcagttatttggaaggagggtgatgcaggcagagaaggtaggtgcaagggcccacatgggagagctggcatggaatgttcgagaatgagtacttctctctctctctctgtatctctctctgatactttcttcctctaattagaaagtgatacatgtccttaattaaaactaaaaaaattcaggccaagagcagtggctcacatctgtaatcccagtcctttaggaggccaaagtgggaggactgcttgagcccaggagttctagaccagcttgggcaacatgatgagacctcatctctacaaaaaattaaaaaaattagccaggtttgatagtgtgcacggtgcacccagctccttgggaggctgagttgggagaatcacttgagtctgggaggtcaaggatgcagtgagctgtgattgtgccactgcactccagcctgggcaacacagctagaccttgtctcttaaacaaacaaacaaacctggcccagtgcgatggctcacacctgtaatcctagcactttgggaggctgaggtgggcagattgcctgagctcaggagttcgaaaccagcctgggcaacacggtgaaaccccgtctctactaaaatacaaaaaattagccaggggtggcagcatactcctgtagtcccagctagtcgggaggcagaggcaggagaattgattgaacccgggaggcggaggttgcagtgagctgagatcgtgccactgcactccagcctgggtgacacagtgagattcgcctccaaaacaacaccaccaccaccacctatgaaaaaaaatgaaactttatacgagtgtataaagtaaaagaatggctgtctccctcctcagcctccagaggtaattacgttaagacatgtgttgtagccttctagaatttttttgtgcatatacaagtacatacatgtatgaatgtatatatataaatctagatatttttcactggataatatcatattgcatgtattattccgggacttgctgtttttcacttgactcctcacgggcatctcttcatgacggtgtttacggagccatggcattccttttactagtcacatcatgtcctgggtacactgcacagagtctgtatagctatctgctgccgctgggttttgcctctatagaaagcattgcaatgaatacccttgtacataaattttggatctcttgtctatttccagatataaaactctaggattagaaacatactcctggaaagcttttgctatcttgcattatgtttcagtggtagctagtaattattgagctctcaatatctgccagacaatgaacttaatggtttacatgtgttattttttgttttttgagacagaatctcagctctcttgtccaggctggagtgcagtggcacaatcacagctcattgtagcctccacttcccaggctcaagcgattctcccacctcagccttctgagtattaatagctgggaccacaggtgtgtgctactgtgcctggctcattaaaaaaatatatatttatagagatggagtctccttatgttgcccaggctagtcttgaccttctgggctcaagcgatcctcctgccttggcctcccaaagtgctgggattacaggcataagccaccatgcccagctacatgtgttgtttttattttgtccatcaaacagccctgggaagtatgtactattattatttatttatgagggatttttatttatttaatacatctgaaaagaatgtatgtgaaaagaatgtttaatacatctgaaaagaatgtactattattattattcccattttatggctgaagaaacaggcccaatgaggtgaagtgacttgcccaagattcttatggccagaaaatggcagagccagggcctgattctaggtctatttgttttcaaagttcaagttcttttaagtttttgtgctgccactgttgggaattccttgggctttttacgtggcctggtgatctgtgtgtaataaggatttgtatcatgaatcttgattgaatttttggccacagaattgcatgcaaaagattgaatgtctattggtgagatttgaggcactgtggctggcagggctgtgtgtgtgtgtgtgtcccctctggatgctgaccctcacccctggcttcaagatgtactgtctcccacccgcaccactccttgaggagcagggtcccttctctctggggcacttgtgggcacagtgaagcattttagggtggtgccctggagagggtccagagtgcttgggtcatctctgatctcagcctttccttagtggaagagaggcttgggtgggctggggtaaggacaccagacagggagtgggtgggggtcttacctgttgggtcttccttcccattatttctgtctggccatcccagaagactgtgaggcatggcagaaagagcactaggaaggagtccaggatgcagatccaggcccagctgtgtccctgacagtctttatttttaattttacttatttatttatttttgagatggagtctcactctgttgtccaggctggagtgcagtggcgtgatctcagctcactgccacctctgtctcctgggttcaagtgattctcgtgcctcaacctcctgagtagctgggattacaggtgtgtgccaccacacctggctaattttgtgtttttaatggagacagggtttcaccatgttgtccaggctggtcttgaactcctgaccttaagtgatcctcttgcctcagctttccaaagtgctggcattacaggcgtaagccaccacgcctagctaattttgggtttttagtggagacggggttttgccatgttgtccaggcttgtctcgaactcctggcctcaagtgatcctcctgcctcagcctcccaaagtgttgggattacaggcgtgagccacggcgcccagcccctgacagtctttagatgaagcacttgcccctggccatctccccagtagggaaggaccagatggcacgcagtagaaaattgctccaagttacatgaagtttagcccgtgagtagcttgccatggctccttctgaagggacccacagggaggccattaacccgctgtggttgagatactatctgggattcctgggctgagtgagactgaaatgctcaccttcagtccagcagctctttccaaaatgagcagggcaatgtattggatggggctggatgcagagtgcaaaaggaatagtgttggttacctgtccctcgcagccacacggctctgtcctgcctagggccaccattctgactgtgcttttctcactgtgagcaccggatgctggctacgcagttgaccctgtgctctcagcaggccgcccctctccagtcctgctgaagtcctgggcgctcattcaccttcaccctacctgctctcaccgtcccagggctggcaaaggaatggctgggaaggatgcctcagcttttccccagttcagacatgggagaactttgtggtgcatcactttggtgaatcctgtgcagttatgaggaaccacattttagaaaaatacttaatcattggaatgtgcttatgacaaaatttaaagcacatcctttaaaatgacagttaatgactactgtgaaagttgtgtgcacgttaaatttttttttatggttttgatttttcaaacaaaactgagaacgtttgaaactattgtttatttagctgtttgcttttttttttttttcaaaccttgcaatttgtggtggacagtttttcctctcagcacataataatctatccacttcattctttttttttttattatactttaagttttagggtacatgtgcacaatgtgcaggttagttacatatgtatacatgtgccatgctggtgcgctgcacccactaactcgtcatttagcattaggtatatctcccaatgctatccctcccccctcccccgaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtataccacttcattctttttaatagctttatatagggacctatctaggttttttggagcctaaaacttttgcaagaaaaatgcacaaaattataaaaaattaggtacaaaagtgaatatttatttagaatgagaaaaaagtgtcaacaaatttcaaaacttataaatctgacaattacaaaagtcaccagaacttaccagttctttcctagaaccttgaacttaaacttgaacttagccttgagcttcatgaacttcacgagtaaatctgccactggctgcagtgtatttctttggattcaccatgatttgtttatttatttatttatttaatttaaaatttttttgagacagagtctcactctgtctcccaggctggagtgcagtgacgtgatcttggttcactgcaacctccgcctcccaagtaccagcaattcttctgcctcagcctcccgagtagctgggattaaaggtgcccgccaccatgcccagctgatttttgtatttttagtggagacagggtttcaccatgttggtcaggctggtcttgaactcctgacctcaggtgatccacccgccttggcttcccaaaatgctgggattagaggcgagagccaccatgcctggccaaaatacattaaagtcttaatggtgattatttctgggtactgggattttgtaggtgattttaatttcctttcatatgtctatgctgcccacattttgtacagtgagcacttgcataaagtgggggaaatgcttgccctttgtctttggttcagggattcctgttttttctttttttcaaaaaatttttcttgtagtgaaatacacataacataaaatttaccattgaaaccatttttaagtgtatggttcagtggtagtaaatatattcataatgtgcagccatcaccactatccattcatcttgttaaattgaaactatacccattaaaaaataactcccactcccctctccctccaaaccctggaaacccccattctactttctgtctttatgattttgactattctacctcatgcaagtggaatcatatgtttgtcttttggtaactggcttatgtcacttagcataatgtcctctttgattaattcccaagtattttactctttttttgacactattgtcaatggaattatttttgtaatttccttttcagattgttcaacgttagtgtatagaaatgcaactgattttttatttttttttttttgagacagagtcttgctctgtcgcccaggctggagtacaatggcacgatctcggctcactgcaccctctgcctcccaggttcaagtgattttcctgcctcagcctcatgggtagctgggattacaggtgcatgccaccacacctggctaatatttgtattttttagtagagacgggctttcaccatgttgaccaggctggtctcgaactcttgacctcatgatccacctgcctcagcctcccaaagtgctgggattacaggcatgagccaccgcacccagccaatgcgactgatttttatgtgttgactttgtatcctgccattttgctgaattcatttgttagccccttttttttggtgtgggagctttagcgttttctacatataagataatatcatctgcaaacttataattttacttctttctttccagtttggataccttttatttctttttttgcctaatccctctggcagaacttccagtactctgttgaataaaagtggcaaaagtggacattcttgccttgttcctaattccagaggaaaagctttcagtcttttactattgagtgtgatattcattgtgggtttttcatatatggcttttattatgtttaggtaatgtccttctattcctattttttttttttaattttgtcaaatcgttttctgcatcaattaagatgatcgtgtgggtttttttctttttttgtgaaggtggtatatttattgatttttatatgttgaatcatccttgcattccaggaataaaagtcacttggtcatggtatataatccttttaatatgctactgaatgcagtttgctaatttttttgataatttttaaatatcagtgttcataagggatatttctctgtagtctttttttttttcttataatgtctttgtctgactttgatatcagggtaatgctggcctcatagaatgagttaggaagtgttatctcctcttcagtattctggaaaagtttgggaaggattggcattcattcttccttaaatgtttggtagaattcactggtgaagccatcaagctttgggcacaagggacttctggtttttgaccctggcaccggggccagtgggaagcaggttgaacaactaatttcggatttctacaacaataaggataattgagatttttttctttcttttcttttctttcttttcttttttctcccttccctcccctcccctcccctcccctccgcttctcttcccttctgtttttttttttttttctttaaatagagatagggtctcactatgttgcacaggctgtctcgatctcctgggctcaagtgattcacccgcctcggcctcccaaagtgctaggattacaggtatgagccaccatgagatttttgataatcgagatttttgttgttggtgacatgttttggggacacataagctattacactgtaaagttctgagcaggagtgaggaagcttccaatttcccccttctggcctgatttgctctaccaccctcactatgctctcagcctcctgctgggtgccaggcaagaaactttcttctcatgcttgccatgcagagtaacttcccactgtggcccccacatgggccacaggtgtgacatgtaagggaaaagtgagcagagtgaggaattagcaaagggcatgatcaaaacaagtcttgaacaagaatttgtttaaaatgctttcttgatgattggctggaaaatatggatatttcactatagatatacatgaaggggaatgagttccttccccacatcactttgggttgagttacaggttgtgaaaatcttgtctgagcctatgtcgaatcaaacttgtaagccttcatttgataaacatttattgatcatgtattatgtgtcaggcaccattgtggttactaaggacaaagtagtgaacaaaaaagacgcaaaatccctgccctctagtagttcatagtcgagtatgacgttccttgtcaccagctggggaggaagggtgggaccaccatcaccactttcactgggcatctaggaaactgggggaccaggtgggtgtggtgacttgctgaggtccctcagcaccatgtgacagtggctcacagccctgctgagccgggccctcctctcttcctcagataatcttcctgcagaccaggcctcgcctgccgcacacggctgccctgctgagcagctgcatggacggctacatctacgcctggtccctccatgagaatggaggcctgctggggaagttccctgtggacctagacaatggggatgttgtcgtgggtgccatggccactgataaaaatgactggatcctcatcacgggggattgtaaaggatacatcaaggtgaggaagaactggcaggaagattgaggggctggtgccagctaagtgttcggccatctctttgctcacatggcccttgcctagttcctactctgtctgggtactggttccatttgtgaaacaatgcagcgaggagtcctctcctgctctgctaagcccagtgacaggagcgggtcttggttcaaaaagcccctctgagaagccttccctggagaattccgtgctccatcactgtcttctccaactccctcatcccgaagtcatgtggctaatctaggatcagctgtctcaggagctgattgtgtgccttgtggcaagacatgaggcaggggtgtgctgtccttgagccggtcacacccttcctgcctgctaatccaggagtatggcctagaagatccctaaggccctttctggccctagtggtgaggtatctcagagatgtaagtaagaactgccccccacccccaccaaatgaagaggaatggtctgggaggagcccgcagagtgagttggggtctgggtcaaggggtgtgaggccactaacccacactttatgtctagatctgggacatcaaggattactgcgcattgattgataaacagccattccaatccagtggggccaaggttgtctctgaagcacacaacaagttccggttgttaattcctcagcaacttgggaccaacttcccacactacattcccttggaggataaagaggtaggaggattactggagagttgctcaggaaagtgcctttgagccccacaaatgagctaggaccataaactaactcatacccaagagaaatacacttactaaaagataagagcaaaaatattgatagaattagtattcgtggccagtcgtggtggcccacgcctgtaatcccagcactttgggaggctgaggcgggtggatcacgaggtcaggagtttgagaccagcctgaccaacatggtgaaaccctgtctctactaaaaatacaaaaattagccgagtgtggtggtgcactccttgtaatcccagctactcaggaggctgaggcaggagaatcgcttgaacctagaaggcagaggttgtagtgagctgagatcgcgccattgcattccagcctgggcgacagagcaagacttcgtttcaaaaaagaaaaagagttagtattcgtaataatgccacattagaaacaactcaaatgcccatcaccgtagactggaaaataaattacaaataaattacagtgtaatatctggcaccagaagtgaatttactcactacaaaatggagaactcttcaaacaatttaggcaaaagaagtcagacccagaagaacatatattagaaatgattgtttttgttgggggagtggagaggctggaaggaatcatgaaggggacttctggagaggttggcagtgctctgcttcattaacgggcctgatcatgcagttgtattcagtttctaaaaatttattcagtggtgggccgggcacggtggctcatgcctgtaatcccagcactttgggaggccaaggctggtggatcatctgaggtcaggagtttgagaccagcctggccaacctggtgaaaccctgtctactaaaaatacaaaaatcagctgggtgtggcggtgcacgcctgtaatcccagctacttgggaggctgaggcacaagaatcacttgaacccgggaggtggaggttgcagtgagcctagattgctccgttgccctccagcctgggcgacagcgtgtgactctgtctcaaaaaaaaaaattattcagtactacacttatatacgattttctatgtgtatatcatacatcaatgaaagttttaaaaagtcaggtaacgtaaaaaggcttacagcgaagagtctaagtcccattcctgttcccccaaacagttcatgctccctgaagtaaccacgtgtgttgatttttggttattcctctggtgtttacttatgcaaacacgatgtgtaaagttattttctactgaaggtatcatttcacttatactggtactcatcttgcttttcttgctgtatgatatatcttggagacctttgcatagcagcactatcccattttaaggtaaatttgtctttaaaaaaatcttacacaaaagtgaatagtgaatgttatttcacatatgtgaaggcatttctgtaggagatgttcttggaagtgggattgctaggtaaaagggttacatgcatttgcaattttgatagccttcttgcagtcttatgtgccttttgaatctctacatgagtatgttatggctagttcgttttagtatgaagagaatgtcattatattaaaatgtcttgggaactgattacccacagtgtcagtatgtgaagaatttataatgttgatacaatcatcatcataataatatttatttactgcttgcaatgttccagggatggtgatagtatattatatatgcattcattaatctccataatgacttgtgagggagatgatgtttttcagatgaggaagtaatgaaactgaagagctgagagactcgtctaagctccagtagcaaccagtgtagacctgagactaaacctaagtctgtctgactccagaatctgtgttcctgaccatctgctcttagttttataatgatatattttaaacaattgggattatattgtatgtaactggaatttcctataccatcaagtattcttttttctttaaaaattttattgtttcaaatagataaatcataattgtagacatttctgaggcacagtgtgctgttttgatctatgtacacatgtggaatgattaaatcaagccaattaacatatctaccacctcacttacaatttttatggtgagacatttaaaatttactcttagttatgttgaagtatgcaatatattactgactatagtcactctgctgtgcagaagatctcaaaactttttcctcctgtctgaccaaaacttggtacccctttgaccaataacttcccattctctctcccttattccccaccccaccctctaagcctctggtaaccatcattctcctttctacttctttttaaaaacctctttttggccgggctcagtggctcaagcctgtaatcccagtactttgggaggccgaggcgggcagatcacctgaggtcaggagttcaagaccagcctggcccacatggtgaaaccttgtccctactaaaaatacaaaattagccaggcatggtgatgcgtgcctgtaatcccagctactctggaggctgaggcaagaaatcacttgaacctgggaggcagaggttgcagtgagccgaggttgcgccactgcacttcagcctgggcaacaaagtgagactccgtctcaaaaaatcaatcaatcaaatcaaagcaaatcaaaaactttttttttttttttgtagagatgaggtctatgttgcccaggctggtcttgaactcctgggctcaaggaatcctcctgccttgacctcccaaagtgctgggattacaggtgtgagccaccgtgcccagccctttctacttctatgagtttgactttttataattccatatataaatacaatcatgcagtatttttctttcatgactggcttatttcacttaccataatgtcttccagattaatctatgttgtcccaaatgacaggattttttttctcttttaaggctgaatagtattccattatgtatatacaccacatttgcattatccattcatccactgatggccccttaggttgattctatatcttggctattgtgaaaagtgctgcaatgaacatgggagtgcaggtatttctttgacatattgatatgacatattgatctcttttggatatatacccagaagtggaattgctagatcatatagtagttctaattttagttttttgaggaaaccccatactatttctcgtagtggttgatatggtttggttgtgtccccacacaaatctcatcttgaattgtagctctcataatccccagctgtcgtgggagggacctggtgggaggtaattgaatcgtgggggtgggtttttcccaccattctaatgatagtgaataagtctcaagagatatgatggctttataaagggcagttcccctgctcatgctctcttgcctgctcccatgtaagacgtgcctttgctcctctttcacctctgccatgattgtgaggcctccccagccatgtggaactgtgagtccattaaacctttactttataaattacccagtctcggatatgtctttattagcagcatgagaacagaccaatacagtggttgtactgatttacattccctccaacattgtacaagggttttcttttttctgcctcctcaccaacacttgtttcttgtctttttgataacatctaatctaacagatgtaagatgatatctcattgtggtttaatttgtttttcctaatgattagtggtgctcagcattttttttcttgaacctgttggccatttgaatgtcttcttttgagaaatgtctctttggatgctttctccattttctcttctcttctcttttctttctttctttctttctttttttttttttttttttttttttgagatggcgttttgctcttgttgcccgggctggagtgcattgatccaatcttggctcactgcaacccccgcctcccgggttcaagcaattctcccgcctcagcctcctgagtagctgtgattacaggcacaggctaccacacccggctaattttgtattttcagtagagacgaggtgtcaccttgttggtcaggctggtcccgaactcctgacctcaagtgatctgcccgccttggcctcccaaagtgctgggattacaggcatgagccactgcacctggccactttgcctattttattttattttgagatggagttttgctcttattgcccagactggagtgcaatggcgcaattgcagctcaccacaacctccgcctcccaggttcaagcaattctcctgcctcagcctcccaagtaggtgggattacaggcatgcgccaccacgcccaactaattttgtagttttagtagagatggggtttctccatgttggtcaggctggtcttgaactcctgacctcaggtgatctgcccaccttgcctcccaaagtgctgggattacaagagtgagtgcacctggcccactttgctcattttctaattgggttattcgttttctggctattgagttgtttgagtttcttatttattgtggatgttactcccttatcagatgtatgatttacatatattttctgtcactctgtgggttatctctttactttgttcattgtttcctttctgtccaaaagctttgtatcttgtctaaaatcccatttgtctatttttgcttttatttatttttatttttatttttattttttatttttttgaaacggagtcttgctctgtcacccaggttggagtgcagtggtgcaatctcagctcactgcaacctctgcctcccaggttcaaggaagtctcctactccaacttcctgagtagctgggattataggcgtgtgccaccatgcctagctaatttttgtattttttggtagagacaggatttcaccatgttggccaggctggtgttgaactcttgacctcaggcaatccgcctgactcagcctcccaaagtgctgggattacacgtgtgagccaccgcgcctggcctatttttgcttttattacctgtgcttttggggtcatagctaaataaccattgctcagatcaatgtcatggagcctttcctctaggtattcttctagttgttttacagtctcagatcttatatttaagactttaatccattttgagttgattttttatactgtgtgagataaggatccaattttattcttctgtatgtggatccaattttcctagtacagtttattgaaaagactgtcttttccccattatgtattagtaacacctttgtcaaaaatcaattgactattagtgcatgggtttatttctgggttttctatcttgttacattagtcgatgtgtctatttttatgccagcaccatactgttttgattatattagctttataatatattttgaaatcagggactgtgatgtctttagctttgttctttttgctcaagattgttttggctagccagggtcttttatgattgcatatgaatttaaggattgttttatttctataagaaatgacattggaattttgatagggactgcattgaatctgtagattgctttgggtagtatgaatattttaataatattaattcttctaatttatcaacacaagatagctttccatttatttgtgttttcttaaacaatgttttagtttccagtgtacagatcttttaacttcttggttaaatttacccctaagtattttattttattttaaaatacctggctaattttgtatttaattttatattgtatttattttatttgtaataaaattaagcattttattttattttaaaatacctggctaattttgtatttttagtagagacagggtttctccatgttggtcaggctggtctcgaactccagacctcaggtgatccgactgcctcggcctcccaaagtgctggtattagaagcatgagccactgcccactgcacctagctgaaaaccacactttctgttgattaaataatatttcaccttatggagttacaaattttcattttatggggttataatcacttacttagcttgttatcttttgttggacattaatgtggtttctaacttttcattatcaaaaaataaaagaaaatggacaaaacctcagaaagacacaaactactaaagctgacttaataagaaatagaaaatctgaatatatagaaaatctgaatgtaacaagtaaggagattggattagtaataaaatttcccacaaagagaagtacacattcagatggtttcactggtaaattctaccaaatatttaaagatttttctttttttttgttgagacagagtctcactctattgcccaggctggagtacaatggtgtgatcttgactcactgcaacctctgcctccggggttcaagtgattctcctgcctcagcctcccgagtagctgggattacaggcatgcaccaccatgcctggctaatttttgtatttttagtagagacagggtttcaccacattggctaggctggtctcgaactcccaacctcgtgatccgcccaccatggcctcccaaagtgctgggattacaggcgtgagccaccacacctggctaaagaattaatgtcaattgctcacaaactcttccaaaagagttctctatgaggccagtattaccttgataccaaaaccagataaagatatcacaggaaaataaaactgtagaccaaatatttttatgaatatagatacaaaaatcttcaaaatactagcaaattgaaaccaacaacatatgaaaatgattatacaccatgaccaagtaagatttatcccaggaatgcaaagttggctaaatatccaaaatcaattaatgtaatacaccatattaactgaataaaaaacaaaagccatatgattatgccaatagatgcaaaaagagcatttaacaaaattgaacaccgttttctgattgaaacacccaataaactagaaatagaaactccttcaacctgataaaagccatttatgaaaactcacaggtagcataaaacttcatgttgaaatattaaatactttcctgtaaaatcagaaataaaacaagaatggttactcttgccaccccaatttaacattttattgggaggtcagttaggcaagaaaatgaaataaaaagtatctatattggggaggaagaagttaactatctctatctgcagatgacataatcttatatctagaaaatcctaaataatttattaaaaactattaaaactaataaattcaatagggttgcttgatataaatatacaaaaccaatatatttatatacactagcaataaacaatctgaaaatgaaaatttaaaaatttcacttataatcgcatcaaaaaaatacttaggaataaatttggaaaagtagtgcaaaacttgattcctgaaaattgcataacattatgggaagagatgaaagaatacccaaataaatggaaatacatctcatgttcattgattggaagactggatgttgttaatatagcatattccccaaattgatttaatgcaatttatatcaaaatcccagctgctttctcttctcttttctcttcccttttctttttcttttcttttcttccttccctccctcccttccttccttcctttctttttctttcttttccttcccttccttccttccttccctccttccctccttccctccctccctccctccttccttccttcgtttctctctttctttctttctctctccccaacttctttcttttttcttttccttccttcctttctttctctctttctttctctttctttctttctttctttctttctttctttctttctttctttctttctttctttctttctttctttctttctttcctctctctctctctctctctctctttccctccctccctgccttccttccttccatattctctctctctctctcctttttttttttgttttttgttttttgacagagtcttgctctgtcgcccaggctggagtgcagtggtgcaatctcagctcactgcaacctccgcctcccaggttcaaacgattttcctgcctcagcctcccaagtagctgggactacaggcatgtgccaccatgcctgactaatttttttgtatttttagtagagacggggtttcactgtattggtcacgctggtctcaaactcctgactttgtggtccgcctgccttggcctctcaaagtgcttggattgcaggcatgagccacctcgcctggcgggctggctttcttttcttccttccttccctccttttctccctcccttcctccctcctttctctctctgtctctctttttctttttttctcccttccttccttctctctctctcttttttttttcttctatttgacagagtcttgctctggtacccaggctggagtgcagtggcgccacctcggttcactgcaacctccgcctcccagattcaagcgattctcctgcctcagcctcccgagtagctgggattacaggtgcccgccaccatgcctggctaatttttgtattttcagtagagatggggttttgccatgttggccaagctggtctcgaactcctgacctcaggtgatccactcgcctcagcctcccaaagtgctacgattacaggcatgagccactgtgcctgcctgcctgcctgcctccctccctccctccctcccttccttccttccttccttccttccttccttccttccttccttccttccttccttccttgctttttggagatacaagggatatagatagtaagaaaaaaatcttgagaaagaacagagttgaaggactcacaattcccaagttcaaaactgaatatgaagttaagtaatcaagacaatgtgatactggcataaagaaagacatgtaaatcaatggaatagaatttagagttaaaaaataaattctcacattatgatcaattgatttttgacaagaatgctgagacaatcaaatggggagaaataatatattttttaaaacatgtcctgctgggacaatagggataactttatctgtattagaagaatgaagttagactcctacctcataacacatacaaaaattaactccaaatggatcatagacctaaatgtaagagccaaaattataagacttttagaagaaaataaatggaaaatacttgtgaccttagacagtgtgtcttagatatgacaccaaaaacaagctacaaaagaaaaaaacagataaattggactttgtcaaaattaaaaacttttgggctgcaaaggataccgtcaagaaagtgaaagggtaacctgaaagaaaatacttgcaaatcatatatctgataagggactagtatccagaatatataaagcactcttgcaacttgataaaaatgataaataaccaaattaagatacgggtaaaggatctaaataaacatttcttcaaagaagatgtacaaatggctaataagtatattaaatgatggtgaacatcattagctatcagggaaatgcatattaaaactataatgagatcccactttacacttgccaggataactatagataatagcaatggttggctgggatgtggacaaactgggactcttacacattgctggatagaatgtagaaagctggccaggtacggtggctcaggcctgtaatcccagcactttgggaggctgaggtgggcggattatgaggtcaggagtttgagaccagcctggccagcatggtgtaaccccgtctctactaaacatacaaaaattagcagggcatgatggcgggtgcctgtaatcccagctactcgggaggctgaggcaggagaatcgcttgaacctgggaggcggaggttgcagtgagcagagatcatgccattgcgttccagtctgggcaacaagagcaaaactccaaactctgtttaaaaaaaaaaaaagaaaaagaacatagaaagctgcagtcactttggaaaacagtctggcagttcctcaaaaattaagtgtagacttaccatattacccaacagttccactcccaagtgtatacccaagagaaatgaaaacatatgttcacataaaatcttgtacatgaatgtttatagtagcattatttataatacaaaagtggaaacaacccaaatgtcaacttccaaatggataaagtgtggtatggtgatacaatggaatgttatttaataataaaaaggaataaagtactgatgcatgcaacaacatggatgaaccttgaaaatactgtgctaagtgaaagaagccaaccacaaaataccatatattgtgtgattctgcttaaatgacatgtccagaatgtccatattaaagtagattagtggtttcctgaggctgggggagggagttggggaaattgcgtagtgactactgggtaaagagtttctttctggggtgatgaaatggtctaaaatagaatgtggtggtggttgcacagctctgaaaatactaaaaaccattgaatgagcactttaaattggtaaatttttatgtgaattatgattcaataaagttgtgtttagatattactaaaaatgatggtacaaatattctttttcacaaatgttttttgttgttgtttatagttgtttatttgtacatctagtaatttgtcccaaggaaagagtatgtaaaagaacataagtcactttaaggcctttaatgtatactacaaaattgcactctagaaggtttatacagttttgcatttcattagcctgttttttttatctttgacaacctaaagaatttattagtggtattcatctgaggatcctctaggtctatcagagtgtctttcttatagaaggcattcaataaataaatgtcctaagtgagcaaaacatttttggttgatttttaggtgcaaatggtttcttttgattttaattaagatgcctttgtttattagtgatgttgacatattttcttaatctattggctttgtataactttatgaattgtctcttcatgtcctttgcctacttttctattgtggtaactatcttttataaatgttgtataattatttaaaaatacattaggttgggcatggtagatcatgcctgtaatcccagctctctgggaggccaaggtgggcagattgcttgagcctaacagttcgagaccagcctgggcaacatagtgagaccccatctctaaaaaaaaaaaccaataaaaatatattaaaagattaactgattgtctatcatatggattacaaatatcccccccaatttgtcatttgcttgttaattttatttatgatgacttaaaaattacaatatattttttggtgttcaagtcagtttttgtccccattgtgatattttcctttgcctgtttatcactttcttagagaaaagataaatactgattcgttcttttgtaggtgttttatgatttcattgaaaataaaatcttcaacgcatctagtattcatttgggtgtaagataaaagataacaacgtaggtttctcttatagttcatcaggtatcctactactgtttattgagtcatgttttctgttaccactcttactatataccagttttacatacatttgggttggtttctgagctttctattgtcttccattgctttgtttaaaatttaaagtttattattctgactttccatacttgaatatggtcgaataagtcctcctttattaatcttgttttatttaaaaatggtcattttcactcattttccagttcagtagttttattctctcagtgtaatgtgatttatcaccccattgctcaccctattcatctcccaatacccagctgaaaaactttagaagactgaggctcttgccctggccccatcactttctagctatgtgggcttaggctagttattgaacatgtctgactctcacttttctcctctgtaagtcagtgagaattatatacttcttataaggttgtgaggttcaaatggaataatgtgtacagaggcacttggtaaacaatgtagtcatatgcaagtcatatgcaagtcatatgtagtcagcttggtgaattttgagaaagtaaatgcaagttctttttatggttttacctaaggggccagtgagggccagagaagtgccgggacctatgtaaggtcgcaagcaagttcatgtggaatgcatctagaactagaacgctagcctgtgtcccagggcccttccaactgggctctgctgcctgcagtcctgggtgccttctaattagcctgtgtagtggtcttggtaaaagtgtttctcctgtactgtcccctataggttgtggctggccataccatttccctggttccccccacgctcctgatgacctggaaaggccatttgaatagtgtggcagacatcctgtatgtggacaacttccagctggttatcagcgctggccaggaccgggacgtcaaggcttggaaactctccggtgatgccattggtatgggtcctgctgaagctcagccatgcccatggcccttcttgtctctgtccctgtctgaacataagctggtatgaactttgtactctgtggggagggactctcaggccacagcaactgccttcacttaaataatattacagtctgtccaattatccattcagcaaacggtccatccattcacccatccacccaatattattcacctatgtatatttttgcaaatcatatatctgataaagcatattcctttctcttttaaaaaataaacttaattgttgcattgtatataaagaaaaacatacaaaccagaagggttcagcttggtgaattttgagaaagtaaatacatacccatatagccaccgttcatgtcaagaaataattagggccaggcgcggtggctcactactgtaatcccaacacttttttgtccccttttcctcctgtgctgtcttcctatgtgtttgtttgtttgttttagtgacctgtctctactaaaaatacaaaaattagccaggcatggtggtgcatgcctgtaatcccagctacttgagaggctgaggcaggagaatcgtttgaacctgggaggcagaggttgcagtgagctgagatcatgtcactgcactccagcctgggcaacagagtgagactctgtctaaaaaaaaaataataataaaaataaagtgacttatgtgccactattacagtattacagcattctgtatttttctatgtgtttacatttatcagaaagctttgtattttcatatgctttcatgttcctgcctagcatccttttgtttcaacttgaaggggtccctttagcatttctttaaaggcaggtctaatggtgatgaactcctcttgtttttatttatctgggaaaatttttatttttccttcatttttaaaggacagctttcctggatatagtatttttggatgagagtttttgttctttttataatgtgtctccttgtggatttctttgactttatcctagttggaatcccttgagcttcttgaatataggtttcttttcctttttaagatttgaaacattttcagccattatttattcagataagctttttgtccctttctctctctctgtctctctctcctccttctagtactaccataatgcatatattgtccatttgacgatgtctcataaatcccttaagttttctttactctttaaaattcttttttcttttttgcttctctgactggatatcttcaagtctgctgatttttccttctgcttgatcaagcctgctgtagatgacttttgaattcaattattttactcttcatcttcagctctagaatttctgttatttttattattattattattattttttgagacagggtcttgctctgccacccagggttgagtgcagtggcacgaattcagctcactgaagccttgacctcccagcctcaagtgatcttcccacagcctcctgagtagctgggactacaggtgcatgccatcatgcctggctaattttttgtattttttgtagagacagagtttcaccatgttgcccaggctggccttgaattcttgagctcaagtgatcgcccacctaagcttcccaaagtgttgggattataggtgtgggccaccatggctggcctctgtttggttcttttctatattttctgtgtcttcactaatattctcagtttgttcatgtattgtttccctgagcttgttgagcatttttattacggttacttagaattctttgtcaaataattaatatacctcaatttctttagcggcagtttctggagatttattttgttcctttgggccatgctttcctattttttttgtgtgccttataactttatattgggatccatgcatttgtaaaatcagccacctctcccagtctttatatactggcttcattcagggaaaattctgcaccaatcagcttggctaaagattctgggtgcctccccaatcttttttgtggatactttcaccagacttacgcatgtaaattcgcaattacaggaatctacaggtttatttttttcaggagtccattatctcttgctctctctggtgtctatttgcagtactgcaagttctctagagcggctacaagcttcccccaggcctctagaatatgctgggtccttcaatagtctgagagaggcaagacagaaaccagtttcttgggtacccctcaaaggctaacattggatatgtatgctccaaatctgcctcctcaaggagaagctggaagttgggttgttttctctactcattccacagagcggcaggagggactctgatagtgtgtgctagtctaaattgtcacctttgttcttagtagcccagtctggtgcctcttcctgtcagtgcttagattcaggcaagacagaaactggttaatcatgcagccctctgaaaagtctgcatgttggatgtacatctcagtctttccctcccagggagaagctggaagctggtggttccttcccaatctgcttcactgagccaggaggagggattacaagtgagcactatgaattttcctactggcttcagtgcagctggttttttgttttttgtttttttggtttttgtttgtttgttttttcattcatctgggatgaatggtcctggtttctggtccatgtactgttgttcagtcagtgtctccatagggagaaggaagttctggatcttcctattctaccatcttgctgatgtcacccatttttttgtatctttcaaagacgtctttgactatcccctaaatataatatctagtgttatcttttagaagcttgttttaaaaatcagatttctgaagtataatttacatccaataaaagcaccttttaaaagtatatagttctgtgaggtttcatgaatgcatacaattgtgtaattggtatcacaatcaagacatagacattaccccaaaaagtgacctcatgtctcctcatagtaaactctatttccttctcctaacccctggcagccattgatctgtttgtctctatagttttgccttttccagattatcataaatggaaacatacacatgtagctgagtgaaagtctaactttcacttagcataatcaatttgagattcatctttgttgttgaacgtatcagtagtttgttctttttattgctgagtattattccactgtatggctctgtcatagtttgttaatccattcaccaattataggacatttgagtcattgtcagttttggatgattatgaatgaagccgctttaaacattgttttcatttctgttgggtaagtatttagaagcagaatggctgggttgtatggtaagtgtattgaaactttatgaaaaatgaccaaactgttttgcatttctacctttgtgtcttcatcaacatttggtgtttgatctgttattattttaaattttaataatctatgattgtagcatgagatttcaatattctctcaatttataaaacaactatacagaaaatcattaatgatatagaatacttgaataacactatcaaacaattttacttaattaacatttatagatcattcataaacaaacattatttttaagtgcacacagaacattaattaaaccgaccatattctggtaacaaaacacatctcactaatctcaaaaggatttatgccatacaaagtatgttctctgatcccaatgaaactgaattataaatcaaaaacagaaatatctttgaaatatccctaaatatttggaagctaaatgacacatttctaaataacccatgggccaaaaaaagaaatccagagggaaattagaaaatattttgaactgaatgaaaatgaaaatgtaacatttcaaaatttatgagatgccacaaaaaacagtagtaacggggaaatttgtagcactaaatgcctatattagaaggaaaaaagttcaaatctccagcctcaacttccacattaagaaactagaaagaggtctggtgcggtggctcacgcctttgggaggcaggtgggaggatcatttgaacccaggggttcaagaccagcctaggcaacataacaagaccccatctcaattaaaaaaaaaaaaaaagaaaaaagaaactagaaagaaagagcaaattgagcccaaagtaaatagaagagaaataataaagattagaatggaaatcgatgaaacagggaagtaaaaaataataaggaaaatcaatgaacccaaaagctggttctttgaaaagatagttaaatcgataaacctccagctagactgggcaggaaaaagagagagaatacaccaattaccaatatcaggaatgagtgagatgacatcatttctgattctacagatattaaaaggataacaatgaaatactataaacaactttatacaataaatttggcaacttatatgaaataaactccttgaaagaaacaaactactaaatcttacacaagaagaaacagataacccgaatatccttatatcaaagaaattaaatttgtagtttaaaactctccttacaaagatacctccaggcctaaatggcttccatggtgaattttacccaaatatttgaaggggaaataatataaattctacagaaactcttccagaaagttgaaaagggtacaatacttcccaactcatgaggcaacttggtaccaaaatctgacaaagacgttataagaagaaagtgaaaaagaaagaaagaaagaaagaaagaaagaaagaaagaaagaaagaaagaaagaaagaaaagaaaggaaaagaaagcaaactatcaattaatatccctcataagcataaatacaaaatatcttaacaaaattttgcaaataaaatccagcaatgatcacatagggtttaccccagatatacaaggttggtttaatatttgaaaatcagtgtaatttattatattaataaagtgaaaaactatgtgattatcttgatacaataaaatcatttgacaaaattcaacatccatttctgataaaaaacatttagcaaaatagaaaaaactttctcaacctgaggaagtgcatctgtgaaaaaacctaaaactagcttcacacctaatggtgaaaggctgagtactttcccctgaccaggaataagacatgtcacttcgattcaaaattatactagaagagtagagggcaattacagaaggaaaaaaaaaggcattcagattggaaaggaagaaataaaactgtttttatttgtagttgactaattgtctatgtagaaaatccagtggattttactaaaaagagttagtaaggagtttaacaaggttgcaggatacaagatcaatacaaaaaatcaattgtatttctatatactagcaatgaacagccagaaattgaagtaaaagatacatttacgaaaacataaaacataaataccaagatatgtaagtacacagaaaaatactacaaaacattgctgagacaaagtatagaagatttactgttaatgggtagaagactctctgattaagaataaaattatctccaaattgatttataggttaactgaaataccaatcaatatcccagaagaatttttgtagaaattgacacactgattctaaaatttatttaggccagtcaaaatagctttggcaaaggaaactaagatgaagggctaacattgcctgatttcaagacttattgtgaagccatggtaatcaagacagtgtggtaatggcatagagacagacagacagatcaatggaatggcacagaaagtccagagatatatccatacatatatggacatctgtttctgacaaaagtgcaaaggcaattcagtggagaaaagacagtcttaaagcaatgaacttggatccacacctcacaccacatacaaaaagcaattcaaaatgggccatgcatgatggttcacacccgtaatccaagcactttgggaggatgaggtgggaagatcacttgaggccagaagttcgagaccagcctggccaacatggcaaaaccccatctctgctaaacatacaaaaaattagccaggcatggcggtgcctgcctgcaatcccagctactcgggaggctgaggcacaagaatcgcttgaacctgggaggcggaggctgcagtgagccaagatcgcaccactgcactgcagcctgggcaacagagcaagactctgtctcaaaaacaaacaaaacaacaaaacaacaacaacaacaacaaaaatggaacatagaactaaaggcaaaagttaaaactaaaacttccagaagaaatcgtaggagaaaacctttgtgaccttggtttaggcaaagattgtttgcatgcaacaccgatagagcatgattcataaaatatcaagttaataacagtttatcaaacttaaaaacttctgctcttcaaaagacactgttaagagaacaaagataaaccacagactgggagaagatatttgcaaatcctatatctgataaagctcctatttagaatatataaactctcagaactcaacaaggaaacaagtaatacaataaaaacattagaaagaggtttgaatagacacttcaccaaatttgaagagacttcactgtaagaattaaagaggaaacacgaaggacagctcaacagtcaacagggacaggtttattttaaataaacctgagaggggcggctggctgagttaggttagagccacactctcttacagactaagagtttttaaggattcagggtgggagaatttatcagaggcttggactgcttctgtgtctctttgttgtgcttatctgggagggagagttgtgtgtctgttcccatacatctttctgcagctgcaggcaaatcccccgggttgcttttagcttccctatcttagtgcacctgaagggaaaggaatgtgcttcttaagacccactgttttactggagcccattgtatgagggtgaagtttagcagttacccaagagacctccccctccctctgtgcccaagctgtcctattgtattttactgtctgctctttttggctgcttgtagttagaagagacgtgatttccttgaaatgcatgaggctagaaagggagctggaacttaaagtggcagtgtttgtccgagatgacggtgctcctgctctgtcattcaccaaaggaaatatatagaagcatggaaaacaatgcgcaatatttattcattagaagagaaatactaattaaaaccgctgtaagataccatttatcttattagaatggctaaaggagctgaaactctcctgcacggctaatgggaatataaaatggttcaaccactttggaaagcattttggcagtttcttaaaaagttaaatgtgcccctatgatatgaatcagctgttccacttctatgaaagcatatgcccgggtaaagactacatacataaatgttcacagcagtatttttttgtgacagcctcaaactagaaacgattcaaatgtccatcaatagttgagttgataaactatggtttatggaatatcactcagcaataaaacagaatgaagaattgatacgttatacaacgtggttggatctcaaaataattatgcttagtgagagaagccagacgaaaacctgtacatattgtatgattctatttattttttcccaaccatttacacctgcatctatttatataaaattttaggaaatgcaaacaaatgtgtagtgtgacagcagataactggttgtttgaggatagggggctgatgagggttggaagggtgggagctcaaagaagcaggaagaaacttttgcaggtgatggatatgtacacattaaatagaaactggttattgcatgtcaattatacttcaataaaactgttaaaaatagtcatcctactaggtttatagtggtatcttactgtgattttaatttgcattcctctagtgactaatgatgttgaaatattttcttgcacttattagttatccatatatcttctttgatgcaatgcctgttcagatcttttgccattaaaaaaaactgtgttgttttcttattgagttttgagaatgctttattctggatacaagttcttgatcagatatgaggttttgaaaatatttttctccactactgtggcttgtgtttacattctcttcatagtgcattttgaagatcagtggccaggcatggtggctcacgcctgtaataccagcactttggggggccaaagtgggtggattgcttgagctcaggagtttgagaccagcctgggcaacatagtgagactcttgtttctacaaaaaaaaatattaaaaattagccagttgtggtggtgcatgtctatagtcccagctattcaggaggctgaggcaggaggattgcttgagcccgggaggttgaagatgcagtaatctgtgattgagccactgcactacagcctgggcaacagaataagaccctgtctcaaaaaaagaaaaaaaaaatcagaagttttaaattttggcattgtatgcaagaaatttttgcctaacccaaggtcacaaatgtttccactatattttcttctataagttttatagttttcactcttactttttggtctataatcattttgagttaatttttgtaatgttgtgaaatatgagacaaaatttaaattttgcatggagatagccacttgttccagcactatttttatcctttctcctttgagttccttttgtacttttgtcaaaaatcaatttgttattggccactcatacatctactcctgtgaagtgtctctttgagtattttgttgtttttaagaaatttggttgcttgtctttgtattcttgatttgtagaaattctttgtgtcctggatatgagacctttaacaggtatccacattgtgagtacttttatcagtgtatcacttgcccgttcattttcctgatggcatcttttgatgagcagaaatttttaattttgctgaagtccaacttaccaagttaaagaacatgttgggtactttaaaattgtggtaaaatatatagcataaaacttaccatcttaaccatttttaagtctacagttcagtagtgttaagtatattcacattgttgtgccatagatctctggaactttttcattttgcaaatctgaagctttatagtcattgaacatactcctccatttcccgttacctccagcccctggtaaccatcattcaactttctgtttctacgaatttaactactttagttactcacctaagtagaataatacaatagtcatctttttgtgactggcatctttcacttagcataatgccctcaatatttattaatattgtaacatgtgacaagatatcctttcttttttaacattgaataatatttcattgtatatatatgccacattttctttatccattcatctgttaatggacactttagttgactccacctcttggctgttgtgaattgtgcttctgtgaacatgggtgtgcaagtatctatctctttgagaccctgctttcaattcttttggataaatacccagtagtgggattgctggatcatatggtagttctacttttcattttttgaggaacctccatactgttttccatagcacatgtaccattttataatcccaccaaacatgcacaagggttccaatttctctgcaaccttgccagcacttgttattttgtttttgttttttttgtttgaaacagccattctaatgggatgatgttgtggttttgatctgcagttctctaatgattcatgaggttggcaatcatcttttcatgtgcttgttggccattgtatatcatctttggagaaataaatatctattcaagtcttttgcccattttcaaattgggtgttgttgtttttaagttgtaggagttctttatatattatggatattaacctcttatcagggatatgattttcagatactttctcccattctgtaggcttcgttttcattgggttgattgttgattgtggtttttgtttgtttgtttgttttgaaatggaggtttgctcttgttacccaggctggagtgcaatggtgccatctcagctcactgcaaccttcacctcctgggttcaagcgatcctcctgcctcagcctcccgagtagctgggcttacaggcccaccacacctctctaatttttgtatttttagtagagacagagtttcatcactttggccaggctggtctcgaactgcaggcctcaggtgatacacctgcctcagcctcccaaagtgctgggatcttagatgtgagccaccacacccagcatgattacgttttttgatacacagaggttttcaagtttaatgtctatttttgctttcattgcctgtttttttagtgtcatatccaagaaataatggcctaatccaatgttatgaagcttttcctccatattttttctaggagtttttacagttttgggtattatctttaggtatttaattcattttgagttcatttttgtatatggcataaaataacagtccagttttactcttttgcatgtggcaattcggttttcccaaaaccatttgttgtagagactatctttcccaattgagtggtcttggcacttttgttgaatatcatttggctatatatgtgaggctttatttttggatactctcttctattccattggtttatatgtctgtttttatgcctgtaccacactgtcttgattcctgtagctttgtaatatgttttgaaatcagcaagtagatgtttttgttctctaataaatttttgcttacattaaaattacaaagatattctcttagatttccctctagaaactagagattttggcttttaatttagctctatgatccatcttcaattaattgttgtgtagagaggatgttttctctatttctaattagccaagagagttaaaaaaaatcataaataggtgttgaattctgtcaaacgctttttctgcttctactgtgataatcatatagcttttgtcctttatcctgttgatgtggtaaattacattttttgaattttgaaaattcaaccttgcattcctggagtaaaccccacttagtcaagatgtattattcttttaatatattgttgaattctattttactcttaatggaactttattgtattatggccaggaaccattgagtgcccaaaaccttcttggtcctggacatctatcctccccatgagtagagtggccaatgggaattcaaaataccattttactttggttctcttggttttacctaaaaaaatgcagcatttttctggtaagtggagatagagctgtatgattttgcttaaggcaggcccctccctccccctaaagccaaacccagatcttatcctagctggccattagagacaagaacacaagtgaaaaacagaatggctcctccaagtgcatttgtaacaagtgatccctgctgggctcagtggctcatgcctgtaatcacagcactttgacagaccaaggtgggaggattacttgaacccaggagtttgaggccagcatgggcaacaatgtgagaccctgtctctacaaaaaattaaaaacttagctgggcatggaagtgtgcacctgtagtcccagtgactcaggaggctgaggcaggaggatcgctagagcccaggtgtttgaggttgcagtgagttaagactgcgctgctgtactccagcttggggaacagaacaataccctgtctcaaaaaataaaaataaaataaaataaaacaaattatctaaaaaacatgccctctcagtattcgagagtcctgtttggattagtaaatgttctattcttgaagaaaccccaagaagggcttgagaagggggctgggagccttccccacctccaaacagcaagcatatatcttctgttccacgtcctgagcgagggtataggtggcctccaacccagttggaataaaggtcctgcctcacatgtgcaaatgctgcctgcccatgtaagggagggaaaaagctgtttctctattttttgttaaaaacgaccctttcagcccatctctgttcttatatttgtgtgcctcttttaaacaatgtataattgagtcttatttttttcatcctgtctgacaatctttaccttttaattgggtatttagtccatttaaatatcaacaattatgtagttgggttgaagtcaatcatcttgctatttattttttctgtttatcctatccttggtttcttttttcttccttttcttatttcttttggattaatcaaatatttaaaaaattgttgttttatgtcctctgctctttaaatggtatcttttgtattattcttttagtgattaccttagagattatatgtattcttgacctagtgctgcttcctgtacaagaatcttacatccctcccatgtttatgttattattatatattttatttctacatatgttatgtcttcctataagacattgtcattattatttctttcagcagtcaatttccttttatggttactcacatatttaccatttctggtgctcttcattcttgagttctaggattctgtctgcagttgttttcctttattctgaagaaattcctatttcttatagtgttatctgccactaataaattctcagattaataattttcagatcaaattttctgatcaaattttcagatcaatagtttattgatctgaaaatatctttattttgccgtaaaatttaagactattttactgggtatagaattctcagctggcagtttcttttctttcagcatttaaaaaaatcattcagtggtcttctggtgttgatattttctgttgaaaagtcagttgcaagttgcttctttgaaggtaatttgtctttttttcccctggctgcttttggttttcagcagtttgactatgatgtgcgtaagtgtggttttgtttgtatttattctgcttggagttcactgatcttttaaatctagaggttgatgtctttcatcagttttgaaaagcattcagatattatctcttcactattacttctgcattattctctctctcctctcattgtgggggtactaactatatgtatactagactatttgactttgtctcataggtctcatgccctattcttttttttttttttcattttttttcaatctctgaattccagattatttttttgctgacctgccttccagttcacgaatcctatcctcttctgtatgcagcttgctattaaatctattgaattagttcttaattttagatgtatttttttagttttagaatgtccatttgattcttttctatagattgcaattcttttccaccattttattcaattttccttaattttatttaacattatttgtaacagttatttaaagttttaatctgctaactccaatgtgaatcttctggagggcccacttctaatgcctatttcttctcttgattattggttatattggccttttcacatgtcatatatacaaaataaaattaaaaaaaaaaaacccaaaacttttctgggcttgtataaatggattgtaaagactttagttgatattatttcccccagagcatttgctctttcctctgtatagggctgagcatctccatccagttggggattgaactgggttggggctggatagcagctttaggaggactcagtttgcctctgtgttcagttgtctcaaggttgaaatctgtgtctgtttcaggctcctccttcagtgggactctgtctcccaatgatctcattcggcttttctataccagcacctacaaccccagcctccctggtgctcggcaaatgtcctaacaagaaaaacagctgtgcattcaggcgagacttaattaatcatgccagccacagtggatgtcagaagctctgctggtttctctctctctaagccaagtctgattctcattcagcccgtgtgtagactcaggagtgcccccgagacaagaaagcagctcccactcccagctcttcttggaaagacttgtccctttctgtcatcttagttcacctggccctctttgcttctactgctttccagtgatttttttttttcttaaatgattttttacctgttttatttttcttaactttaaaaatcctgcagcaggagaatggcctactactcactattctctgcccaggagcaggacttaattctgttttcagtacctactttttactccagccccattccttcccccaccaccccaaatctcatatctgatgggtgtctgaccgttttatgccattgccattttacacacaagctacctgaagcccaactgaggatcattcagtcactgccatagtactctccccatctcagttcacatgtggggcaggatgctttaggcctgagctccgagtgtgtcctagggcttctgtctggctcatccacacgtttgttgagtactcagtgtcgtgcctggtgtatggtgggcactcaacatttgagtgagtgtgggggctgaggataggggctgctagctgacccttgaagggagaggataaggggcagagggcatggaggagggggtatgccagttgtggttctgagcagtctggtcaaatcacaggaacgtttggcctgagtgtgtggaaaagactacaggatgcctgtgatggtcctcgtgaaaacagagcaagcttagaggaagatggtgactccactggcaccacccagaaggtcttacatctggagctgcagtgagtgagcacagcctgcttgatcttctctggcctgaggagggagaggctgtgagtcttcccaggtcctgggaagcctctacctgggttgggtagagctaggcatgggtggggaggaccctcagaaggccagaggcttgagggttgcaggcagctctactccacagtggcagctatggctggagagcccaggccctattttagcccagctcagctgaaaggttgagcagtgaaaggggaaaatacaaaaacccaagtgcttggatggggccctgtcccccagccaggcccagatttgctagagctggcttccctgcagagatcattgctgcatggccagaggtccctggcagaggagtgctcaggcccaggcccaagtccctgatcctgagaggacatttgtgttatttccctgatttgcagggaggagcaggctgctggctacttggtcctccccctgcaggttcatctcctacccactccatccactgcatctttattcctgaccaagtctccagtaattctggttcattcaagaaaatgtgtattgagatcctactgactgccagaccttgtgctaggttctagaaatacaagacatccagacacagtcctgcctcagagaactcacagtttactcagggaggtggacatgcaaactcatggctgcaattttatgtgataagtaatgagagtattaggaacagggatggctcagaggacaatctacatgattgagtggatcaagtaaggaaggcttcgtaggagaggtgattttggagttgggttttgacatttaagtaggagtctgtcaggcatccacagaatctttgtgactcctatgcttccatcaaggcatacatcttgacagtacagtggagggacatcaaacaaggcaaaggcagggtttccctggggcagggggcagacatgtttaaatagtccacaaggggaggtccagataaagccagatcgggtgtcaggtctgcatggtggagaggacagagtggtgggagagtggcaggactgctgggccagctggatccaggctttgcaaatgttaattccatacttactcagtgatggactctggggagtctggcctgagggagggatggaagattggaaaggatcaggccaggaaggggagaggctttcagggtttctgggagggtcaccctgctttgcagtggggggacatcttgtgaaggaaagcccccacactagggagcagcgggatctggctgaggccctgatataccagcggcgagagcaggcggcgctgatggctctcctgcatgggaaggcagataaggaggcagacacttgggccaagctgcagaagatggccctgatgtccccgtgggccggagagcgccccctggaagacattgaggacagctggaacaagtgggagtccagggacaagcaggtgaggctgggaggggagcacagggaggagtgcagggacccccaactcgcagccttcattcttgggcgtggctcctgcaggtgagcaaagtcttgggagcggcgtataagcccaaggaacgcttgcagaataccaggttcctgtccaccagggtgccatatggctggatgaagcatcaggtaaggtgggatggggcagctccccaagaggctgggtcaggggccaggggatcccatgtccaccagcagccacccttgtgcccacacagcccttcagtgagggtggacaggagcctttgtcctttaacaggattctgggccatggacaggtctgggatgagactaatgtggccagtttgtttgccaaggccctggctgaggtcagtggtgcagcttttgtccttgaggacaagcctcaagggcctgtgggacaaggtctccttgggcaggactcctgtctatagcctccaagcatttcctatggtctgtggctgtctatttgctggttagcatatttcccacctgtgtccccactactttggtgctcaaacagcagactagggcatcatgccaggcccatagtaagagacagggtaaacggagtggctctccatcagggacagaaaggagcaggggatgttcgaaagagcagatttgagctccagatttgagatcccagcctccccgtccttgtctgccaggggaatattgtgggagctccctcctccctgtggtccccttaagaataaatgagataacaccgaaggccatgcccctgcagggcccccctgtctcgggctggggagaggctggtgtgagatggattgctccaaggagctctttgcacctgggcctcacccagggtccagctcgaggcctcattctcagaagcgggcagtctgctcgccagctcacagagttgccacaagcgccgtaactgggtggagagcagggctgggcacctggcctggtgcagggtggatgcatgggcccgcaggccacggtggttagtggtagccacagtcctctggacacacgccttcttggcatgggaagacctcagggcgcctccttcctgtgagtctactcttgatcctgggtgtccccggctccaactggtgccccattcccgctccccactctgttccctgcagatctcgcctcaggtctaccaaagcctgcacttcagtgatctgatgccgactcagcagcctgacttcctgaccagcaggggcccagaccagcaagaccagcacatccgcctggtggcccaccatgtccagaaggacctggtgcccagcagggagcaggctgtgctggataccacggacagcacgcctgcggccgcctcctccccatcttccttgttatctgtcactgcctcagcctccaggctgctggactccagcttgcccaccttcctgacgccccagttctccttcttgctgcggccccagtcagcctccacagcccattccaccccctcggtcccatccccggtgtccaagtccaccctgcaggggtcagtgacccccaagcacattgtctcctccttcgagcggcccccaaggcctctgaaggccaccttcatgtcctctgtgaaggggagctcccatgtcaggttctgaggtgctccgctgtcttctctagtcctccagcagggcaaccaggcccatggcggtcctgcatgttctcggcttattccctaccagacccagaggatgtggctcttcccccggccaccccactgggcctctctggggaagttcacctgtctcctaatcttgtcttctctctggccccgcacagagccctggggcagaaaataaatgttctcagctgtgggcatccacaggtgatgaggttgggctgtgtgttccttgcccccttaggtccttccttttctgagaccagtcacatcccctggccctggcagaggcagagaggagagtccaaggacacctgggcatggctggttggcttggaaacttggttcagcctcatggcaagagtgaggaccggcagccatctggtgagggtcatggctgtttgtcttctgcccctgctgtctgtcagtcttccctcatcatcaaacactccaccccaagcaccttgttctgtcccgtgtgcagagagggctggaagcatggtgggcagcacccctcctggctctgccgctgtcaggctatggagtcccatgtgtccttcccctctggcccagaggcacctttccagacctctgctgggccatcagccctcttggcagctggagatcccattctggggcatgtggggccctctggacatatcacctgcagcctgaagggagctggggcagcccactgctactgagcaaggaggaggtgggctataggctgggggttcttgggggatctctctgtctcagtgtcctcactgaccctcctgtgcagtccgaggctcagccctgaggggcgtatgtgtcgtttctcatctctgtgtttctccttccatttccctttacacttcacaggggtggaagcacgggctccccaccaccactctgctgggaggttgggaggttttttttttttgagacagagtcttgctctgtcacccaggctggagtgcagtggcacgatctcggctcactgcaacctccgcctcccaggttcaggtgattctcctgtctcagcctctcgagtagctgggattacaggcatgtgccgccatgcccggctaatttttgtatttttagtagagacagagttttgtcatgttggccaggctgggctcgaactcctgacccaaaatgttccacccgcctcagacccccaaagtgctgggattacaggcgtgagccactgcgcccggtctgctgggagtttctgcgtcacctgtgcctccttcctggggtcactgcatcctctcctgtatgaagaaattatgatctaagccctcccagcttggttcttgcattaaggagtcaggggcacgcaggagccaggcattattgaggccaaagtccatctgcagtctgtatcccaataccatctctgtatccgtttcctagtgctgctggaaaaaaagtaccacacttgatgtcttaaaacaacagaaactaattgtctcagctctggaggctggaggtcaaggtgtcagcttggaagaggctgcagcttacgtgtcagtagcttcccagtaaacccacccagcagcccttgttgattttcactttcacaacaaacacctattaagtgccttctaatctagaaaactcttccttatggtggagctgaaaaaggcgtccgtctggggctgaggagaggctgctgtctgggccacagaggatcatgggatgtgtccccaggaggaggtgctggggatcagacacctttgtggtcggggttgggggcacaggtgatggggccctgcccaggccacgcggaccccaagcagtgcctcccctgaccttcccctcataccacctcccctgggaagtggcttctcattttagaaccctgcctttgtgtcccagggcttctggatgcccctggaagttggtaacagagcaccccacacaggggccttcaaacaatagacattaattttttcacagttctggaggccagaagcccaaaatcaaggtgtcaacagggcaccttgaacctggtaggggaggacccttccttgcctcttccagcttctggtgtttgctggtaatccttgcttggtgttccttggcttagagatgcatttcccgccccgctcctcactctgcctccattgtcacacgggcatcttcttcatgggtctccatgatgcctcttttttttcttttcctttcttttcttttcttttctttcttccttccttccttccttcttttctcctccttcttccatctcctcctcctccttttttctacttctatcttctttcttcttctatcttctttcgtcttctccttctccttcttttcctcctcctcctcctcttcttctccttcctccttcctccttcctcctttctccttctccttctccttctccttcttcttctccttcttcttctccttcttctcattcctcctcttcttctccttctccttagagacaggatctcactctgtcaccaaggctggagtgcagtggtgtgatgatcatagctcactgcagcctcaactccccaggctccagcgaacctccccgcctcagcttcccaggtagctgagaccacaggtgcacaccactacgcctggctacttttcagaattttttgtagaggccgagtgcagtggctcatgcctgtaatcccagcactttgggaggccgacacgggaggattgcttgaggtcaggagcttgagaccagcctggccaacgtggcgaaaccccgtctctactaaaaatacaaaaattagccaggcatggtagtgcatgcctgtaatcccagccacttgggaggctgagacaggagaattgcttgaatctgggaggtggaggttgcagtgagctgaaattgtgccactgcactccagcctgggcaacagagcaaggctgtgtctcagaaaaataaaaaaataaaaaataaaacttttgtagatacaagatcttgctgtgttgcccaggctggtctcaaactcctgggctcaagggatcctcctgcctcagactcccaaagtgctgggattataggcatgagccactgcacccgaccacagtgtcttctcataaggacaccaggcatacaggattaagggcccgccctactccagtataacttcatcttaactgatgacttctgcaacaaccctatttccaaatcaggccacattctggggtactgggcctgagggcttcaacgtatcctttggaggacacaggtcaacccataacagcccccgaggtcggggagcagaagagagtgtggctgcactgaagatttttcccagtttctttttcttttttttctttttttgagatagagcctcactctgtcgcccaggctggagtgcagtggcgtgatcttggctcacagcaacctccgcctcctgggttcaagcgattctgcttcagcctcccaagtaactgggattacaggcatgcggcaccatgcccggctaattttgtatttttagtagatatggggtttcaccatgttggccaggctggtcttgaacccctgacctctggtgatccacccacctcatcctcccaaagcgctgggattacaggtatgagccaccaggccctgccgattttcccagtttctagagctttcagctttgtagctgacgccctcttcttaaatcccagctgttctcccagcaaatttcagctagagtccctcaaaccaatgatgaactctaagttacctgccacctccccactgacccagggaccggtgtttctgagccaggcacggaacaggggtggctgtgctcgattcctctcttccaccctcactggatttccctcgttgacttatccgagaaggagtgggcttgaactctctttcccttctgcaaaaggatggaatttccagcattccctgtttctcaaagttgaaggaagtgagagacaacctttattagacacgttccaagcatcaggtcctgaaccaggtactgaaactgtatttaatcctcacatcattccacgaggtgggtgctgatatgacctcattttgcagagaaagagaggttcagagaggtgaaattgcttgcccacgatcacgccaggaagtgggggagtcagcgtttgaacgctgccaggctcagctgctctgagtgcaactgctgggctgtcccagataactcaacccccacaaagctatgtccattggctttggggcctgtcctgggctctggccttgctcccttgggaggaaggacccctggtccctcctgactgtgctgtcctggtgtctgtccagtttagcccagcctgcgaagggcttggtgactttggccaccacttgaggtgggaggggagtgtccctgccaaaggctcattggctgatgccagaaatcagcttcatttacccaaggtacccagctgatgcacccagtcctggttgtcagcacctcagggtcctgcctctccagcgctgagccctggtgtagtctgtacaggtttggaaagtgagttgtgggcccgggcaggggcgcagctgggattggaaaggaaaggcaggacaggcaaggcctggggcagctgtgggctctcttgagcgggataagcgagatgctcctcaccagtccagactctatttccaaaaccctctcctgcccatcagctcacttgagctggacaacagttttcttaggcatttgccccattttacagcagggcaaactgaggctcagcgaggagtaaggtttcacagctagaaactggtagagctaggattcgaacccagggttttctgagctaaagccctcgatccttccattacatcctgctctgcgcagcatctcaggtggagaactcaggaagtggggaggtgtgtggataagctggtgaaaaagcccaaggccaggcctagggctggtccctcctctgcccagaggaaggacacgggggaaggacactggggctggggagcagggaagatgggggtggtagcaaccaggcttcgggggattttcttagaggcttctgcataaccctgacctggagggtggttcagggtttcctttagagacccaagatcctgacatggggacacctggctggacaccatggaccaggacaggccaacctgtccccaatcccctgactctgggactcttcaaacctcccctcaatgcacccagccccattacaataacattctgtgacccacccttgaaggggtcagttgaccctaatgtgtcttttccctgcccggtgctgtttgtgccacgaggacaaaaccaggttgggcaaagcagagtcaaactttattcgttgatcaaggaatggggaaggggagctcatgttcaaaccaccttctccctaaggcatagggcaaagggggattttaagggcttttagggcaggtaggtggagactgggccagggattcctggagaaaggtgggttcttccaggaggggctggaccctgcacagtcttgtcttttgcacccagcactttttgtgcctagcaaggtgcattgctccccctgggtggagattttctcagggtaatgaggcaagagttcagtcaaggccgcactgctcggttcagctcatcctgtggctggttcgtggttattggcttccagccttcacttctgcaagcacagcagcaagcacaggttaatttcgcaggttgcggggcttttctgaaaaaactaagatcatgctgcagtgacgctttcactatgtttctcacacgatgtagatctggtgaattgtaggcacttaaagaattgtaaggtctgagtctcatctcctactctgacttcagccaaccctggagatttgcctcaggtgccacagcccacaggccatccctccaggcagcaggtgcccaagatgcagccgtcacaggccccagcatgacaggcagggttgagctccaccaatagcgagtgagcagccatgtctgtcccactgcccacacccagcctctcccacccaggccctacctgggatgccgggtagatcattccagaacaccagagtcagaaggagcttagaacccagatggggaaatggaagccaacgtcccccaggagccggcatgaggaagctggattgaggccctgcttcctggtcaccagtcatcctggtgcgtcctcgagtgcccatgccccttcgcacctgctctctgctttttgcaccaatggcgtaaaccccacttggatttagctcttttctgattctaaaagtagcacagactgagtgtagaaaattagaaagacatagaaaagcatcaaagtcaataaaaaccacctgaactccatcacccagcgatcattttggtgcatttttcttctagatttcttacccccgccaaaaaaaaaccagggttcatttgcctggtgagccacaaaccactcactgtgagaactcgggttttgatcaataggagcttcattacttggcacaagtaaggagggtgctgggtgtattctccaaagcacggtctccctgagggaaagtgacggggggctttctgggtgatggagaggggaaggggtgcatcacagcatacagaggaggggtcccagttgcacagatgcagtgagtcatcatgcggcacataggtctcatgtgctggtgatgaggctacagctccttctgggcgggagacttcagcatggttgtgagaaagttcactggagttcatccgtaagttgccggtgtctgtggggtgcccgttttaaccaactaggcgactgcatcccacataggggttttttttgagacggagtcttgctctcgtcacccaggctggagtgtgatggcgtgatctcggctcaccgcaacgtctgcctcctgggttcaagcgattctcctgcctcagcctcctgagtagctgggactacaggtgtatgtcaccacgcccggctaatttttgtatttttggtagagatggggtttcaccatggtggccaggctggtcttgaactcctgacctcaacagatccacccgcctcggtctcccaaagtgctgggattataggcgtgagccaccgcacccggccccacatagggttcaggaggaaatgggctgcagagtgggaggctgtccaacaggctgactgccaagttgatcatgaaatttctatcgtccctggaaccctccctgtctgtgtacagagacttttctgtttttatgtgaatgtgtgcacacacccacatacacacccaagcatacccttacactcacacatgcacactcagactcacactcattcactcacttatatactcacacacatgcacaactcataatctcaaaatcgacgcttcatacacatcattcttcatgtgatgagtaaacgcctcaatgctgcagttcttggaggcctcgcccacgatggctgctccttgggggctgaaccttctccaggatctagagctgccacccagctactctttaaaggagcaggaagacacgcatgagggcatcctgcctgcccctaacaatgtactgctgccaccagacaaaggaatggacagccatccctctgcggtggagcagaactgtctcctcgggcccggctgggctgaggggtcgtggccacaggctggcagcccaaggacggggacatgggacatgagggcactgaggagagtgtggggacagctttgtcctcagaaagaagccacccttgacctcattttctggtgccacttccaaatttcacatgtgctctactcttgttaagcatctactgtgtggggggcactggggacactagagtgaggaagacccccccctttcctgttgggacacggattattcctctacagcatggatgcagcttcttgttagcttatccagcagattagctgtcctgaatgcatacccacttctctgtgccagccaggcaaatctcacgggagagtgggcagacgtgggagaagcaatccaagacggcttcctggaggagggggtctatgagcccagggccaatcaggacctttgtgtttggagaacaggaccctgttctctgcctgagaaggccttcccccagatggaatgcctctccctcaggctctgcttagatatcccctcaaatacccggtcacccctggcctactttatcctctgataagccctgactttagataggatcgggctaggggagggaaggtggctcatgaaggtgcctgggcacacagaaagttctcaccagttgcagacagtccatggggtaggtcggctagaagcctggcattgcctatcacccacagaaggcagtgggaaggcagggggcggccggctgactcagcctatgccctgtctcacggcagcctcctggccacgcatgtccaaatcctggtctccaaaagcatctgggagccgctgtcctgcctggtgagccagggggcctttgcaattccactcattcctgttgagcccagagaggctgagccatggccaggggtcatagagcacactggagagtgcccggcaggccaccatgaccagggacacactcctactttgccacggctggtggtgctgcctgtgggaagagaaatatcccaggacccagaaactgctcgaggcacccagaggctgtgctcagtaccccagaatactgcaaggaaggagaagaatactgcaatgggctgagcagtgcccattattcagatgaggaaactgaggcgcaggaggtgatgaggatcaggtggtctgggggcatggatattttggaaagtagggaaactgagcagacccaggggcccagggatgtaggcaaaactcttgctcactcgctcggttctcaggtgggaagagagctgtgctttgtgttggtggcctggcctagcaccctacccccgtttccacagagttcacagcaacactgcaggtcagggcaatggcccagagatggaatgggaccaggcaggggccacacaacaaatcaatggcagggccgggtccaggtctcagccccatcctggctccgccattcagaccccagccctgtctccggcctcctgagcccctggcttgaggctgggttggggaggcttgggcgtgggatccctcttccacggtgggcttgtcctggtctgggtggggctaaagtgctgagctgcagggtccaggggacaccaagccccctttccaccctctggttttcttgtcagtcttagggaaagagcttaggatctggggccagcaagcctgggttcgagtcctggttgtgtgacctcaggtcagagacagctccttgctagcctcatctgcaaaactggggtgacagtactgcctgtctcatgcccgttatgcctgggcatgccgcctggcacacagcagctgctggggaagggccgtgaggtggtttcccttcctcccagtgccatgggcagcatggggtgggtcaggctgcaggctccagctacccctttgaggtgctgtgggagccctatgaggcccttccctccctgaacctctgtctccctagatggggtaccagcaggtgggggcctctgtgctcaaccgtgaaccaacgtgggcatgggatgggggtgggagacaaggtgggaggcccagagcaggaggtgaggggctgagggctcagctgggacagggaggcagccacagggtctttggagtgcccccagtgaggcaggaaaatagggtctgaaggcagggaacataaggccaattcccacttcagctaggacaggaaatatcctctccgtggggtgtaggccaagtaaataactttgtaattttacttcatcctctctatttacatagggtgtaccccaagtaaccagtggaatcctctggagggtatttaaactcccaaaaattctataacggggcacttgagccgctacgctcgggcctgctccctcactgtggagtgtactttgattttcagtaaatcccttcactccttccttgctttgtttgtgtattttgtccaattctttgttcaagattccaagaaccaggacgctctccaccattaacgccatctccctgtcctgttccacttcctgcctctctttcccccatctctgtgtctctagctgtgactctgtcttcctgtttctccatccattctctttctgcttcagtctcattgcctcctgtctttggccttgtgttttctccgtctccacttctctgctctctcaggcactgcttctcatcctgattctctctcctctcaggcatcccagagttctagtgttatcggcgccctgggtccttgtaatctgccaggatagaaatcaagagcgatcaccagacatagcagcaaagagaaagagctttatttagcttgtgcacgagggaagtcagcaacatgaaaggaagagggcaggctgctccccaggggagtgtgtgggttagatttctagggcctttctatggagaggggtttcagggttcctccaggggagtgtgtgggttagatttccagggcctttctatagggaagggtttccccaggggagcgtgggggtcagatttccagggactttctgtagggaaggattttgccagggcatgtataggaggaggggtttctctagcacttgcacagtggctcaacacactttttcaaacattgcatgtaacatcagcattttaaatctccgtgcttgggcacgatttgcagcattaaaatgaggaagagggtaagttgaagtttaagtctaactgcacatgcggggccccagggaagtccctagccccctagagcaggaactcgtggtgaatagtttcctgggtctttggctgctgattggctggaagtcaggtgagctacagtctgataaggggtttttgtactttttctctaaaccacatcaaaaccaggaaaccagtcagcctgcctgtctcacgagcccctatttcctgttgtagatggtgaccagcttgtcctggtttgcttggaactgtcctggttttcaaatgtaaggttccacatcctgggcaccccccagtcctgggcaaaccagaatggctggccagactgttgctgtgactggagtggggcataccctgcctgcttttttctgggccttacctgctaagtggtgtccaaggagaggccctgggggtctgggtgtgggatgggctggtgactcgtccctctgtgcccttcccacccactcttgccctcagtgctggtgcccacctggcatcccggacaccatccagggcaccctggctggatggcctgtcttcatgggccatggtgcagggctcaggctagagatgagtgggggatgggggcccgaagcccctgctgtgcctgatgtgccttcggtatgtcccgtccccaggtggctctgcacttgatgtcaaggaacacagccattgcaccacagcttggtcctctgacagtggcccagccacggctccgaggatatgcgccctccctgggcatttccaggccttcctgttggctgtgttctttgtcctgatcaacgtccccccgcagatccctccctgcacgcaggagttggtggtgagggactggccctgcgcttcggctcctagattctccatgcagcaatcacagcccaaccaccaactcctcactcatcaggagctcacacttgctgcaacctcaggcttctagacttcggctggggccatggatcgtggcctctgagctccacaggtcctcatgcatgatgtaggtgagatgtgttttaagtcctctcttggtgccaatttactcaatatgttcacaagttctaaccaccttggatacgggtttttcaaagctcagagcatattaggccggtgatgtaatataactgttaagggcatggacccagatggcctgaatctgaattcaaattctgtcctgtattagacccttttttctaagcctcagttttctcatctataaaatgggttcaatgatattacctaccccatgagatgttgtgagtattcaatgagatcatcacagtgcctggcatggaaaaatagcaactttttattgagtagttgttttatgcaaggcaagactacatttaacccccacacccatgggattcagagaggtcgggtaattggtctaaggtcacacagttaggaggaagctacatccctaaccagcaggctatcctgcctctgcagtagtaatgactaacatttacggagcacttgttatgtaccaagcactattcaaaaggcttgatatgttctaaagattttacttttaatcctcacaattctgagaggtaggtactaatattattccaatcagttagataaggaaaccgaggcacggggaggtaaagtctcttgtcaaagggtcacatagctggttagtggtgaaactgggatttgaacccaggaagaagcctagctgcagagacagtttttcttttttcgttttttttaggtgatgtttttaaccacactgttttttcttttaaaacagcctgtgtctttatcttgatcctctgagggtacctaatgcccaagaattatgagctgttattatcattattatagacaagaagctggaagaaggtgcaggaggctttgagggtaggggcatgctgacagcagagcatggaaaactaagagcagagctcaggtgcgtaggctggacatggtcccacggctcagcaggtgaaggggttaacagctcttcttcatggctgaaggagctacgtcctttctggaaagacttccatcaagttagggagaacaaacagagctgtgacaccatcagagtgggcccctgaggacaagaaattgacatgggggatgtagccatgaagtggtgactgccaacgtgcctctgatgtttgctgagaactttgtgcctctttccatagcctcatggctgcagtcccatttgagcctcagaatggtccctgtcaggcaaaatgactgctctgctttatagattagaaaactgaggctcagatgggagctgtgacttgctcaatggcacactggctcctgtgctgagctccaaccccaggctggaatgctcacacacccaaaggtgggcactgtgtgtcaggcctctgagcccaagctaagccatcatatcccctgtgacttgcacgtatacatccagatggcctgaagtaactgaggaatcacaaaagaagtgaaaatggcctgttcctgccttaactgatgacattaccttgtgaaattccttctcctggctcatcctggctcaaaagctcccccactgagtaccttgtgacctcacccctgccagccagagaacaaccccctttgactgtaattttccactacctacccaaatcttataaacagctccatccctatctcccttcgctgactctcttttcagactcagcccgcctgcacccaggtgaaataaaccgccttgttgctcacacaaagcctgtttggtggtctcttcacatagatgcgagtgaaactgtgatcctggtgtcacaggcctggggtgtatagagaagtcaaacatggcttcccgtgtaaactgttagtgtaatgcgcaaccttgtttttactaaccctatttttagactctcccttttcctttaatcacccagccttgtttccacctgaattggctctcccttagctaagagagccagacagactccatcttggctctttcactggcagcgccttcctcaaggacttaacttgtgcaggctgactcccagcacattcaagaatgcaattaactgataaaatactgtggcaagcaatatccgcagttcccaggaattcatctgattgataacgcccaaaaagccctgcgtctatcaccttgtaataatcttaaagcctctgcacctggaactgtttactttcctgtaaccatttatccttttaacttttttgcctactttatttctgtaaaattgttttaactagacccccctcccctttctaaaccaaagtataaaagaaaatctagccccttcttcggggccgagagaattttgagcattagccgtctcttggccgccggctaaataaacggactcttaattcgtctcaaagtgtggcattttctctaactctctcaggtacaattcagtattgacgccgagacagggtttgactatcagggcctggcatgttcagttttcagagctgctgaatctttatcccagtggtagaatcacaggaagaaaaggcccatggaggcttgcacttatgcccatttctaccatagagacgctgggtacccttaggcaagaccttgctcctctctgggcctctgtttgccacgtgggccttgaattagattagcgtttcttaacatgaggactcattttctcaacatgagatgtcaggatggggaggaccctagaacgggtagtgtctcagggttgagctgatgctccacagaacgtgggctccagacttgaactgactgacttgggttcaaatcccagcttctctactcactcctggtgtgaccctgaggaagcgtctaaacctcttagagcctcagtttccacattcataaaatgggatgaatgattggcagcttaattccctggtggggagaagacatgggctggtggcggggcctctgggctctcacagggctgaggacagccacaggtaccccacagtgcttatcaaacttgccagcagtgaccttggggctaaagctgacttgggcacccccatggtgctgttggaggagggcccgtggatggtggagatgtgcacccttgtggagctgctgctgtgtggacccaatggttcgctgcctcctgctgctcggactcaaagaggtgagtgctgcatgaggcaccctcaccctccagctcctcccctcactgtccctgtgccataggccctgccggactcctccccactgaggggtgagtgactgagagcagcacagacagggacagagcttcaggccaaaggcacgtgatgggaatggaatgatctcagcagcaggcccacaggagctgcacttccaggcagagatcacagttgtggggtggaggtggaggcctgggagggccctgaggggtggggcgactcctggatgtcatctgcacggaccttgggggaccgaacaaaggatgacaaacgtgggaataaagataaagacaaaagagtgtatttggaagaaggggtcagggggctccttgcttctagtgaacaagggctcttagctttacagcccttcgcatttgattgggtaaaggagatagggagaagtgggggtggttgtcgatcaggggcttaatttacagcaggcttgcaagactgcattcttcaaacaataggttctagatgtcccagtagataacctcaatgagcacggtgccagggccctcagcaaaccttctggcagtaggcgcagtcgtgagtttgcccacatcctgcattcatgataaacagtttgctgtttgatcatatagccagtggaatgctgagttggtcacgattcctttggccttttcagctccaaacacctgggagctcctctttgcctcacccccaatcccccttgcaggatctcatcctcagagccatgtttgtggttgatggatgcaaactcactgtctctgtggacatgaagagatgagcagaatggctgcaggcacaacccagacttcctggggagcagaggttaggcagctggcaggctccacagtcacagttgctcaggaagtcctttcttattgctgttgttcccaggaggctgcctctctttctgtccctctttccctgtggatccagggactggctccaaacctagcagggccagagctcactccctccttgctcccatggcgtctggtcacattgatggaaacggaggctcagagaagttgagacttgccctcagccacacagcaagcgaccagggctgagtgctggattcctgtcccaggctgttccaaggcagtccctcttggggagagcctcagagatgccctttctctctgctgtgcctccctcaccgggtcctcaccttccatgaggaacgttcctgtaagtgaggccagggcttggggattcgggcacattctctctgaaggatgaagggttgctggtggagggagatctgctctgatgcttcctccctcaccagcccaggtgtcagacctcagcctatgagctcccaagctccagtgtgacctcctggtgcccagcactgatggtcagctctgacctggacttcctggtggggttgtggtcgatagcactgccctgcctgcctgagccccacggccgacctctgagctagctccaccggcttcaggaccccacacagtgcccagcaggccactcaggcatccacacctgaatggaaggcgaggcgttggtctagtccttcctgcatgaaccaaggccctgcgagggatagggactggtgagtggtcacatagctgggaggtggtcgagctgaggtgtcacttacccagcttccccctggcagtgccggagtgctcatgtcctgcagcccagcagcctgcatgtggcagggctcttgtgatcaccagatcctgtagcgacctctggtctcgggaaagggggaatgagctagctttgcctggtgtggacaccgaaggcagaacctggactcggtgcctcagatactggctgagggcccccagctcatgagggcgagggagaggtatttggagggtgatgagaagggtggtcagtgtgggtctgatctcagtctctctgaaggcagctagctgggagtccactggagacatagcccaaaagagtgcagcagaaggctctgattcttttacgtagattagcctgattttggccttctaccccataatataatttaatatggaaacactccttaacagctgggagcagtggctcacgcctgtaatcccagcactttgggaggctgaggcaggcagatcacttgaggtcaggaattccagaccagcctggctaacatggtgaaaccctgtctccactaaaaaatacaaaaattagccaggcgtgttggtgcatgcttgtaatcccagctacttgggaggctgaggtgggaggattgctggaacccaggaggcagaggttgcagtgagaagagatcacaccactgcatccagcctgggcgacagattgaggctccatctaaaaaaaagaaagaaaggaaacactgcttaagtacttacaggtaaatttctttaccttgctctgcatgagattgccaccctgtgtcacttcccaacttgctggcttggccagggcattcctagaatgttttgggggccagtgggtatcatggcttgcctggacatggtggtggggataggttctaagtcttgatgactttatacttttttttttttcgagatggagtctcgctctgatactcgggcaggagtaccatggcgtgatctcagctcactgcaacctctgcttctcgggttcaagcgattcttctgccatagcctttcgagtagctgggattacaggtgtgcaccagcatgcccagctaattttttgtgtttttagcagagacagggttttgccatgttggccaggctggtctcaaactcttggcctcaagtgatctgccggcctctgtctcccaaagtgctgggattacagatacaaaccactgtgctggccgactttacactttctaactctggccaagattaatagggttggtgtttatttatttctttctttatttccccctctctctctgcccaatgtcctgggtatcagctggtgggcaccattgtgaggccgatagagtaggaggtggtgtgcccattgtgtagatggggaaactgaggcccagagagggccttggctggactccagggctcccacttctcagcccttgcttttctccctgtccatttatggacgagccaccatgagattgtcaccctgagattgtcttgtccagggaatgctgctggtgtgcttgtgaccctgaccctagcctctgtgaggaccctcaaggagtgtcccctggggacttgggtgagggcaggctgtgtcagccccctgcccatccacagcgggccttatgctgcaaataaacgtcactgtttgctccaattcctagaacctgaacctgtgccgtctcctgtgccgtcaagagccctcctgttcactcacccgacttctatttatggggcagctcttgcatgacaggctctgtgctaggctctggggaccccacttatcacacagccggcaagagcctttcacactggcatcctgggggccttaggccacttctggcagggagaaggtgaggacaggcatctcctggtgcagatgaggaaagtgaggctcaaagactgactcccttgggcactcagtgaaggggcacaggccaggggaagggcctaggctctgtctcatcactgggcccttgccactgtctgtccaggggtctcgtgcaggggtctctgagtctcatcactgggcccttgccactgtctgtccaggggtctctgagtctcatcactgggcccttgccactgtctgtccaggggtctctgagtctcatcactgggcccttgccaccatctgtatggggtctcatcactgaggctctcgccaccgtctgcccaggggtttctgagtctcagagaagcagcctgccccagccatgcctggtctggcctccagggattagcggattagctaaaacctcagggcttgaactgggcgtaacggaggcgccactctggcggccctgtgggtggttggcactctgcacctctggttcttgtcttggtcgccttggatcccaccctggctggcagccgactcctctgctgcagtccagtgggtgggctgagtggcgggcaggcggccagccttgtgcattgtggacctggactgggggtgggtgggagggagacttttgttctcctgctgccccagaaacgagcccctccccctgctgggctgaatcaaagtcctattgtgggacttgggtgagactgggtccctcgcagggcctcagcctccttgtctacgcagaggggctattcaactgcactgtgaactgtaatgctccatccagggactgctgaccttggaggacaggagggagtgtggggaaggggtgggtggataaagggtacctgatcatctggtcagggggctgagctgcatgcagtggggctcctcggatgtaatgacagaactcccattcattgagcgcctgtccattgtttgtgcgacagtctcagccatctgggttgggggagggggtgggccaccatctgctcccttgggcatcactgtaagaaccagggttcaaccctctactcacggctccacggagttggctcagccaaacttactgggacctgaatggctgtgggaagagttgagggggggaaccaagcattttggggcctggcaggtctggattgggggtcagagcatcactgtgactcactgtgtgaccttgggaagctgccacatctttctgtgcctcggtttcctcatgtctaggggaatgttcagtccccatagtcgggtggagatgtggtgacaggtgtgacacaccgtggattatgtagtgtttgtggaccgggtgtccccctgggagaattacatgaaccctcaggagggtggcatggggttgggggcaagtgccacatgagtgtcaggcagcaggagctacctccaccacagccctgaccacagagaatgtcaccaagggtaaggatcccattcatcatagtcctaaaactggtaaagtatccaggattaaatctcgcaagaaaagtgcagaattcatatgaaaaaagcgaggatacctgactgaaggacgttgaaggaaaaccataagaaatgggagaagaatctatgttttgagaagagctgacatggccaagagatttgttcgtcatgcataaaaccagtgccaattcagcagcattttaaaaatgcaagttgacaagctgattctcaagtttgcctggaaaagaaagtggatgagaatggccaaggaggttttgaaacaggaagaaagagggggtgctggtacgtaccaaatatattccaaagctggagtcacagagcatggtggtcatgcaggacgagacagggctcagtgaaacaaaaaagaggccaggcactgcatggagagtgtttccaagctctgggaaaagacgaaccattcaatgatgatcccatattgtggtctttgggtagtaatacacaaaaattaaattagattccctacctcacaccatgcacaaaaataaattccagatgcattaggagcttttatacatttatatattgtgtgggtttatgcaccaacaagtgtatatatattcatatatatgtatgtataaaatgtgtgtataataaaattaacagaggaccagcctggccaacattgtgaaaccccgtctctaccaaaaagtacaaaaattagctgagtgtggtggtgggcgcctgtagtctctgctactcaggaggctgaggcaggagaattgcttgaacctgggaggtggaggttgcagtgagccgagatcacaccactgcactccagcctggacgacagagtgagacactgtttccaaaaaaaaaaaaaagattagcaggagaaagtacaggagtatatgtctataaacttggaactggggatgtccttcccaacaatgcacacaacttagatgccataaagaaaaacattgaggtgataatattttcaagaaaatctgttgaacaaaagacacttaaagacaaatgattgggaaaaaacacagaacagctggaggagtgagcctgggaggggcatgtgggggtgggggaagtggggtttttcaatggattcgctttttagcaaacctcagtttgatttggctttttaataacaagaatggtttacagaaaaactaccctaatgatgccaggctggacgtgtatggcttccaggtgccctgattgcttggaggagcagggagcagcagggatgtgaggcgaccccttgaagcccattccactgtgaggcccatcagagatgggcctgggtcaggtgctggaggaaccctgggtgctggcgtggaggcctggcaaatggccagaatggcggattctgcagcagggatatgaggcgaccccttgaagcccattccactgtgaggcccatcagagatgggcctgggccaggtgctggaggaaccccgggtgctggcgtggaggcctggcagatggccagaatggcggattctgcagcaggacgggctggtacagggtgccctccctggagacaagcatatttccgatctgtccacccttctaatgcccagctggccctgtgccagagtcttcacttccctgcccttgcctgctaggaattccctccctcgaaggctccagttcctgctgccattccagctgggccagcctgccctattctggagctcagcccctcccagaggactaggcctcctatcacttgcctggggccagaggttgacaataaccttgagggtcatttacccagcacctatcatgtgtcatgctctgtgctgagagctttgtgcacacagctcctgtaggttccaggaataggcactgtttttagcacctctataagctctcaagacaatgctagagcaggatggacctcagctatggcaaagattacacagacaaaatatgagtgactgaagtttgggaaacaatacttacatacctggaaaaactgaagtccagagagggtgtctgacatgcccaatgtcacacagtaaattgtcagtatgacgttgaaacactccatagtgggtagggttgggacctctcatctatcaccttgtctgacacaatagtcataatcctgtccctattttatggctgggaagaccaaggctcctagagggtagggtcttgaccgatgtcacacgtagtttggggacagagcttaacttgaagcaagaaaggcttctcatgtgcaacagtcagactgcttgggtttgaatcctggagctgccatttgttgtctgtcatctgcagcaagtcagtttgctgcttggagccttcactgtccccatccgtgaatggggtctcctggggctgctgagaaggtgcctgggcacccggaatgggatcaaccattgctaaccatcaaatgctcagatgtgaaaggctagcctactccctctctttggggccaaaagacactcagacttggtctgggggtaaagaataaattttaatctctcttagggtaggggttctggtgaggctgctctctgggcggggccacagagccatgcactcgcacgcggtacaggcaagtgaagcctgggttcccccagttgcttgagatcttcaccttgaccgcactgaaagcccgggccggctggttctggaagagaatcagtcacagaggcagctcacccatagactcccaccctgcctttccaaaggtggggagtggaagggaagtttcccatttcataggtgggaaaactaaggcccagacaggaggatggactgtcccaaggcctcacagcaagtcgatattcaggagctcttactgaagatgctgaggccagaaggacagacatgctgtgggtaaggaaatgtcctggccttaatgctgtgggatcttgggcaaacctccaccctttctgggcctcagtctcccactcctgccctgccccgcccgtaagatgggaatggtaatatctgcttcccaggattgcggtgggcatgaaatgagattttgggaacaggcggcctctagaagagaatcattcacagaggcagctcatccacagactcccggcacatagtaagttctctgtaagtgaggcccctccccgtttttgccaagcaagagggggtggagcctgtgtttattactctccctatctagtgtaaaaagtggggcgggcttggccttcactgaatgttttcaacctcccagggaatgacagaaggggaaaactgaggctccagagaagcagggcttggcccaagctcacacataatttgtggttgggcagaaattcgggccagtatgggtttgattcccaagcctgaaccttcaccctgtcaagccccagggccattccagtggtcactcctccggacctgcttctgtctccaaacccctctccttcaggcctcagtttccccacctgtggttggatccagtgataattatggggccacccactacggagactctacctttggagccagcagcccctgcccaatgggaacctcttgctcagcgtctgctgtccccgggaagaaacacagcaagagggctcctgggctcatcaggaaaaaggggacatggccacaggcggtgggatctccctggagtcccatttggccctgggtagcggctcctactctctgagcctcagtttccttgcctgtcaaacaggttagtcatgactgggcacctcctggggatactgggggatgaagagggggtccctgggtacagactgcacactgtgcattcagcaggtgctcagcacaggcagctcttcgcaggtacctggagtgggaacatctggatgatgttttctggctgaaactgaaatgcccccaggaacacctcctccttgggggagccctccatgccctgtggaaccagaaccaaggtgaaggcgtcagatacaagcagggccctcagagggtgtctcccctctccagtggagacttgcacactccccaggatgggagctcactacctctttgggcaccgtttcactgtggcacagtgtaatgaataggaaagagcactggcctgggagtcagagcctgggggtctatgactagctctgccattgacttgtaggattagggtgtttccctgatccttctctggaccttatttcaccgagacagttcagataacgcttcggaccttcttagcaaaatgggggctccatggtctctgaagattatctcggctctgaaaagcttggtttaaaatagagtagctgtttatcccctacccttgaaggctgaaattggaccccagcgctggccacttccagccttaaccaagctgcattcagcccctccagcctgcaagtgttgtgcagacactgtttaccccaggcctggaatatcaccattggaaggttgtccctttagctaagcatagctccctgcaggggagtgctcacatagatgacgaagtccttgggggcggtgtccaggctgcctgacaatgagatggtcttggggatgtgctgcagcgtgaggttggacaggtaaaccttctgagccaattggatggtcacctggccgcggtcaccctcaaaggcccagcaattgccaggtgtcacgttgggctagaagaggcaagtacaataagggatatgctgggtgggtagggggatcatcccacctttgatcccctgtacttcctgggacctcctgggtgagccagtcctttcttgtctccaaagcttggctcaagtgccaccccctccaggaagctctcctgactacccatgcagggggtaagccttacttcagttcaatgcagtaagggaggggcctgcttgggacctcccagcctccacccgctccccactggcacccattcattcattcatttactcactcactcattcattcattcactcattcatccctcccattattctttacatggtcttacaatcaccccatgacttaggcatcatcactatccccgttttgaaggtgaggaaactgagttgggggagcaggacaatgactggtccagggccatgcagagctggaagtgcagcccagggaatctgaccttggaacttgccattaagcaccacgatctcctgccccacagacggggaaacaggcccagggagagaaagaggtttgatggaaatcacccaggaaaggcgattactcggtcggttctgagcttctggagccatggcatggacagtccttatttgaacagtggatgctagcccaggggtgcagggggctgtgggtgtcagggaaggcctcctgaggagctggggccaggggagatgaggagccagctgggaaagggagctaagggaacagcacgggaaaggaccaggggcgagccaggcttgatgatgtgaggacctggagagctcagtcaggctggagctgggagagggcccaggaggggcagagtcttggctgggctgcttttcactactgctccaaacctgactgcagccagcgctttgcaacccagccactgcccgccgcgtcccccgccccagcctggatgtgtgcaccaccccccactcccgggccctgtgcttggcctgtgcccctgcgttctatctgcctgcggatctgctagtcctcggctgcggccaccaggaagccccttgccccgtccaagctgagcaaggccaatgccccagcttgacctcgagtgccaagatcttggagctccttaaggtagaacccacggatgagtggcctgtgaccttttggcatcacccagggtgtgccactgggatgacactctcagccagtgttcactgaatgaaggcacctgctttgtgaccaggacaagccctttccttctctgggcctcattttcctcatctgtgaggcaggatcctggagggctgaagagctcaggtttgaactctggctctgctacatactagtgaccagctctgtggccacagtcaagtgacctggctctttgagcctcagtttccttttctgcaaaatgggtctatgatgggcccatgcccagtgtagtcctgaggtttctctgaccctcaaatcttaagggctgagtggtggggtccctcccaatgccaaagcaagctgtccctctgtttcgctcctaccctagccccagcagcccctgctgtctgttctcacctcctgcccccgccttctccccagcccccgccttgtcagtagccccctccttctgctccctgcctttgcccctgcatctgtctcctgctcctacctctaaccccgcccctgcccccactccctttgctcccaccccctacctcttctgccagctcctgtccccaaaccctgcccggaccactcccctgccgctgtcccatctcccgccatcccccctgcctcaaggatcacgtctgggggctgtgcgtagttccacagctggatccagttccagtaggagtgggccttctcatggttataggtgactgacgtgtgctcaaagtcaatgctggcccctgtataggagaagggggtctcagccaagcagccgggcttctgcctggtggaggggacgccactgatgggccctgactatgtgccgggcgagcattttggatgagtcactggccctgttctcctctaggaaatgtgattacagccatgttaataatggtaatcatggtggctattattttttattttatcttatattttttgagatggagtcttgctcagtccccaggctggattgcagtggcgcgatcttggctcacggcaacctctgcctcccaggttaaagcaattctcatggtggctattattagcagagccatggtggtggcaacggcccccacgtcatagggctgctgtggcgctgagatgaatcatcagagcacgtttcccaaagtgcctggcacagggtaagcgctccccacgtaacagtcttgtgatgacgaccgacacccattgtgcagaggaggaaattccagctctgagaggctaagtgaggcccagtgtcactcaggggctgggctgacactatctgaccccgcgtctcactgatcctgggggtgcccgagttggaggtgctgcctggtaggggtttgcgttgggggcagcctgcggcccatactttgcctcctcccagctgtccctgaatggctctcaccggcctcctcacagcctccctttgtctggagtactttctctcctcaccaagtctcagcccaaacgttctcctgagagggaggcctctctgcccaggtcccctccctcctcgccacctgccttattcttccggaagcactgattattattttatttatttatttatttatttatttattgagacagagtctggctctgttgcccaggctggagtgcagtggcgcgatcctggctcaccgcaacctccgtcccccaggttcaaacgattctcctgcctcagcctcccgagtagctgggattataggtgcccacaaccacgcccagctaacttttgtatttttagtagagatggggttttaccatgttggccaggctggttttgaacttctgacctcaggtgatccgccttcctcggcctcccaaagtgctgggattataggtgtgagccaccaagcccagccctgaagcactgattcttttttttattattattattttactttttttattttttgtgagaagcagtctctctctgtcgcccaggctggagtgctgtggcgcgatctaggctcactgcaagctctgcctcccgggtttaccccattctcctacctcagcctcccgagtagctgggactacaggcgcccaccaccacgctcagctaattttttgtatttttagtagagacggggtttcaccgtgttagccaggatggtctcgatctcctgacctcgtgatctgcccgccttggcctcccaaagtgctgggattacaggcgtgagccaccacacctggccgaagcactgattcttgactgcgggttggagatggctctgtcttgctgacctgtgtgcccagcatcgggtttggagaagagtggtgggtgggggtggtggagaggtaaagccaagaacagcctaagcacatagtagggtctttatagatcttctataatgttgagggcctgtggattcccgtgttccctcccaccccaccccacccctacccccataccccaccccgtcccagaaccccttgagagaaaacaaaattgtagcaagaaaaccagcttggaacagaggatgaacttcccagcggcagagggagtaccacaccagaactgaaacccaccctgtgtacagcttcccaggacacttgaggcagtcagatggtggggaagggggtcacctacctatagacttcagggcaaagtctggcttttcgatgtaatctccgtgtatcatcttcattattttctgggccattttttgctgaaaaggcagaaaacacaagttgtgccctggtgtgttgtcacggactgtgatccccacgtgtccacgggaggtaacagggggctgcaggacgctgtcctctccctaacagcccacccctgcctgtggaagcctgtggctctgtgaaagcccaggtgacacaaagccatcctgaccccaccctgggttcactgggtgctttcaagtccactgtgaccagatgtcatatggaggtcccggagtctcagtgaggttcaggcaggggctctgacgtcaggccaacttttactgttgtggggccttgggcaacttactgcccctctgagtctcgatattctcacctgtaagacggggacaataatcgtgtctacctcccactgtggatctgtaaagcccctactatgtgccagggctatcctcggcttcacatatgctcaccctatcccctcccagcacccctaagaagtatgcactattatcatccttgtattaaagatgagaatactgaggcacaaaggtgtagcttgttcaagatcacccagctggtatgaggcagagcgatcactgtggttccagagttcaggcccttaaccgctccactctgctgccagatgcggatggcaaagcacttagcacagtaggtgcacaataaataccagctgttctttttattagactcttcacagtggtggaagattctgttttccaaaaatggctgcaacaaggtctcccattccaggctcttctttcagtgtgacctcccactgagagttggggtctaagctcccttcccaccagtctgggctaatgacttggcagaagtgatgctgtgtgacatctagggctaagtcctaaaaaatgatacagcactgcctggttctctggggacagccactcctggaggccagctgccatgttgagaggaagcccaggccacacggagaggccacagatgggtgctttgatcaacagccgtaactgagtcccagttgatagccagcatcaatctccagtcacgtgagtgaatccagatgattccagccccagatgtagagtcacctccagccttcaagtcttcccagctgaggccccagataccatggaacacagacaagccatctccactgtgtcctgtctgaattcctaacccacagaatctctgagcacaagtggttgtttcacacccctaagttttgggatggtttgctatgtggcaatggtaactagaacaatagccagggtgttacaaggcagtgattatgattctgtcttgttgatgtgcaaactggaggctcagagaggttgatgacctgcctgaggttacacagctccaaaaggcaaaaaaatccccaactcctcccctcgtttactggggacaataatctcacctattacttttcaaaactgggtcgccaaccctaaggaatttccctgatggcccccaccctttctctgccccaaggctgagtgcagtcttcttctctgggatccacaggtgctgggactggcttgagggcaaggacgagctctagttgatccccgatcctggatccccagcacgcagtaggcacttaatgattgcacattgatgagtgcatgcctttggattctgcctttgtttaaatgcaacacacatttagggagcactcaccataggacagacattagtctaagtttacatgaattaccatgtttaatccttacaactcatcttctagatgaagaaactgaggcacaaagacggtaagtaaattgaccagagtcacacagcttataggtggtggggatgaaattcaaagcctagcagcctgactctagagccagtccttataatcactataccttactgcctttgtaagtcatagcggggcttccctccccactgcagaggaaacacctgccaagagcctcacttgacagtgagtgactgacacggtctctcctcctgggtctgtctgaacagagcttagaggggagattcaggggcactggagacctaggactttgggacaataaaagataaagatgagttttagcaaattttgctgaatcttgcacaatggaatttatctttgtgaactcttttaaaaattcaacttctaggtaaagttgatggatcgaagacatcacgtaattttagtttctcccaacactccattacagcttcagtaaagggatttgaaaagacccaaacccatatgaacaggaagcacaggagaggagaaaaccaggctgctgcgtatggttgtgcacgttgcgcacagcagaaaggttcccagttgaggggccctgtgtgggtgctgaaacccagctcttcccctgttctttgatttggaggaaggtgcattttgcgaattcatctgcccagcacagatagttttttccagtctgcaaaaaggcacaatgtgtcccagcagtggccctggagacagcagcaatattctggaagttgtcctacaccttgtaggatgtttagcagcatccttggctacccactagatgccagtagcgtctcctcctcacattgtaacaaccaaatatatctccagacattgctggatgttccccagggggcaaaataatccccaattgagaaccactgatttagcagaaatgagaaatctgaatccgaaactggccatcctcaaaaagctcaggattggtggccttaggtgcccctgaaattggggtagagaattgggtgttaagacagttaagaggaatctgcatattccctggggactccctctcactctgagaagctgagtggacttctctgttccccagtagaagactagaagttattctctggagagggtaaaacagaagggctctgttgggacaggtgaaggtttcttaaataggatacccaaagcactgcacaaaaaaacatagatacactggacttaattaaaattagacatttttgttcatcaccattgagagtgaaaagccacgctatagcctgggaggagatatttgcaatatgtacatccaataaaatatgtttacccagaacacagaagaactccgacatatcaataagaaatggcactctcccccaaaaggcaacagacaaaatccaaatggccgctggatacaagaaaagacactccacattattaacaaccagaaatgcaaattaaagccatagtgagataccacttctcaccctgcagaataaagtaaaaaagacatatgacaccaattgctggtgagaatgtgggacaactggaatttgcatatatttttcatgggagcgtaaattgaaaaactatttggcagcatctaataacatgaacacactcatacctcatgatccagcaattccactcctagttatatctaccgccaagatcaataagtatatatgttcacccaatgatatgaaaaaaattataattgttcaggagcagacattcaaacaacaggagcttcaaaaataagaatagagcaaatgctgctgtgggaaatcaccaatttagtcacatgaataaataacatttcttaggcccaaaggccaggagtttccagattgacggattccaaagggtggccagcccataggcacatctgtggaagcaacaaggaccagatgaactaaaattctgcagagcagaaaaccattctgagatgtgctggcattttttgtccgtttgttttaaatctctgggggtatttgacgattctaggcataggctaaggatctgggcttaggccagacaatgggctgctgctactggtgaaagagaaggaagcaaagttcttaatggtgacaaagagctaaagtaacaaaactggggacttgaggagcctcaaatatggccacttttcttcacaaggtattaactgaatttcaagactataggaggctataggccacttcaaacatttctgaaaagcagaataaaacttcatatcttcacagtgcttaggaaacgaagtccctttgagggagggcaccgcaaaacacaacaagcaagagatcaaggccttagaacagtgattctctctggtatatgtcagaaccacctggaaggcttgctggaacacagatgattggtttgcatcttcagagcctctgattcagaaggtctgagtgaggcctattaattcgaattgttaacattttcccaggtgatactgatgatgcaggcacgtgggccgtgggccgtactttgagatccattaccctagaaggggtggtgatgagtcaatactgtgcttcagctgcacttcacctgggggcactaaatcaatcctgggcacaattagaacccaggaatccaagtttgctcctggcggagaaggctgccaccaggcccagagatttttgcgttcatgcaggggtgagagacacatttggagacttgtgaggcctcaaacatacagtaagtctgccactaagacagttgtcaaatttttgaagctgcatgggaaggagtctaaagagttaagcttaaaacctctggataaatttttttaaaattgtgatccaggtctgtctgaactagcttagtgcatgtctagatagaagtgaccagtctatttcatcctccttataaagaaaaggggaactttctctagtggaattataattatttggaacagctacagttcttttgtatacaatgttgagaaaccactaaaagttactagacttgaagaggcaagaccatatcattgatacccaagataaaaagcagaaaacagagggaggccacagatgatccagacattggagttagcagacaaggatttttaaaataactgttgctaatgtgttaattaaaataaaggaaaagatggacaacataggtgaaatgttggggaatttcaccacagaattaaagtctgtgaaaaaaatcaaatgtatatcctagaactaaacaatgcagtatctgaaattaagaactaaggctggatgcagtggctcacgtctgtaatcttagcactttaggaggctgaggcaggtggatcacttgaggtcaggagttcaagaccagccaagtcgacatggtgaaaccctgtctccactaaaaatataaaaattagctgagcgtggtaatgtgcacctgcaatcccagctactcaggtgtaggatgcacttgaacccaggaggcagaggttgcagtgagctgcctgggcgacagagggagactccattaaaaaaacaaaaagaactaaatgcatggatttaataataaattggagagacagaatgatgcaagattattagtaaacctgaagaaaggttaataggaaaatatcaaaacataagcacataacagaaaaagaatgaaaaaacaaaccaggtaatagcgtaggaatcacataaagcactctaaaggctttcaaagcataggcctagcataggtgtaattagaatccaaggaaaggagacagataatggaaagaagaaatattttaagagataaaaggtaaaagtttcccaaaactattgaaaaatatcaacccacagatttaataagctcggcaaaccacaaaccaggttatatgaggaacattagagacaaaaagatttttctacaagctcccagggataaaaaatagatcatactcaaaggatcaataataagagtgccattagacttctcattagcaacagtataaactataatagagtggtgggcttccttcaacattctcaggagaaactatttcatatttagaattctgtacccagccaaactatcaaccaagtacaaggatagaaaaagatgcttttaaacatacaagcactaaaaatatacttctttcactgtattcctgaaagtcactgggggatgtgctccctcaaaatgagagataaaaccaagaaagaacacttgaggtataggaaacaggacatcaaacaaagagaaattagatgtttggggcagaatggccagcgtctcacctcatcggacatggcttccatctcctggagcttggcaatgagctggttcatgctacctcggaggtcctggatttccccactgtgatgtcgcaccttctcctggtacaaccttatcaggaaggagtgataacaagaacaggttgatttgtgatgcgttgttgttaccctcagattttccctttgctagttggctctcaaagaatgagtttcagattttcctaatctcttgggcccatccctggacccattcatcaggttattatctctaaaacattactcattctcttctttctgcttggaatatctttatacccagctcattccttccaaatattcctgagtattttgtctgcaattaaggatgctgccatcaggtggtgtcttggttaaaatttcttctcagctaccatttgctgagcactgactatgggtcaggagctattcaagacactttgcatcttctttagcacccataattgccaagagcaagatgggtgttatgcttcatctcataaatgaggagtcaaaggcccagagagaataggtgacttgcctaaggtcagccatgtagaaggcatgggagttaggatttaaacccaggttgatctgactgcagagcctatatttgtagccaatacaccccagattctggctatagctctgctttttaggtaataatatggttacccagaagattcctcttacctcaagctctgcagtggaccatttatgctgtcatcctggtggagtattgagaaagtaaggggtctccttcagatggcttaatctggccccaggagaacttcatccatctattctcccacaattataaacccatacattcatccactttcctgttgactcttccacccgtctacccacctatcatttctccaaactctaatttactgccctttttattcatccttccagacttttatccatccatccacaccttcatccatccacccttatacccacccaccctcccttatccatctgttcttccaactccccaacttcccccatctatttacactccaatccatataccctaacccatctacccactctttcattcatccatctatccaccaacccacccacccactcatctatcccatctgctcttgcatccacccatcatttcatccacccattcacctattcatgtattcacctagcctcctatctctttcccctagtcctacatccatcaaatccaaccttccatctgtccatcctcccatccattctctctccatgcacactcccatctggccatccagtcatccaacatggatagtggcaaccctgttgctggcaccaaactaaacattgctggggtgaataggacctggctccttccttcaagaagctgccagtacagttggagagacagtcatgaccacagaaaattatcggaggaaagaggaatgtgacaacttctgcctgggtgtttctagaggaggtgatattttagccggaccttgatggaccttgatggatatgaaggggttcataaggaggaaaagaggagagggagggacaggcctttcagattccctttctgaggtcctctgagactttttgcagacctcatgtagggagtttcgctacttatttcctcctccttcctcctcagaaacctgaaagcaaatgagtatcattgctgttaagcagaaggacaagctgccttaagtacagaaatgtgttccctgttatcaccaccccactttaagtggggccttgagaaaggagagatgggtcatctctgagagtcaatacaggagagccatcttggaggagggactattgcatccaatctttgaaagtcacctctggcagagagatgggttctaggtggatggtacgatgaagggtgagatttggatctgggtcaagtcaggaactgatgaggggccccatttggtgagaatgaatggagctgtggaggtgatattgactggttagggtgagacctgtcagctgtggggcctgaggagggtgcacactcacctgccagactttcattttcgatggtaagtgaatagaaaacatccagaatcctgtgaggccatgagaataagaatgagccatttaacatgcaagatgaagagcctaggtgctggagttaggacatctgggttcaaatcccagctatgccacttgccagcattgtgcaacactgggggaattacttaatgctctatgcctctgttccctcctctgtaaaataagaataacaataatatccacttcatgatcagatgatatcaaatgtgtaatacatggcacataaaccaagtcatctgtggctcccccttccctgttccaactctactggggataactggcaaagagaagaaggcgctctgcattttatgatctccatgctggctgaaaagccaccattcaagccattatttaaaagtcttggccaggtgtggtggctcacgcccataatcccagcactttggaaggctgaggcaggcagatcacttaagcccaggagttcaagaccagtctggccaatgtggtgaaaccccatctctacaaaaaaaaaaaaaaaaaaaaaaaatacaaaaattagcccggtgtggtgcacgtctatagtcccagctacccggaggccgaagtgggaggatcacttgtgccaggaagtcgaggctgcagtgagctgtgatccactgcactccagcctgggcaacagagttgagaccctgtctaaaaaacaaacagcttttactgaggcagcagaatcgcttgaacccgggaggcagaggttgcagtgagccgagatcatgctgctgcattccagcctgggtgacagagactctgtctcaaaaaaccccaaaaaccaaaaaacaaaaacagcctttaaaatttatttattcttcttgataaaaccctcaacgaactaggaatagaagggaaactcctcaccatgataaagaccatccatgaagagctcacagctcacatcctatttaatggtgaaagactgggcgcttttcccctaagatcagggatgagacagggatgcttcctcttgctagttctatttaacatggtactggaggttctagccaggccagttagtcaagaaaaagaagtaggccaggcgtggtgtctcacacctgtaatcctagcactttgggaggctgagatacgatggtttgaggctgggagttctagaccaaaccgggcaacacaacaagactcaatctctccaaaaaaaaaaaaatttaaacaaaaattaaaaaattagctgggggtgatggtgcacgcttatagtcctagctactcaggaggctgatgtgggaggatcacttgaactcaggagtttgaggctgcagtgagctatgattgcaccactgcactccagcctaagtgacagagacagaccctgtcttaaaaaacaaaaaagaagtaaaggtcgtccagattatcatgcagaaaagagttaaactaccactatttgcaaatgacatgatcttgcattagaattctaagggatccaaggttaggtgtcttgccttgtgttataactaaaaatcgggttcagcaaggttgcaggatacaagatcaaggtacaaaaagtcagctgtatttctatatactagcaatagataacctgaaaacaaaattaagaaacccatttctaatagcgtcacaataaaggtgttatttaggctgggcacgatggctcacgtctgtaatcccagcactttgggaggccaaggtgggtggatcatgaggtcaggagttcaagaccagcctggccaagatgatgaaaccccatccctactaaaaatacaaaaattagcagggtgtggtggcgcgcgcctgtagtcccagctactcgggagactgaggcagagaattgcttgaacccgggaggcggaggttgcagtgagccgaggttgcgccactgcactccagcttggcaacagagtgagactctgtctcaacaacaacaaaggtgttatttatcgaagtcctagttgttggattttaaagtgggacggttctctaggattcactgtctattttcccatggggagctgattctccctccctaccccacccccagcctccactccaaagccagtatatgtcagtggagggaggagattcctttgcttgggaaagctaagctgtgttgtgcgaggtgggggtggtggctggaaagaagccatggaaacccagaaagcggaagtaacaatgttcataacacggtttggggagagctttataacttctgaagcatttcttggcttctacaatattttcatggtcatcatttcatttcataattctcacagcaacacccatcaggcagatggggaaactgagtcacgtggcagtgcagtgtcttgcccagtgtcctataatcagtgccagggcccagggatacctccacctgggactgggcagggccctgggacacaccgaaagcacagaggagcagaatgcctgtcttctccatgagcttctggcacagcagcttgcatctggaaggcagggagtggtggtcaagatcaggtgggcaaggccctgccaagtgttcaccctcctcctcgtcactctctttctccgtaggcatgctgtttgccctatcccttcttctctccctggtaaacgtgtccttcaggattcagctcaaatgtcccctcctccaaagacctccacaggcaatgctcccaaccctgtgaacttggcaatgttttggtgcctgcctttcccacctgactgggagctcatgagtggcagggctgagctaggctcagaatagatgttaagaaaacatttaaaatttaaacttcaaatgaatgaatgaatgaggtggatatatctgctggagtttggaagaatttccaaggacagcaaaggaaaagggaaggaaagaatggggcaggccctccaggcaggaagaacagcatgtgctgggctgggtgcggtggctcatgcctgtaatcccagcacttcggaaggctgaggtgggaggatcactggagtttgagaccagcctgggcaacatggtgaaactctgtctctacaaaaaatacaaaaattagccagacgtggtggtgtgtgcctgtagtcccagctacttgggaggctgaggtgggacgattgcttgaattcgaaaagtagaggctgcagtgagccgtgatggcaccaccgcactccagccctggcggtagagtgaaaccctgtctaaaaaaaaaaaaaaaaaaagttaacagcacgtgcaaatgtgtggaggtgggaataggaataggaatggtgtgcccagggagtgagaaccctggccttgctggcccaatgggtccctggcaggaagccaagtgagagcagcttggaaaggaagggtgggacaggattccaggacactgcaggctgaggggctggagcaatggggggccacagtgggttctggggtgggagtgtttgataaaagccaggtttgggatagcttttctggtctggctaccaaggggagatccaaactgatggaggggctgttatggtccccagctgccatttcccactccccatccaccctccccctgccttccctgctcacctgcacgtgttaaacagaacctgctgggcctgagttctcagggagcaggcaaaacaggtgaaccaggctgcacgggagacagaaaagcagtgactcactacgccctcatctttgtcccactacaaggacctgctgacctttctggggctgggggaggccctggagctgggagaccctctcgacttgttggccgagcctgggacagaaccaggctctgcttatgggtacgcactagcctggagtgagtacaggtcactacaggtgggcactggttgccactggcagttaacagacattttctttctttcttctttctttctttctttctttctttctttctttctttctttcttttcttccttccttcctttctttcttttttcttctttctctcctttctttctttctttttcttttctttctttcttttcctccctccctccctccctccctcccttccttccttctttcctttttgacagagtctcactctgtcacccaggctggagtgcagtggcatgacctcggctcactgcaacctccacctcccaagttcaagcgattctcttgcctcagcctcctgagtagctgggactacaagtgcgtgccaccacgcccggctaatttttgtggggtttcactgtattggccaggttggtctcaaactcctgacctcgtgatctgcccgccttggcctcccaaagtgctgggattacaggcatgagccactgcgcttggccaataaacacttaatcgtgactcaggagcacaaaaggcctggaatgtaacaatgcccatttctagacactgggagcttggcaagagctggggccttgtctggttcatcccagaatgcccactatggagctaggcaaaaagtaggggactcagaattgacaggaaggtgagaggacacaggggtggatggaagaaggaagaagggaatggctgtctggcttggaggtggatgaatcaggagatagatgagagaatgggagactgaaaggatgggtggatgaacagaaagagggatgactgggtggatgtacctatgaaataaggtctgggagaactgatgaactcaacaggtggatggatgggtgaaaccagcagccagactggtggtagaggagggttggcagttaactcctcctccagacagcaagcctccctcccagttcccctctccagccaccaaagactttggcaggaatgatacctccgatgggtagaactccagagttcaacctgcagctccccaccacccctgcagtccagggcaggcattgccacccccaggtcagcctgggccgaggctggaccctctccccagacccatattgatgacgaaggtgattattcagtatatacgtacacacacatcccagcatgcactgagtcaggcctagggcttggtcattgttgcggacaggcaacaggatgttgtcatctgcagagagcacaggactgtcatgtcactgccagcctcttgatttggtgcttgcagagacctagggagcacccagagcttggtgcgaacatccctgcccctgccccttgctgggtagccccaggttgcccgtttgacatccctgagcctcagcccctcagctgcccatgaaaataccagggcacctgtccttgctcactcatgtttggggaggtgtcctctgccatcctgctggtgttccggcctcgctgggcaatcctggggatgataagattcatagtcgcattttacaattatgaggaacatagtgtccttggaatgtgcataccacgttccagattgggaaactgaggtacagagaaggtttcccaacaccaccagcctgtgattcagggacagacccaggtctggctgaccccaaatccaggtatccatcaaggaaaagacccaggttgctgtggcagtcacaggcggttgtcgccatgtccccgaggttggcagaagcttggttttgttcctttgtctgctcctacccaatgtgattttaggccattttgattggtcgaagcctgctgtcgtgctcccattccctgtgctgtgattggttcaagggtgaggaagtctgcaggggtgaggtagggtgaggtaggggggtggttacgaggtaagggacttgggggaaaagttaggtttaggattagctaaatgagacccacagaaaacgatgcttattctccttcccctagacgccacatttctgcgtgacacctgaaactgtggtggccatcttgtgaccatgagagggggctaaaagagcagaatgatgacaggaacctgggtcttgggtggcagaactgaggaattaacacactccggagccccctgcaccttgggacctcttgatatgtgagatttaaaattttcccttatttcttaagtcaaaggtctttaaacatttttgtttataccacctcagagtatttatattggtttattaataaattatatatacacccaattgtactaatacattgtttacccttcccaaatgtacagatttatggtaacattcctgaataatataaattaaaagaggatgaaagacatacattctagcctggttatttcttttctcacccttggggattgtttggtatactctcttgggatatacacccagatttgggtgcccagagataggcatcattttaagttggaatttctgtcacctgcattcagaggctttctgacagataaagatggcgaaatacttgtttccttctttcataccagtctcctgcactagaccgtgagctccatgagggaacggagcacatcagactggtgccacaccgtgttccccgtcctctgtgcatttcccggcacacagtagatgctcaataaatgcgtgctggaaggatggctgcttcaccacttcctggctgggagactttgggaataccactgccaaacctctctggtcttggtggctgtctctgtacagtacagttgacaatgccactcatctccaaggacagggtggaggggcagcattttgtaaactgtaaagggctgggcaaagggaggggctgccatcctcacctccggggtctgggattgtgggccacatcttcgagtagggcgcctgggtccccagggctccttgaggaccgtggcatcgatttccttctttaggattggggatggagatgggaactctgggagctggtgaggaggaaggggctgatgcctctgaatgtcccctgaaaagtgccaagtggaatctgccaggatcagtggagcagttggcattgtgacctcacagagcaggtgggtggaggggcaggggatggggctagtctccagcttggccctagaacctcccccagaggaagccattgtgacccactttcctttcttaagatggggaaattgaggcatcaagacaggaagggccatgctggggtctcagaagctggacaggggcgagagctgaagctccagtaacccaaccatgcttttccttgtttcctagatcccttcctgccccaagcttcccaggcttttcaccttcttaggttgcacctgaatgcattttgtaatgctgagcttctcactggtggacattgtgcataacacaaaataacattgcatgtgttgttgctttaataaagttctactttttgttgggcccggtggttgatgcctgtaatcctagtactttgagaggcagaagcgggtggattgcctgagctcaggagtttgagacctgtctgggcaacatggcaaaaccccttctctactaaaaatacaaaaaattggctgggtgtggtggtgtgtgcctgtaatcccagctactcgggaggccgaggcttgagaattgcttgactcgggaggcggcagaggttgccgtgagcagaaatcgcgccattgcacccagcctgggcaacagagtgagactctatgtccaaaaataaagttctacttttttactggggaaaataaaagcataaccgagtggaaatgtcgggctaagttttttctgttcaccctgcctgtagggagcttgactatttggatagcaaagctaaaatgaattcacttttgccccctggtggcagttgcttaaaattgcaggctaattaccaatgggaagtggtacgatggtccctcaaagaggcccacacactaaaacctgaacatgtaaatatgttaagtcacaaggcaaaagggagttaaaactagaagagcaatttaagttgctaatcagtcgatcttgagatgggaagaataccctagattacccatgtgggtgcaatgtaatgacaagggtccttaaaaatggaagagggaggcagggagatggcagcacaagaagcactcagcccaacatgctggctttgaagatggaggaagggaccaggagccaaggaataagggcagcttctagaagctggaaaaggcaggtggacaattcctctcctacagcctccagcaaggaacacagccctgccaatacttccttgattttagcccagggagacccatctgggacttcagacctccagaatggtaacatgataaattgtgtcttaagtcactaagtttgtgataatacattattgcagcaacaggacaccaatgcaaaacccctgagaatattcagtgaaggggaaactctgaaatgccaccactacaattgttacaagggtctttcaaatgtatactcattcatttattcattcaacaaatatttatgcacctagtatggtccaggtgctggaaacagggctgagcagaaccagctcccatccctgcggatgcaggcaaagtggctggcagaacattctgcatatagcaggtgctcaccaaacggtgcttgccattgctgtcaggagccggttgagatctgggatgggctggtgagaatctccctcttttatgtctactggctgtcacccaaatggctcttgtgctggaaatatttaagaaaaggaagtgtccaggccaacagcaaacaccaagagtgggtttggtcaatatttgcgcctctgtccactgagtctgctgtttgcatcagctatggtgagggcgcaggaggggccggtcttgggcattggtggacagaccaaggccaggagcagggtgtcagggagctcacagcaggctcttctcattcctctttgcgtctagaataggggcaagggagcactggttgggaggcagggctggttcaagtgagctccagctgctcaggggagggcttgatggtgtctgtggtcagctttgtagacactggtggaggcctagcacagggtgggcctgggagctgggcctgatatttgggctggtgtggggtcagtgggagtcaaagagtgccctggagttggggaaaggccccaagtcatcctgtgccaatgaagaaaaatggaaaggccatcgcctgctgtgcacacatatatgcacacacacaagaacatatatacatgtacctccccatcccaggaaacagtccacttgcatacacacatgcacctaacaccacacactcacagacccacaaacactcagtaggccaagcccacacatgcatacatgtacacaaaactccccacctctgtggtcctgttggattgtgtgaatagacacacaacaccataaaccaagatgccaacgtgcccatttcatgtccacactcacacataagagcacacattttccccgtacatgtgactatgcacacacactcacatgcatgtatcaacacaaccctcatccacacatgtgcatatgcaaattccttcatgcgcacacacagttccttgggtcccatccagccaaggcggaggctgacgtttgtaatgtggaaagagaccgtggactaatccattgtgagtggaatgtgcatttggagagaggctgggatgttaagctgtggggacaggtcacgcacactttctcttctgttcccttctgagttagggctcagtttgtgactgggatcagggctcagcatgtgatcagggtcagagctcagtaactggggtcaggactcagtgtgtgaatatgtgacagggtcagggctcagtcaatgactgaggatggtgctcaggtagccttctgcccctcctaaaagggtcatgtttccgagagagcttggaggtaccaggcttgaggggtcattgcagccatccccttgcctatgggaggggggatggggtcctcatgggccccatcctcccaggccttggctgggcatgataagataccctcctagaagcagctttccttccagagatctcctggccctcactaaggccatagctgcctagccccaggggcttgtagtggttgggagctgggcctggctactggctacgtggcagccccagcgcacatgtgggatgagacactttggcaaaggccatgtttgcagggaaaacacttgcaaccacaagcaaactcgccgctccctgggtcccttcccagtggactctgcacattgggagccttataaagtagcctctgcatctgcctgcctcgggcagaggagggctaccctggggctgagagttcacctgtctcaggaaccacctgaggtaggcatggggctgggctggtacaccacttccaaggaggcttggcttctctatctgttcagtggggatgctacctccagccaccctctgcagaagggtccttccacccctggccttgctgtaggacctgggcaagtgccgccatcctgggtctcagcagacccacctgagccgcagtccctcactcctgcctggctccctctccctgagtcagacacagatctgcctatttggccagactgagtcaggagaggatgggggccatgtgagaggcctactcttaggccatttaccacctggccaggaggggatgaggacaggagccaccctgggtcctcccctggctgaatttggtggacagctggacaccaagctggctgtcacacggggctggactccggcatcaggtgatacagtcctgggcatcttcttgggacaggaaactaccctcagtctccccgtttgggagtctcaccatccttctatgccatggcttgggtcctgcacctggtcccagtccactgtgtggccctaggcaagaccatttcttctctgggcattgcgggtcatttccagaagggactcccccatgattcctgatgaagcaagcaaggcaaggtgatggttcccaatgcagagatgcaaaaactgatgtctgtgggcctggggcagggctgggatcaccagtcagggcttgttccctccaggctggagtggggttcgggtggctcaggggtgggctgttttggctgagctccctgatgctcatttctaccccagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacggtaagcggtgtgttacccagtgagtgtctgtgagcctgtacatgcgtgtgcaatcctaagtgtgtgtgcgtagctgtgaactcaaaaggcccatgaggacccagattttaattggaagttgtgtccctggcacccagacagtgcctgacacatggcgctgctcaacaaatgcttattacataaatgcgtgaggggggagtacgtcatgtggccagtgtgcaagtgtgcacatgtgacttgctcacatgctttggtgatgtgggcataggtcggtttgaggggctatttttacctgtgtgtgtctacttatgagtttgaaatttcatagagctgtgcccacgtgtgtacttaagtgtcggggagggtgcaagcccatgatgctgcctggatgtgtgtgcacaggtacggctgttcaccctgggtgtacacgtttgcgtatgtggtgtgtgcacgcacgtgtgttcttgggagaggtctgtctagcaccgtgatgcaaggagtgttctaaagttatatcccttctgagctcagcgtgagagaaccatccgctctctgggtcccacttgtgcgagggctctgtcttacggctgtgctgctagatccttccaagtcttgccccaatcccctaaggagggcacaatgaagaaacttagccccagggagggacagacattgccaaggtccaggacgccagcacaaacatgtttattcacctcgagttgcctcccggtgagaatttggtttcccaccaaagccaggagatcagaagcggtttcccccaaggccaaactcagattacagtgtgagaaagtcaggtcagacagtagatgggaccttcagtggcccaggacatgaagcagtggctcagggaagtagcaggtttcccccacccctgggtaaacacagccttccgggacctcatatccgggctgatgggcaggcaatgaaaggggtcagtgatccgtgccagagcatgacatggagccattcatggatgcctgcaggtagggccatgaggcccgcgccctccgccgccttcctgccctctgcccatcctgtgcaagcctcctttgtccccagggagccctccccagcttgcctgcctgtgtttgtttttggcagaaatctggctggaggcccacgctggacgcattgctccccaggctgggctgagtggctacttccagtgtcctccccaccccatcctgcaagccccagagttcaaaccctgcgtcaagggagcactgtagatggagtctgaggtctgggtgtgagttccagctcagctgcagatggttaggtgggagaggggtgctgggaaacatggaaaccaccgcctttatgcttcttgttgggggagactaagaaccagagaggtgcagggactcctcaagttcccacagtgagtctgagcagtgggcaggcctcttgactcctcatttgaagctcccttccagcaccatcacctcttattctaattcaactcctgcttaattagcacctctctggggctcagcagcacaggtgagtgaggatgcccagaggctcgggagccaggtccctcggtccaaagccagctttccctggccaggtgccctcacctctctgtaaactgggcacgataacaggaaaagtaaagcactcagaacagggcctggcactacaggatcacaacataaacgattgccgctattattacaaaaataaatagcaatggtagaagctagcatttgctgtgcactgagtgtttacaatgatcctatgtgacagataccattagaatcattgcagatgtatagatggggaaactgaggcacagagtagccacacaggcagtgagtagcagtgagcactgcggtttgaaaccaggatctgagagactcttgagtcctcagcccccaggtgaggctgtcccctcccctcccaagggacgtcccctctgctcccatgggcgcctccacagcaggccagggatgactgggagatgccccttctgcttgggaacttagggaaggctcccagaggagatgggatctggttggaaccttgcaagagggcaaaggattttgttgcttttgaaggacggggtaaatcagcaggattttgagaggcagagtgggagaaggaggtcatgcccaggtggagagagcctgatgcgagtggtgcacccaaggtgggctcatggggagtcagctgccctccccatatgcttggagtaagcctaccccttccagtctgagtaccctctgcccaaggtgcagggtagatggcaggcagtgtgttcttgctacttggtggttcccgagggcaccctgacctcactctaccctggccccacagtgtctgaaattgggaaagcccctctccagcgggccctgcaggtcactgtccctcatttcctggactggagtggagaggcgcttcagcccaccaggtgagtgctcccctcctccagagaaggtgctcctgccaccaagtggagtgttcctgcttgccaggtgggtgcttcagtccaccgggcatgtgctcctgcctgctgggcagatgctcctatccacggggcaaagtgttccagtccaccagatgagcactctccactgaaggtgagtgctccctcccacaaggtgagtggtcacaagatgatttaagagagggacccaagatggagaagccgggcctggtgcctctgaattagtgaatttctgccctcaagggctaagagtggctcctgggtccccagggctggcaggaccctctgtttctagaaactggatactgaatttagacacgaatctgagcctcctttacctccaccctactctgcttaatgcagaaactaaaggcatagggatgtggagcatcccaaacttagacacccctgggctggtcaacagtcaccttccacataggaactagggctcactactgtcagatctttgggtttccaagagaagatatacatctagaatccatcaaatttggaatgatagcaactaatgaaaaaacatttaaagcccaggcgcagtggtccacgcctgtaatcccagcactttgggaggccgaggtgggtggatcacctgagatcaggagttcaagaccagcctggctaacatggtgaaaccccatctcaactaaaaatacaaaaattagctgggagtggtggcgtgtgcctgtaatcccagctactcaggaggctgaggtgggagaatctcttgaacctgggaggcagaggttgcagtgagccaagattgtgccattgtactccagcctggacgacaagaatgaaactctgtctcaaaacaaaaaaacaaaaacaaaaacaaacaaacaaacaaaaaatatttaagactttaagaccctggaacaatgggtggatggtgaaaaaaacatctggcttgggggccaccagtttgagatcccttaggaagagctgaaatgcagttcatggcatggttaataaaggtggagaactggacataaatacccagcgaccaaagatgcctaaatcacttgtggtctggccacacaatggacaccatggggctgtttgaaaacagtgcccggggctcttgtttgtagacacaggattgaacccaggattgttgagtgcacagacgcagcttctgtacggggacctgaactgtacagtgcagaaatgactttcatttaggaaataaaataaatcacaggttagctggagagtgcttggagctttgaagtgggggagcttctgttgctgtaggctacgagctgcagacattgactaggataccagagagaggatttctgccttctgtggttcctgaagtttttcttttccaaccttcccaactttccaggcaggggtcggaaactgtcaaaaacctgagcaatcatctcacccaagtcctgcccgaagcgggggcccctctgcatgttctccctaccagctggtgtccaaccttggtttgcatgccccgtggtgatggagaactcaccatcttccccttacctcatggttccaattgtcagaaagcccttctttataacatcgtgtgggtatggctcagagcacccaccccagagttgatcccatggtttaatgggggccactctgtcaccttgattactaccctgcaggatccggattctgaatgtccatgtgccccgcctccacctgaaattcattgctggtttcggagtgcgcctgctggcagcagctaattttactttcaaggtctttcggtgagcggatctccttgttagggggtgagaagggttttggggatgctccgagggatacagtgaggggacggggggtagcaactcctccagggccctcatccaggcctcttgactctctgtccagttgctctctctcccctcacgcttggaggggagcaagatagtgagaacatttctgagaaccctgctcaacagctctgcaactgggcagagtcacttggcttgtttaccccctcagcttcctcatctgtaaaatgggatgaacttctgtaaagtgccaatgacggtttggtgaatgggttcattgctgtgattataatgactgtcctctctttcccagggcaaggcacatgagagacgctcaataagcataacgatcagagttatttttgtgtgcctggcatcttgtatgttactgcatttaattttcacaccatgagctgtgcagtcagaggggtctcttatctagcttctctaccctgacactatgattttatgattgcttcctgtgggccaggctctgtgctgggtgttttcacatgattatctcacaggaaactcagcacagccctgcgaaataggtcccaccaaccttatgtccattttacagaagaggaaactgaggctcagcatggtaaatgactggcccagggtctcacagtgagaggctccggacagccagtgctcacacccactgctgcaacgtctatgaccccaagtggagtcttgaggctgggggctgtgggcctgccccaggtagggccatctcactctgggagtggggggcctgcctgggccaagtggagggcaggcaggggctggggaatttgtaagatctatcatcagtcatggtgggctctgctgggcggtgctgctcgggctcaggactggcatccctacagcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacaggtgggtgcctggtgagggcagggtcacaggaatcccagatgccaaagctgtgctgctgtttcctgagctgcccactcaggactttaaccaatggccacaagggcctcaggggcccccattattgtgcttgttttatgtcggaggacactgaggctcagagagggggagaggcatgcctgaggtcacacagcaagtgagcggccagagcctgggacctttccatcccctgcaccacttgacaatacacactagctattagcacactctttggggagggattttgggtggatcagactggctgtgaggacctcggagacccacccctcctagcagagatgagggaaaggaagccagggagggcctgggacccaccaatagccagctctcgcaggccaggccgctcccttctgcataaaggctgatggcagctcccgcctccagagcacttatgtgtgctgagcattgttcaggccctttccatagatcatttcgtttgatcctcacagtatcctaccaggtaggtgttaagtatttcctgcattttacaggagcgcaaatggaggcccagagcagttaagtgacttgcctaaggccaccggctgacaaatggtgtaaccacattcaggcccaggcagcccgactaatcccatggcttgcaaatccccctagacgatgtctgcaccttcccaatgtgagcggggcttgctgaggtgttgagcatcttggaggcttagaagaatgcaacgtatgcatcaagactgagctttctccccagagagggatgtggctgcgtaaacccattcacacttgtgtcgcatgatcaccacgtgtgactcacgacccctcactgtccttacaggcaggggatgctcacagcttattgaaggggaaatggaagcccagaggctttgggaacacagaggccaccctcccacctcccccccagggagctggttcagcaaggttgggctgtggcttggatcgacatttttgcaaatcaaggaactataggtgcctatggagcactgttgagttgtttagaggggaaacggaggcccagagtcaggaagggattttattaggtgtgtcacagaaaattggacccaaagcatgaagcagacccaggatcccagctctaccccctaacccaacctttactgggcttagagtggccacgaagccagctggccaaggtcatggccaagtctggcttttgcaacgccctctctgtctcacgcgccacattcttggccatttccaaaccttgagataaatgaccctctcttttgagactcaatttcctcatctatggggccagttatgccagcactgtgtctggcagatggcagggcatcgaatggaattgattggcctcctggctgaggatagagacttctcttcccagacgtgcgactgtgctgagtgacgggacttaatatgtttgggagcccaggaactctttctgtgtttctccctcagcacctcccacgcgctgctggtcctggtgcagaagcacattaaagctgtcttgagtaacaaggtaaagggcttgcagatttctcagaaaggagggcatggcttcaccgagaaggcacagtgaagaaagagtgggatttcaggcagggggtactttgcttgggattaaaaaaaaaaaaaagacgccccttcatggtccccatgaaggcagggaaaaggctggtgccaggtccaggggagtgatggggaggcacaaatgagggcagagtttatggggttggaggggagggggaggttcatcctcttagggcagccccaatttcatgctagagggtggatggagtggggttcatgggcctgtggtttgtgaaaagaagacagaacgagagtgaacgagggtgtgggcatggggccacctgtggcctggacgggtcctggtcctttccagatgtgcagtctctgctcctggttccacatctgtactgaaagagacaaagcccctcctccgtggggtggttgcaggcatgaaatgcattaacatttcagaagagttcgggacagtggttggcagagtgggtgctgctattattattactattttagctcttgtcattgtctgcgtggagctgacttggtgagagagggtagcccaggggctagggtcccactgcccagggggagctcattttctctctgccctatcccatcccaaccccactactgctttaaggggcagtagtagagacgaagtcaacctcctgcatgccaccccacaccccccagagggcgactgcaacatgcccaccttacagatgagaaaaccgaggctcgaggggtgaaggtggggcagctcctcttgagagtcctgcgggatgcccaagtggacagcttaactttgtctgttggtccagcctcttcctctccctgtagtccccctgctgccctcatagccagcctcttctgggcaaggggcttcaggcagcactgcaggaaggaagacccaccctctcctcttcctctcgacctcgccctgcccagtctcgccagctcttgcctggttaaggctgcgagtgcccctggccttgcagttcctcctctgcccccatcttctatcacactgatcccaacataatgtacttctctggctgcccatggtgcccagggaaaacctctgtagctccctggcctggcatctgaagcttggcctggtctggcttgctgatcactgcctgcctctgcatgggcaccaccctctcaccagctgagcttcaagactgagctctcagccccgttgcagcagattccctgcctccgttgctcaggcccagctacgaccacctgggctgggctccacggcctctgttctttcttccgtgcctggggacctatgctcacactgccatcagcctttgggttgcttctcctctgtttcttcggtgcctggaaggggtcccaggagatgcccactggcgggtggaggaagggattccaggcatggtgtatgggttggggaggcttctagacagggactctagacccctctcagccttgtgccctccagccccagggctgccctaaccccagcctccttctctctgtcttaccacagctgtgcctgagcatctccaacctggtgcagggtgtcaatgtccacctgggcaccttaattggtaagatctgggagccaggggagggggctggggcctctgggaccccctggagcccctagaaccctccaaaggctccactctggatcacggtcgacctctaggagagtcagttgtagggtgactgaattgtgagctcccaaaacagtgtaattattcatgaaatctgggaatctccaaattctagaaccaaaaccaagtctttgattctagaatctgtgtatcttagatcaaaaaatctgaaaaacaaaatacaattttgaaatcatgagtcttaacattggagaatccaaggaccattgacacttagaatctggaatcattctagaatctagactcatcattccaaagaccagctcttgcctcggcctcccaaagtgctgggatcacaggcatgagccaccacccctggcctcgccctttgaaacttccctgcaagagtattctgaggctcagaggagttgggctctgagccatgcctccctgaaggctgctcggagggtctgttagggaagctggacttctgtgatcttgcataactggccccagtggtgtgtgctcttggagttctcataggagacagtgtgatgaggtgggaagagcatagctttggggtcagactgaccaggtattacaatcctgggcaagactgaacctcaccagactgcgtgtgcgtgtgtgcgtacgtgtgagtgtgcatgtgtgcatacgtgtgtataaaataaccctacaggattgtaacgaggattgaatgagatgctgtaagtcaagcatctggaccttgataagtgagagttctcttctttttctgtggttgcttctcacctttgtcaggggatatttgtgcctggactgggcccttctccttccttctaacttggggtcactagtctcccaccaagggggaaagcagaaagcatacctgttagaattgtgcctaaactaagagtcagcaggctgtgagtagctcaatcctggccatgtgcactttgccacttaaatttgcttattcagaggcttgctctgcctcttttgtttcgtggcctggctctggctaatcagggtaatcagacaataaataaacttttctggatagatgaaacgttggtgagcagtgctaaatatgccatcttttcttctctaccctggtttcatgaaggcctcaaccccgtgggtcctgagtcccagatccgctattccatggtcagtgtgcccactgtcaccagtgactacatttccctggaagtcaatgtaagtgcctcctggccagcccagagctgggggcttgctgcctctggagtccttggtgttccagaagattcctaaaggagcgggggagtgggaaaggagaggaggagctggaatagtgtcccagccgggagcatgccacacaggcgaaagtgtgaactacacatgtggcatcttgcaggggctggggggcagggagtggcatctaggagtccaggttctgccatggagccacctccgtgctgaggccctgctgcttttctcccacttccccctcccacccctacaggctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctggtgagggcccgacctgcagcccagggcctgtggggcaagagctccctgtggcccagcctagggagacctcccagaggccaaatcatgggtgggtggggccgctgaagctggcgccacagggtggctgttggaagggttaaacgggggctatggggagcgattgctcagggggaaagtggtgatctgtcttggggagcagctgtcctaaaacctgttgtggcctggggtgctgatttcagaggtcggatgacaacctgctgaacacctctgctctgggccggctcatcccggaggtcggtgatgtttctgatcattccagggactgagacaagggactggggtgggggttctctgggtcatgggatctctgctggctcttatctgtcccaagtgaagttcagcatctgtccttaaacctactcctccatcttggggaggctctaacttctgcccagacatcacactctgtctctctgtgcctttgcttgagcagtgtctgctgtttggaatgtctttctcctccctttcccttatccttcttcaagaccaagctcaaggtcacctcctcggggagatccaaccccctcgtcttgtccagcggcctgtaagacccactggcttacacagaggggggacccacctctgtgcccagtcacatacagcgccatggtggcccaatcagcatttgaggagtgactgaccagagagcccgccagccgctgcctcagcagggcctcctccgcctctgcctccccaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtgagtgcggtggggctggtcggaaggcaggcaactgtcacagagacctccctccctgcttcactgtcccctcatctttgctctactcacactattgtcttcgctgttccttgaatgtgtcaggacactcccgccccaggacctttgcatgtgctgagccctcggcctaggactctcccaccctggctcttggcatggccagctccccctcctcttccaggcctcagcttaaatgttgcagccttcctggtctaccctgagtaagaaggtccccatcagccttctcggcacctcctctctgcatttgtggcccctgccactctctgaaaggatggcgcctggttactgtggttacggtccccctctcccacagctggcggctcgttcccagggcagggagctggtctgccttgttcacactgtgttgttgccaacattcagcgtggggcctggcacatagcaggggctccacagacacctgctgcctgaatgagtcgggggatgggtgggaggctgggtggctggtgcccccctcatggctctgtgccctctgaccctgctctccccatgtgcccaggtagtgaacttgagactccagctctctgtgtccaaggtgaagcttcaggggaccacgtctgtgctggggtaaacgagcccacctggacccagcagcctcagtgtgttcttctgtgccatgggtccatcaccaccctgggtcacggtgttagccagggagcctgggcgtagggaggtgccagaccctgtcctgaattctcctgcttctctttcagggatgtccagctcacggtggcctcctccaacgtgggcttcattgatgtgagtgtggggctggggcctctagaaacccccgtcctgggtagggcacaccttgagcctggggaagagatggctgtgtacatgtgctgacccgtgtgcctgtgtgtgccactatagtcaggcttccccgggctgcttggggacagtggccagtcagtccatctgcctgatactctgcctggcagtcgatgacttgtcacccagccctcaccccaaaagtccattggtcagttggacaaagaatgtcagctgtcccttcagccaggtgatgtgattgggtcatcggccaccatacatccacttgtcagccggcatgccatcaacatgccccccttctacccagccgtcagtctgtctgtctgtcggtcatctgcgtcaggcagtctgctggccagtccacctgttggtcacacagtgcgtgagtgtccacagtcagtgcctgtccctcagcctccactccggtgagcactgctgctgggtgtgatcctgcgaaggctgagccaaccatgggggtatttctgggccccacttgaacccaggacatgggtgatctgccttcctccctgtgcctcagcctctgccatccatctgttgtctgtctgtctctgtgtatatttatgtatgtgcctgactgtccatctctcctggcccctcggctgggacgggcccatctccctggctccgtggccacagacagatcaggtgcgcacactgatgggcaccgtttttgagaagcccctgctggaccatctcaatggtaagccctgccctccaccccagcagggcccctctggccccctccatatcccacatctgctcggtgctcaatcccagcccccttcccacctcccaggctcacagggtgagagggggcctctggagtctagcagcccatgtgtgcatgccccttggcacatatctgtgtagcagctgtgtgatcttcaccaagcagctgtgtgatcttcaccaagttcctttttctctctgagccccagcttccccttctgtaaaaggggtataacaataatggcatccatcttccagatgcctgcgaggactcagtgctgtgatgcacatgagggcttcagcacaggctggctccaggggacgatcctttcttctttctcgcctgcagctctcttggccatgggaattgccctccctggtgtggtcaacctccactatgtcgcccctgagatctttgtctatgaggtgagagcctttgggtgtgaccagaggggcctccttcactcagagggactgattgaggtgggggtcacctctctccctccccctctgtggctgccaaaaccatgccatgaatccttaactgcaatgaaatgaaaagtccaggatgccaagagatgctgggtcaaaggtttcacccttcctttagtcctcataaaatatcacaccagaccacactcggacaattggggccttcacttgtcccgtgatcctgtgccctggaatgggcacaacccctttgatatctggagcagatgacagtgggactccttccactttgtagacaaactgtgcaggctggatgggagtagggaacttcctgaactttctaaaattgctttccctggacctgaaattgtgggcccagggtgagcttcagtcacaacactgcccagggtgagatgcgacagctgctttcttctgtacctgggatataaaaggaaattcagtcagcaagacatgcctaggacagaaagctgaacccaggtctctcaagcccaatgtctcacgtgctgttcatacccgatgagtgtgacctgctgatgtaattccagggaggatgcccttgttccttaagaactactctctcaaggcacttgggtgattatccgcccccatgagaaggaacgattggtacacagaggagcagggctctgtggggatttccctaggacttcccaaaacaggcagttagtggctgacccaccttggcacttgacccagccactgggtcagaggtgaaaagtccctagtccagtactgttaccaatggaactttctgcaaggatggaaatttatactgtccaaagcagcagccatgataagccacaggtacatgtggctactgagcactgaaatgtggctagtgcaactgtggacctgaattttttattttgtttcattttaatgaatttccatgtaattagccataggactaattaattagccatagccactaattgtggctgccttattggaccacagagccctaggctacgagctacactggggcaggaactgggtctggcttgttctctgctggctccccagcacctgccacagggcttggcttatagtagaggcttgatgaagatttactgaatgaatgaatgaatgatcggcagccctccagaatgctcctgcagtggagtgtagcataggggagctatggggggtgcctgagtctgctggagagagttggacttggagaagatgctccatggttctgggctcccattcataaagcatcagtggtatccaccatcggagcagcaaccagtgccttccatgggggtctcactgcatcctcacagtgaccttgtgaggtggaggctgttactacccccaaagtgacagactggtaaactgaggcccagagaggcaaaggactctcctcacaacccacagcaagaatggcagagcagaactcagagccaggctgagggggcggctggggtcctgcctgtgcctcctctgacctggtccatggtttcctttgcccttcagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttcagccaagcccagcaacctctttgcatacctaaggccagttccctacatgcagtctccaggttctgtctgtccctggagccaccaacgctgcctgggagaagaagaagacataaccacatctctgttgatgacatctctgttgatgacatccattgactgtgtcacctctttgcctgggggagctcctgttttgaaagaggaccctggagagccgcatggatgagcctgaagttagagcaccatggtggcactttgggcacagtgccccttgcctggcagcttgccccgtcttgtaactagaacctcataggagccccatgaatcaggcaggcagagactggagttccattttatggatgtggggactaaggtccactgaggaggggaatgcacggtgcctcagagctggatggtgacatgaccttccttcaatccagacatgagatgtctggttccctctgccattctccggctcccagagctggaccttgtccctgagtcatgaacttcaggtgatggggagttcattgctcttctaggcagcttctccatctttggtttctctgcctttggttttacgagcaagttttttgttctaaggaggcagcatctgcttcctgggcctctgcccttctggtcacactgaacatgtctaacccctttagcctctgaatgcccttcacacccagtgaatcacacagaacaagatgacctagggaacaccaagggatgtaaatgctggcaagtcaaagccatgtgattttctacccctgataagctaatctcttagccagagataggattccttcctgcctagatatatggtgtttatgttctgtttatgtttcctttggggagtaaaaggtgcctcaatttttaccaccagtaagcaaagcctttggcacggtgtgaccctagccactcttcctgtgagggttcaggttcattcctaaagtttccagcatgagagatcgaaggtactggaccaagcccagagtcttggtggtggagaacaggttgggggtggtactgagagagtggcaaggggcaggttggaaaatccacccccatgattttgctcaggacaatgtgactcgtatttcatttggttatttggttaattaattcactcatcctacttttattgagggttaaaataggctgagctctagaagtgagggagggagacccaggcactcagagtggtctgcagtatgagagagacaaaaaacttaagacagagccatagtccataaaggaagttaataacctaggaaaagattatgagctcaatatgtcagtccagtgatccatctatctatccatccatccatctatccatccatccatccatccacccacccaccaatcaatctatgtaaccatccatccatttatcgatcatccatccatccacccatgcatccacctactcactacccatcaatccatataaccatccatacatttgttcatccatccatccatccacccacccatcaatccgtataaccatccatccatttgtccatcatccattcatccatccatctactcactacccatcaatccatataaccattcatccatttgttcatcatccatccattcacccatgcatccacctacgcactaccgatcaatccatataaccatccatccattcgttcatccatccatccatccacccacccatcaatccatataaccatccatccatttgtcgtccatcatccattcattcatccatccatctactcactatccatcaatccatataactattcatccatttgttcatcatccatccatccatccatgcatccacctactcactactgatcaatccatataaccatccatccatttgttcatctatccattcatccacccacccatcaatccatataaccatccatccatttgtccatcatccatccatccatctactcactacccatcaattcatataaccattcatccatttgttcatcatccatccatccatccatccatccgtccgtccgtccgtccatccatccatccgtctgcccatttattcagtcattttttccaaccagccaggctttgtttgtacccatgatgtacctatttcaataatatatgttcttttaggtgaaggggggatgaaaatgcctcagtcaagctccttgcccagaaggaagatggtggtctgtccaaagagagttgccctcatcctaagggacaccctttggtcattcagttaggtgcctgctgggctctggctgctgagagggacagatgggtgtagcagtttgagtccagttagaagatagaaaccacacaggagctcaaacaggggaagtttaatatgaagagttattaactatgataaaagagtcactgcaagacataaggaaactctatatggtcctctagggctgagggagagtacccaaggaaagacaaactcggaagggcttcaggcgttattggagaaggcattgctcagcctagtggatagcacagatgttggctggtgtggccaggttggagatggcctcagctggcctagagttgctagagttgctgggcaaacaacaggaaactaagaccttgggatccagtgtgcaagcagcatggggtgacgaaagaggggagctctggggtgtggcttgcacatggagcagctcagggtgtggctttctggactacaggcgactggatagaggtaacgtggggctacttatggaggagtctgggcactggcatgggcaagaggccttcagaggggttgggccagatgggtgggggcatggagagtagttctgatttctgtttggaagggctggccccaggctgaggttgcaagtttgcagagggattgagttctggacccatggctgggataggcttcacctgcacacactcacacagccaactccaacccacattggaaactgcaggaagcctcttcctcttgtactgccctctcctaagaaaggttgacatcatgctcactttaaaggagaaatacttaagtgagtcccattgcttatcatggaacatacactgaagggtgcttttggagctgagaggcagtaataaattgctaactgacacagtggggcagaggagaaaaggaccgtgttttcccaggtcaggtgcctttgcaaatctctcacttgtccacttgcatggccactctttgccctgaatgtctaccctgcatatttcctcgctaggctctttgcccaacatgggatgtctttaccggagcctgtctaccccaacgcagcagctcagatgcagtctcccctggccacagcatggggtgacctacctgcctggtttcagtctccaaacccctcctcctcaatcactgtgttgccctttgattgcacaccatggttattggtgtccatgacttccttccccaccgcacctccctgacccttcccagagcccagagtacaacaaatgcataataaatgtgtggtgagcgagctgtttgcacacatacatggtggagctctggcccaggcttgcctcaaccctaagccctgggcaggccatgtggaaagccccatcctcataggcaggtgggggctgctagacttggagtcccctgtgttgggtccccagagggtcagtggggaagggaaaagatgacactgagcttcaggactggcccagtctctagcgtctgagagttagagaggaaaggaggctagggaaggctccctggaggaaggagcctcagctcgtcctggaagcatggctgaatttagagctggggtagggagggcatcataaggagccaggcagggcgattctggggcccggaggaagagaggagccctgttgagtatgccttggcaggtgttggcctgggctctggagcccttggatccacattcaacccctagctgtgccattcacttgctgtatgaccttgggcaaatgactcaacctctctgagccttagtttctctagctataaaatggggaaaattgctgaagtgcctgcctcatagggtagttctgaggattaaatgggtaagtgtaaataaacacttagcgtgatgcctggtacagggggaatgcacagtaaatgggtcctactgttattgtcagcagcatagagttctaccctctcatccatcataaagaggattaaacagaagtggcccagagaggttgagggagctgcccaaggccacacagcttgtgagggaagtggctgggactggtgttcaggtccctaaacccattcaaggggcttctcctctttcacccaccccatgtcctttctgctctccaccccaaatatgctctgccctggtgggaggcagggagagccaggcaactgcagtcaaggtgcactggggtggatttgtgggtggtgagagaggatgcaaggcctgcctctctgttgggggcaggtcagcagggataagacgatgctatctgtggatctggctcctgcacctcagggcctggatcagagtagagactatctggccaccctgggtcctgctcttgctctttccagcctggcttcagccgcggcatgtgacctcgggcaggccctcactcccctctggcctcagtggccccagatgcacacgagcacagtggcttcctccatcttcctggacgtgtggagtccgtgtggggtgggaaaggaaaaccccaggcccccagcagcctcccggggactgttcctcaagcacaaaatccctcaaggggcctctgagccaagcctccccaagaagctcatgatgggcagaacagaggctggaaaccccaaggcccggtcccaggtctgtggccggctccctctgtgcctctgaagtcacctccgccttcatttctcccagatttggaccttgagagaaagcacccctccacctggtactgcatggtagcatcttcagggggtccctttgaagacaccttacttggccattagctccttgtgtcccctgtgaatgaaccttgggggacacaagccccagtgggcttagccagcatctcctaagccttgtgcacttgctggcccctgcctgaaacaccttgcccctgtattgcagagctggttttgctcaccccctggcatcagctccaacaacccttgctcacaggtctccaggttctgatgatcaccctgttctttcatctctgtcccatctctctggtttagtggctctcatcacccttgcctccctcgagaacgataggctttgtggttgttgacctgcacagtgcccgtctccccctttggcctccaagatctctctcagggcaggaatcccaactgcctgttcactgcacaggcgtggcacacagtaggtgctcaataaatgtttcttgaagaaacaaatgcatgtcctctgtgtgcccagacttgtgggaggtgctgggtctaggaaaagggacagtgtgagcactgatggtcccttgggcagccacatcctgcccctggtacccgccctcatgtggccaccaggattcccagccactcttgtcttccatactatttacattggaacagactgaaacgtcacgtgagcaatagggctcctgttcttcaagcctctagataattatctgggccttattaagcccttaattattccaagccactaatcaggctcccgaatataagggcttcttcagctcagggtcacgaggcaggggtcagtcatctgcagaacttccctaagctcagcaaggtaaggacagtcccccaactgtggaattctccccagagagtgtcttttccagctttgtcattttacagatgagaaaactgaggcccagagaggggaagagacttgcctgaggtcacacagtaaatgggtggcagggccagggcttggatctatgtcctgacccccatccagtgcttcccacctcacaggtgatcactaggcattgcaattttccgatgctgtaggagtaaggaaagatcaaggagacagcagatccaatgggtctccttggtctccatctgaggttgaagggagactagggagggaaaccccaggctctgctttgtaagagctcagagccaagctggggcacccaggagtgggagtatgtgccaggcagaaagagggaggaagggacttctggtgggggaaaccatgagcaaaggatgggggtggttgggggtagcaggaaacactcatcacaggtagggtggattatttgcacggtcaggttcaatttgtgatttttgaggctcagggcagtcgggggttgaggaaggcttcctggtagatgaggcaagtgctgaaattaggacttgagggttgagtcagtgatagatggatggagggaaggcattctaaaagggaggggcagcttaggacaagcacattcagaaacaaaaccctagcattagccatttgtcccagagacacccgcatgaccacgttacctgaagccacttattattctgaaagggcaaaaaaagaccctgccctgagtgaccctaacacctggcatcagttctggcctggggacgggagactggggtgaggctcagtcaccccgtctgtgagatggggctggggctggaggagaccttcaccaagcccctcccagctctgttgcctggctcagaatttcacagcccctttggggatgatttttaaagagatttgacatggggtgtgccgggacatgagcacacgtcatggcacgcacctgtgcattcacagtggtcgagaagcgctactgtggattattttaagcccagatatatcttccatttagtgaatattgactattggcttgaacacttctcgatacttaagctccttttcatccctcaggtctcagcctaaatgtttcctccataaggagtccgtccctgacccctttatcccatatcccaccctattgcttctcgttccctgccagactttaggatttaggaggagcagggctgtctctgccaccgagataaaagagacaagcccggtctgcttggcacagagaagacacccaatagatgtgagccgaatgaatgaatgagtgaatgagtgaatgaatgcaggcattggcttggactgggaaggcaggcccatggtaagggcccatcttagtttgtgcattaggtgagccctcagtgacttagcccgctgagagcaagagagagtctggtgggaacctcctctctctgggtggacataggccctgctcccatgggccctgccttcattcttttcagccaaagctcaaaactgaaatatacacttggcccttggttggaagagtttcagatcttggtaagtaagagggaaggatttctatgggcccggggtggggtagggctttcctgggaacctgaaaaggtctggggtgggaggtccttatgctaggagacctaatgtctgtgcctcagtttctctatcggagaggcgatgtctcaagaggcctttcagggctcagagttgagctttctgagttccacatggaagtgagctgagctggaagaggtggggagggaccctggctgtagggtcaaggtggggacacagggctccccactcccacaatgccgtgtggggctcaaggaaagtctggaactctctctgtggctccagcattcagccgtccttgaacccatgaaaaactgcagttgaaccttcctccaaccccatcttgcaggctggtcagaacacaccatgtccatggggaaactgaggcttacagagggaaatgagctagctgggggtggctggaggccctgtgtttaatctgggggttcctcaatcccttggaagagggcagtgctcatgtttgctgaactggctggagtctaaaggctcttggaccccagaaacacccagggggctcaatctgctctgagacagaaggtccccaaggggaccagggtctggtgggctgcgcccaattcaggccccttggcacaggtggtgccatgctgcggatcctgtgcctggcactctgcagcctgctgactggcacgcgagctgaccctggggcactgctgcggttgggcatggacatcatgaaccgtggtgagcttgtgggcccgggcgtgcagctgggaggcggtgcttggggtaggtggtaggtagtcactgctcttggttgcacatcctggagcatcccgtgagctccaagtaaacttataagcaagtgttattattattctcccactttacagaggggagaaaccaaggaccagagaaaatgggatgattttcccatgctccccctgcaagttagaggcagagctgaaaatcctgctcctttggagtctctccttggccctgatggcaggggttttagccacaagtgggctgtgggagtgacagacaagggtcaaatcccagcaacaacttgctgtgtgacctcaggcaagttacttggcctccctgtgttgctgtttgctcatctgtaaaggtgaaatgtaaagaaatgtaaaatagggtgaccagtctgtccctagcaggatagaataatctcttggaggagaccttagtaaaatgtgttttccacctccatcccccactccactagcacaagggaaaccgagtcacatccaggtacaaaaggctaatgactgttctaccagctcagtgtttgtgccctctctggaattagcttgtgaccataatggaggtgtttctggcggggtgttacttggggttgggtcctccaggtttggggaatcagaatttctctgcttcaggcccaaagtctgcattcaagtccccagaggagtcccctaatcacctaggcttgggagtggctggtccacaggataaagtcagtaccctagggttcaagagcttcactacatgccccctgcaaactgctccagtttctctgtcgtgtctgtcctcaccctccagccatgctgaatctatcctcttcccccaactgtgccaccttctctcccacccacctttgcacttgctgtgccctctgtccagactgatatcttttatccctttgcttcctgctgaaaattactattcccctttcaagtaccaactgatctgtcacctcctcctggaagccttccccagctcttctcttcctacctaaaccctcgtgcggctcctacagcttgttactgtcattgctggtgactccatcttcccccattaggctggggcgctgtgggactcatctctgggtctctgccatcgtccagcccagggtggggcacagtgacggtgagtggcctgggatacctgagtgattggcccagggaaaatctctccaactaagtgtctccactccagaggtccagagcgccatggatgagagtcatatcctggagaagatggcagccgaggcaggcaagaaacagccagggatgaaacctatcaagggcatcaccaagtgagtaggggaggggagctggagggtggtggttagggcagagggtggtggggattgctgtgcccaagatcttagcaggccaggtaatggagctggtgagggatgtggggtctcttccctgccttgtgctgtcttgctgtgtggccttgggtaggtcactgctcctgcctgtgcctggacctcctcagccattcactggggacaatttctgctttgtagtgagcagggtcattttgaggaggaaatgaggttggaaagtcaaatttcaactctgcatgcaacatgaactcattgaatgtacgtgaaattaaatgaaaacatcctcaaatggtagagctggaaaggcatcaacaatcatctaatgacaagaggaaactggttcctctgccagtgccacatgagattgatcagtaggggctgcctgaaacgatgcacttgggagggctctgaggcactgtctgcactcggcaggaactaggactgtgatcaactagcaatgtctgccaagagctcaggatgggcaagtgggggtatgtgtgccacatcttttgttaccctggatctcaactggtgattctcaaacaggggtgattttgcctccaagaagacatttggcaatgtccagggacatttttcattgtcacaagttgcggggactgggggaatgctactggcatctactgggctgaggtcggagatgctattagacatccaataatgcacaaatcagcctcatgacaaagaattatcctgcccaaaatgtggatagtgccacttttgagaaaccctgatctaagcaagcctcccattttgttgatggggaaattgtggcccacataaggaaatgacacagcccaaggtcacacagagtcagccatgtgtcccacctcccatataatgagtgctttctatatacaaattgattcatgtccagccttttgttttgcatttcataatggccccatgaatcatgcttacccccatgacatgggataggaggccggggttatcgaaagtcttcccagtaaagtggtgaagtgggtggaggtcctgggtcttgcctgctcagatcttattggtgtggctgcctgtcccttcccagtttgaaggtgaaggatgtccagctgcccgtcatcacactgaactttgtacctggagtgggcatcttccaatgtgtgtccacaggcatgaccgtcactggcaagaggtgagtgtggcaggggaggggcagcggggaggagaacggccttcctgtctcatccttacatgcacatatattgagtgcctactgtgtaccatctgagtgttgtaatctgggatgatgtagacttggtccctacctttgtcaggaaccagacctaagcacaatcacagactgagtgactggtctaggacagaggaagcattgaacagtggtggcggatggtcagaaaaggttatggggaggcaatgacagcaaagcagattttaaagggtgtgtaggggttcaccaaaacaaggagggagggagaaaagctggttgtgtcacctggggcaggtcccatccccttttctgtcttgtaggggtggtctcctaccctttctccctctcagctgctcagattgtgagcaaagagaaggcagggagagcggacaccatggcagagatgcccatggtgccctcctgctctgtcctccagcttcatgggagggaacatggagatcatcgtggccctgaacatcacagccaccaaccggcttctgcgggatgaggagacaggcctccccgtgttcaagagtgagggctgtgaggtcatcctggtcaatgtgaagactaacctgcctagcaagtgaggggctctgtggctggggaggaaggccggtccatattgctataccccccagcatatcacttcctgagccatggaacccccttaaccatgccccttcatgtcctgtgcctaaattcctgcactggtgcacctgcccacctatcctcggtgcctgtgtccatctagcatgctccccaagatggtcaacaagttcctggacagcaccctgcacaaagtcctccctgggctggtgagtgacccagagaaagcctccacccctcgttgctgggactgcttaggccagggctggcaaatgcatttcatgttgggtgctgaccctgattgactgatagtggctgggaagggttctgagactgtggctggctcagtggaagaaagtgccacaatcatctagtgatgtctgccatgaacagaggaggagaaaatgacagcctgcatgcacagcttgccaaccgtgctttgatgtccagtcccagggaaagagtcccggctaatttttgcagactttgatttggtcaacagatctggactctagtccgagctctgccatttactttctgtgggacttgggacctcagttttctccccagtccctgtcccaccagggctcttgggatggcccgtggtgtaccattcagctgtgtggaggctctccatgcagggaccctctcagcccagtgccttctctgcttccagatgtgtcccgccatcgatgcagtcctggtgtatgtgaacaggaagtggaccaacctcagtggtgagtgtagccctacccacaccttgcccctacctagggatatcaggatagatagactttgatgtcccattccccatcctagtgcctgcttccagcccagccttgggactagaggaggcttgaggtcatgatgttcatccccccactgtcccgatgggaggcctgaagtccccagggaatctgggttccttttctctcatctccctattcaatactgcatcctgaaccccacaagactccaaagacagcagcccttctttgctcgtccacaagcctcgtgcctatgtagtaatcccgatggtagtaatgcctgaatcgcctttgctgaggggatatactgcctccatcattttggggtcccattttgggtcccaaagcaggagagaggaaacctcagtgactggaactgaagaaaactcattcatgtccccagcagtgtggaatgggaaaagtcacttcactcttctcagcctcggtttgcttagctgtgaaatagagctgataatcctgaccatgccagtctgttgcaaggtccaagcagtgatggcctttggtgaactctcaagctctgtgctggctgagtgatgtgattttccaggccaggaaccatggcctctattctacagatgaagttacagaggcccagaagtgctaaggaatttgccttgagtcacgtggagggccaggtgcaggtagcagctggctggtgccagcttctctgggctgttcctggggttggtgcctctttgagtggaacctccttttcacacagaccccatgcctgtgggccagatgggcaccgtcaaatatgttctgatgtccgcaccagccaccacagccagctacatccaactggacttcagtgtaagcgcctagggccacctgggagctggggtctcaggctcactggtctgggtagtgggtgatgcttctgccaggacaggtggctggactagggctgtggagggagggaggcccctcaagccgtggaggccaatgccatgtgggtgtttgtggaccctgggcctctccctctttctgctctaaacgcgaaccttcagtgccccagctggcttctggggctgctgacttcacactcatgatccccgctaggctgtttgcttctcctagtgagtgaagcaaatattgtccccagtgaatggctgaggaggtccaggcacaggcaggagcagtgacctacccaaggccacacagcaagacagcacaaggcagggaagagaccccacatccctcaccagctccattacctggcctcctgagatctttggcacagcattccccaccactctcacctcaccctcacccagttgtatcctgccattttgcggatgggaacattgagaccttgggggagggtagggctgggctagggtcctgcagtgagttggtgtcagagttgggccctcacccagatctccagagctccaggcgaagaggtgagatgcatctttcaggaacgtgaagtaaaatggcaagatgtcaccccgctgtgaagtcttcctccagcaggattcttacacgccccgtgtcgatttccgcctgtctctttctcttgagaacaaggcagaaatcatgttccgaataaatgaagcctccaaccactcagagcaactgaggctactaaagcagtgctaggagaaagtgcccgtggtttagtgactgactcccttatcctcccaggcctcagtctacccacctgtacactgggaggtttggcccactgtagcccattgtggttctcttaataagatttaatgatttgctgactttgggtttggctggagccccatttgcttggaggactgagacactcctggccaacatccctctcggccaaggctgagtgtctccctcctgctgccccatagcctgtggtgcagcagcaaaagggcaaaaccatcaagcttgctgatgccggggaggccctcacgttccctgagggttatgccaaaggctcgtcgcagctgctgctcccagccaccttcctctctgcagagcttgcccttctgcagaagtcctttcatgtgaatatccaggatacaatggtgagctgtccagttccccatttccatctgcctctgtccattacaatgcagtccctgcctagtttttctatcatgaaaattatcctggccttgtgggcaacactaggactggaagatgcaggaccgatttgagtttctctcagcagttcatctcactatccaccatccctctgtccatgtaactaccatctactcatctgtacatccatcagtccgtacaaccaacaatttatcaacctacatctctaatgtcttggtcatccatccaccttccttttgtccaagcaacacccacccactcatctttctagctgtcatgtattcatcataccctaggttctatccttccaactagcatccatccatcccttcatatcatccacataacacctactacaaagtctgatactgttgaatgaatgaatgtatgcacctgccatgtaccacccaaacaccactacatccacccaactttcctttatccatcctcctactcgtccactcattcagccatccatccatccaaccatccacccacatgtccgttcattccccgctgatctatccattcatcttcccaaccatctgtttaccattcatccatgtacctttccatccatcctcccatccatcagtccattcatctattttcccatccatttatcattctactccaccatattcccatccactcatcctcctatccaccattcctgtcattcatccacccacccatctttccgtccacacatcatccatccatgtattcttcctagatttccacctacccatccatccattcatcatcctcccacccatttacccactcctctgtttatccgtttccccatccatctgtctattcatctccaaatatgtctacccatcccctttacccatcacatctacccattctcccatctatcttcctgctttttcatccaacaacattttcttagcatttgaccttgtgctaagagttatgagcattgaaatgtgtaagtcatcacctgggctgcccagaaggcacaatatttagttaaactcagagcgttaagtattgtgatgaagggagcctcaaagggtacaccttgttaagtcagtggagatgtttgttaggatgggccagggaggactccagcaaccctaaccttgacttttattctgtagattggtgagctgcccccacaaaccaccaagaccctggctcgcttcattcctgaagtgagtgccccacctccccatcaccactgcaccctgtcctgccctattgtcctccagtctgtcctgcagtgggacttgggagacagcttttcatgccacatattccttgtccaatgctgaaacatcttttcttctttataaagtactttttgggtccaacatagaaaacagctctacttttgtgcattgtactttctgtccaatagagaatagccaaattgtgtattttgtttcttttatttcctgatagacacatcctggcctttgcatgttgtacttcctgtgtccaacgtagaaatcacctatgtcttgagggaccccttatttcaactgaagccaccagtctaaggactggccctgagtgaagtgttctggtttctgtaggtggctgtagcttatcccaagtcaaagcccttgacgacccagatcaagataaagaagcctcccaaggtcactatgaagacaggcaagagcctgctgcacctccacagcaccctggagatgttcgcagctcggtggcggagcaaggctccaatgtccctctttctcctagaagtggtgagggaaatcgttcccttccccatttattcccaatctcttggatattcagggctggaggatgggatttttagttgacagccaagtcatggatcagagggatcagttaatcttgattatgtctgatccttggctctgccactgaacctttgaatggctggaaagcccagaaaatggagggtcagtggcttagtccttcctttctctttcctccctccaacattcttcagcaactacaaaggcagtgaagggtgcactgaagggactgtgggtgcctagggagattcccaaatccaatttggggaaatcacaaagggcttccaagaggaggtgatagctgagctatgttttgaaggttgagcaggagcttgccagagaagggttggggacagagagtcttaccagggagactggggacagaggacaccccaggcagaggttccagcatgtgcaaaggcctggatcaatagtatgatgtgtgcagggacctactgacagtgccaggtattttgggggatgctgccctgactcaggacaaggagggatgagaagcctgggctggcgctacagggagatggctgggttcagttcctgaggatgggcagagagaagatcccctgctttgtcttggcaatggtggtagtgctgggagggtggtggtctctggctttgccagccctgatggtggggaacccactgccttctccctgcttcctccccaccatgccagcacttcaatctgaaggtccagtactcagtgcatgagaaccagctgcagatggccacttctttggacaggtacgaccctgctgcccaatgctggcatccctgttaccttcacatttggccttctgatctagcacaccccacactaccgagctgatccacccagcacacccccaactaccaggctgctctagctacttttcctgctctagaaccctcaatggctcctcattgtctgcataatcttttctcaaatcttagcctggtactcaaggcccttctcaagttcttccacctctaccctcactcttcccctaggctcttttacagtgaatctggtcatgggcccatgcccccttttccattaataagcctttacccatgccattcacctgagagtcagggtccagctcaaatgccacctcctccacgaagcctttccttatactaatagcagctaacatttatttatggagctctctctatatgtgaggcactggctgcatacattatattcatcatcctatttcattcttacactttgggaggagggtactacaaacaacttagcttaacattcggtccctattaattcttgtacttgccttaataatgaatcacatcaggattaattatgtcaggattctttccgttgcaagagagaaaattccaactttaactggcttaagccccaaagggaatccttggctcatataactgaaaactttaggagtagttcttttttttttttttttttttttgagacagagtctcgctctgttgcccaggctggagtgcagtggcgcaatctcggctcactgcaagctccgcctcccgggttcatgccattctcctgcctcaacctccagagtagctgagactacaggcgcccgccaccacgcctggctaattttttgtatttttagtagagatgggatttcaccctgttagccaggatggtctggattttctgacctcatgatccacccgcctcggcctcccaaagtgctgggattacaggcatgagccaccacacccggcctaactttaggggtagctctgccttcaggtgtggttggatccaggcacacaaatgaactccttgagaatctatctccttcttcctcttgactttgctacccactttgttgactaaattctcaggcagcttctgggtcatagactcacccgagggactttgggtttagcccatctgaatgacttggaatcagagtggaaaatggaggatgtgttactggaatagagaatagatgagcagagccaccagatggccatcacatggcctgttctggtggcaacatatgttagtgcctcctggaggctgtacagggacggggctgggggaagggctcctgttctgtgtcctgcaaggatctgagactgcccagttgggctgtaaacctctgcatagctggccttgggcaggagcaatagacacaaatgggggtcccagagggaagagtcaggaccagtctagtggtttgagctttgagaaatcatgtgctgtaacgaaaggtagtgagtgtcccatcacaggtagcaggcaagcagactcaggagcacctggtctgaaggctgtagaggggactcctgcatcagggaggcgttggggtgcttgggacccccttctccagcgccagggccactggctctgaccgttctttcccctccccgcctggcttgcttccccactcccccacagattactgagcttgtcccggaagtcctcatcgattggcaacttcaatgtaagtgtcccaagtgctcttgcctgtccggcgtgaggacaagactgggcctattctccctcggaactacagggccgaggccctgaaatggaggcagatgaacagagcaaggccactgtgaggcgtggcgcacctgacttgccgtgtgagcttaggaaagtcccttagcctctctgaatccctgtttccttttctggatagaatctggacatctccctggattggttttaaaaacattgtcatgaacagtggcagcctgggttggccttggttggccaagctgttatttttattagtctctgtagcctcagggcccaacacagaacctgaccccaggaggtgccaacaccaccaccacttactctgcgatcatgtgctttatccaaactcttttaatcctcatggaaaccctgggagcaggtgcgattatagttcactttcaaaggtggggaaactcagctatagagcggtggtaagtgagggactcatcaaagctactgagtttctgtaggaccaggactggggtccacagagccacttcttgtctcatgagttttcctgttcctgcaccatggcccaaagccccacatgtcataggtactaagcagaggtgaaggacacgggtctacagtccaaacagagccaaggccaggcccagttttgatgccagctggacaaaccatttgatgtctaatattcacttctgtggtccccaggcctagccagagagggctgaaaagatctgttgaatggtattggactgaatggaatgtggatgctttctctttcttctttccaggagagggaattaactggcttcatcaccagctatctcgaagaagcctacatcccagttgtcaatggtgagggttccaaaaggctttggaccatggtgccaagaagcactttaagcaataagggatgccacctgggtggtctcaaagccctatcactgggcccagatgggggaagctaaaagggagtggaagataattgctgaatctttgaagtgaatatagtcttaatgtcacctgtctgaagacaaatgcctctcccacaatttgggctctgacttttgaccccatatcataaccccacatcttgacctgggatgtaaatacattgcaaatcaggcttattagctctttgcttgtacagctggcaggcatcatgaatcaatcactgcactatttcccactatccctaccccaggctgccactccttaatcaactgcacagcagtcaggctgatatgactcttactgtatttctcagatgtgcttcaagtggggctcccactcccggactttctggccatgaattacaacctggctgagctggacatagtagaggtgagaggaggggctaggggaggtcatgtcaatcaacactgtcagccagtgagtgatgagcaagagcctacctctctcaaactggaaagggtagagcctgggagggcaggtggccatcaatataatcctgcccctcagaatctagaacactccttgaccagggattccatagaaggatacttggactctgctactctcttctcctgccatcttgggccaattacttcacctctgtctgtgtctccattttccggtgcataaaatggagatgataatacattattgtcctcatagagctgttattatgcttcactaagatcatttacctaaaggcacatagtaagtgctgaataaatattacctttgtattgcatgccaacctttgagcttcgagtggtaaatgtacatttttcttatctgatctctctgctctgggaggtgggggtgcttgtcctcacttaacagttgagaaaattgagggtaagagaggtgaagtgacctctccagggtcacaaggcaagtctacttcaacctttgcttaaccaccacactggtttccatttcctgacaaggggcccagttccattccatccctgggcctaggtggtccctggtcattgctctcctacccctttgccttttgccagaatgccctgatgctggacttgaagctgggctgaccatggcaggactcccctgccagctgcctgcttaccaccaaccacctgcaccccatggaggagaccccctgattggagccaggtgggcctggccccctaccactggtggctgcctcctttgacaaggagtgaatgggtcaggcctgggctggagccttgccaataaacaggagaaaggctcttataaatatctgatacttcggtctctttatttttttaagtgacaaatctgtgtgtggcgattctttccttttggtgggttttggggtctaagaccagcttgggatctggagggaagctggtcacagcttgggggagttcttgggcacatattgagtacctgctcaatgccatgcccagggctttacttgtaccatctcgtttaatctacacaataactctattggtggagggcaagtgtcatccccaccttacagatgaggaaattgaggcacagggaggccaactcccttgtccaaggtcacatagtttagcaagtggcaaagctcttcccaccttagctgtgtgcaaaatcttggcaacttgaagatggctgtattcccttggaacctgttacaccaggagccttccctgtgtcaccttctttaatcctcacagcagttgacgggggtgagaaaggtcctcatttcactgatgagattgaggctcagagaggtggcatgactggcttaagccacctggcaagtcaggaggcagagctaggattggaatttgggctgtgaagccagcttgcctgggttcaaatccttcctctgcctcctctttgctgtgtgtcctgggcaagtcacatcaccaatctgagccttagtttcctcacctgtaaaatgagaatgatggcagtaccaacctctgttgcgggaagtcagggaacccgaacggagggaccagctgaagccatggcagaagaatataatataaattgtgaagatttcatggacatttgtcagttccccaagttaatacttttataatttcttatgcctgtctttactgcaatctctgaacataagttgtgaagatttcatggacatttatcacttcctcaatcaatacttttataatttcctacgcctgtccttactttaatctcttaatcccgtcatcttcgtaagctgaggatgtatgtcgcctcagaaccctgtgatgattgtgttatctgcacaaattgtttgtaaagcgtgtgtatctgaacaatatgaaatctgggaaccttgaaaagaacaggataacagtgattttcagggaacaagggagataaccataaagtctgactgcctgctaggccgggcaaaacagagtcatatttcttttctttcagaaagcgaataggagaaatatcgctgaattcttttctcagcaaggaataaccctgggaaaacgaatgcattctcagggggaggtctctaaaatggccgctctgggagtgtctgtcttatgcagttgtacataagggacgaaatacgccctggtctcctgcagcgcccccaggcttgttaggattgggaaattccagcctggagaaattctagtcagaccgattgtctgctctcgaaccctgtttcctgttaagatgtttatcaatgacaatgtgtgcccagtggaacatggaacctcattagcaattctaattttaccctggccttgtgatcttgctctgcccccatttgtcttgtgatattttattgcctttgaagcacgtgatctctgtgacccacaccctattcatacactccctcccctttgaaaatcactaataaaaacttgttggttttgcagcttgggggcatcatggaacctgccgacatatgatgtcacctccggagacccagctgtaaaatttctttcttttgtactctttctcttttacttagggaaaatagtaaagaacctacattgaaatattgggggctggttccctcgataaacctcagtaccaacctcagcagagtcattgtgaggatcacatgagtgaaatcttaaaaggtacttagtacagtgcctggcacagagtaagtgctcaacaaatgttagccacaggtgggtttttgagtcagagagatgtgcacaagtgtttttgtgttggtgtgtgggcaagtaactatgtggccctgaaccagcgcacgtatcagtgtataaatagcctgtggatgagtgacctggtgggagggtctgtgcagaggcagggccaagagtggaggtttgtgtgtgaaaggcccctggtgtccatccgtgcctgtgtgtgtctgtgttcccatgttaacttgcacatagtctgtgccaagggtgtttctatgtctttcattcatgtgaggatcagctccctgacatttgccgtatctgtccccagtgcctctcctgggattcacactgatgctattctttaaactgactccttttttacataaattatgtttacatgtaatcaagttaaaatacatcttaaatgtattctttaaaaaaatctgtcaaacgattaaactaaatcaatttgtgaaggaaacagtaagatgttgcatctagcttgaaggagaattcaaagtgcagacacatacacaagccatcagggatgtggaaacgaatttgccagaggcttgttctgtccttcacatgcattcctgtggttcatctacagcttccagagttgaagagtagctgaaaaatacactattgatgatacagctcagaggcaggcaatgagtaaagatccagagatattttgaggtaacaaaaataattttaacgctagttaatgaggaaaattatttcttagtgctcatcaaaaacatgactttcccattcaggtttatttgtaaatcagatagaactaccatctcactttatcagttctatccaatgttaacattaacaccaagaagaggaagcagtatatgacagaaatatatgtgtatgtgtgtatatatatatatatatacacacacacatacacacataaattgtatacatatatggatagtttacatttcccaggcagtgttcagaaaaactaaaataaaaaaagaaacaaacacaaatataattttattttgtcttaggacaaatataattattttgtcttaagaaaatcatatattttacatatatatatatacacatacatatatataatgcctacatgcatattaatatatatgtatgtatgtacattcactttatcatatgctacatccgattgattttttagatggtaattcaagtttgatctttgttctgggctactgtgttttctctcaactgtcaagttacgtcttatcaatactttagagagtgggtcaaggcaacacgggatgaaaaggcagacttcaggaggctaaaatcactagtgatgtagggggcaatgtgggagttatcgacttcctctgtctttcccccagtagtgttgaccatgagagtggcctaggaggaccaccatgtagactccgactccctctcactcgtagtggggcaaaccaaacagctggggctggaagtcctgcagggaactcagcaacggggaggcctttctggtcaggtcttggctcaagtttccatctggaaccatgaccacctgcatcctggcgtccagggctgcctccaccttgttgggcacatcttcaaagacagggcactcctccacaggaggaggaagagagaacctcctggcacaagtcaggaatatggcagggtcgggcttgctgctcttcacttcgggtcgtctcccagcatgatgtgatggaagactgaagagttcttgtgcctgcttgtcttcacctcgaaggatgcagactttgagctggtggccacggcaaaggggatgttgtgtttccgaaggtggaggatgagtttctcagccccctggcatgagcgctgcagtggggaacacatcccttggcctggcttggctttcttccaacagctcttccaccaggagctgcaggacatccacgaccacctgcgccacctccaacgccttcttacccatgaccagggacttcacatccccggtgtattccttttcatagcgatcacatatgtcttgaaacaccactgaacagagcctttcagtgtccagaagcaggccatccacgtcgaagaggaggtgggtggtgggccgcaggggtacagccataatgcctctgcttgggctgcattggggcaaccaggaggtgtgcacatacccaccagccccgcacacgcactgcaggttccagaaaaggacttctaagtggagcctgcaaatcagtgtcacttgcttaatgtcttttttaaaaatctagactgggtgcaatggctcacgcctgtaatcccagcactttgggaggccgaggcaggcggatcacgaggagatggagaccatcctggccaacatggtgaaaccccgtctctattaaaaatacaaaaattggttgggtgtggtggtgcgcgcctgtcgtcccagctactctggaggctgaggcaggagaatcacttgaacctgggaggtggaggctgcagtgaactgagatcgcaccaccactccagcctgggtgacagagcaagactccatcaaaaaaaaaaacaaaaaaaaaacctttaactatggggaaaaaaatgtatcggggcctcctatgatcagctggtgccccagccctggaaattatgggggtggcggctatgtgtgtccatatgtctgttggggtgtgtgtgtgtgtgtgtgtgtgtgtgtgtgtgtgtgtgtcagaatgtctgtctccctggggtgaggctctggatgtgggagattgggggcgtctttgtgagtgggtctgtgtctgggcacattcatgtgtgtgtgggtggtgtcgtgtagccagaggcctgattaggtcactgctcccctagccatggggccctggcaggtaagccctctcccagcctagcccaggcccatgccacagaggaaggagggcccatcttgcctcatcccagatgccagggctattcccctgtccctcaacatgagctctaatcccgtcactaatcgtctccccagctctgggacaatggcagccttgagggaggcctggcaggttcagatgccagggtaatccatgggctgctgatgcctggccctgggcgtgccagagacgcccctctgcccccaacccacccttggatgttcccacagcacacttatggctacctaaagccttgctgccaccctctccaggctcagtgtgctgatggggaaaccaaggcacaagctgttagggtttgaaggcctggcttcttgccaggccttgggtactgtgtggccttgaacaagccacaactcctctctcaacctcagtttactcatctttacagtaaggaaggggttggatgctctgacctctaatctgatgtcaacagtctttgagtggtcagttcctccagattcaccctgagcagaaaatgtgggctggactggcaagggatccctactccatgaccccacttcctggggaggcagtgataggaggtctgctgggcactgctcacctcccagaatcctccaatcccagataaggaagtagaggcccagaaagatgaagtggcccgcccaagggcacgtggcacatgtggagctggacttgaaccctatcttcctgagttcaagtctcttcctcactccttcacaccacactcagcagtggaatgcagtgttctcctttcaagaaagtgaggctcaaggctacagagtcagaaaagagcagagggaggtcttcgattctgggcccacagctattgaccccccgggacctgtcagacagcctcaccctgggaaaatgaagccacacgatgttccccacacctgtgttcataccagtacccacttaccttgccttctcccttctcagcccactctcagctcgagtagcatggggaggcctcccagggatctcaccaccatctgcacccttggcccccctcccttgatgccttaaatttcatttctaggatacctgtcctcacagccataccaattaggtgaggagggccacctttaatatgagcccattttgcagatgggagaactgtggctctgtgagttaagtcactcaattgtgagtgacagagccagaatgtggacccagaaattttggctccagagcctttactctaggaactaatgcccaggggtatttctcctcatcaagtccctcccctgctctaatcccttccttggcttcccatcaccctcaccagggatatcaaaagggctgcacatcatattgccttgggggcttgttaaacgtccccctaggtgcttgtcagtggaatcagtgttgccaaaggtgaggccaagagatatgtattttaatgaatcccttcccgtgggcaggcccaatccctgacctggctttggtgcatgaggggatatggggacgcctggggagcttatgggtgtgtcagagtcccctgttgggtggggatcgggaaggaggaggagagacgaagcaggccagaaacaactaggtagcattttcctctcttccaagaggctaggctgggcagtggttaagacaatgagtgttagacggtctggctggactcctgtgtgacatccggcaagctgcttacccttgctgagccttggcttcttgagtgtaagaagaggaaataataacagcactgatctcactgggtctttgtggtgactagatgtgctcacatacagcaggtgccttgtacacggtatgtgccgaataaatactagtgttagttttctttcctcttccttcaaacaaatgccttaaaaacactggggatacccagcacagatgaggctgtggagtagcagcattgaccacgtgcaatggcataatgctcaggggaaccatagccatagagagtatggctaaacatgcgcatgcatgctgtgctccagcaattcagctccttgttatttacccaaaagaaatgaagaataaaaacataggcccaagctgggtggtggctcatgcctgtattcccagcactttgggaggctgaggtgggaggatcacttgaggtcacgagttcgagaccagcctggccaacatagtgaaactccgtctctatgaaaaatacaaaaattagccaggtgtggtggcaggtgcctgtaatcccagctactcaggaggctcagtcaggacaattgcttgagcccaggaggcagaggttgcagtgagctgagatcacaccactgcactccagcctgggtgacagagcaagactctgtctcaaagaaaaaaaaatgtccacaaacaagagtgttcatagtagcttcattcataatagccaacacctggaaagcccaggcaccactggacaggaaaatggataagcaaactgtagggattcgcataattgagtagtacacagcaaagaagacccagtcactgcctcacacaatgggagcagggaagccacgcacataaagcacacagcggttgcacttagtgacccccaggagcatgctggactcagcactgagttagcggtcaggacagtggtcaccaccaggagggcagtgacttggaggggacacaaagagggctttgagagggctccatttgtaaaaattcatcacactgtatacttgtgatctgtgcccctttttgtgtacatggtttagattttagtaaaaagtttatcttttaaaaaagtgtggtgtggttgagtaacctggtccagggcctaaagtcatcagaatgaacattgtagggtgagggctttagagatgattgaggtaaacaaggcaaatgccatccttcttccccatcttagcaggcagaggttcagggccccacgcaggagacagacccacagactcacagagccacagacacagtgacagcttggcatgtcacagattctgagagaggaaatcccaggggactgtgggagctcagaggtgatacctcatgcagcttggggctcatgaaggcttcctggaggaagggatgcctgagctggtgccttcagaggaattgccaatgaaagccaaagtctgtaaatccatacagtagcttccagggcttcatcacacattgtttaccacctatctctcactcccctccaatcacatggcccccctgctgttcctggaacaccaccctaggcctttgtgtgggggtccctctggtcagcaggctcttcccagacagccatctgactccttccctcttctccttctggtcaaaagtcacccctgcttcaatatgaggccttccctgaccacgctattgaaaatggcacccactccccacactcctgagccccttccctgctttatttttgttgttagcttccgacttactgtattttttttgagatggagtctcactctgtcgcccaggctggagtgcagtgaggcaattttggctcgttgcaaccttcatctcccaggttcaagtgattttcctgcctcagcttcccaagtagctgggattacaagcatgcgccaccaagcctggctaatttgtgtgtgtgtgtgtgtgtatatatatatatatatatatatatatatatatatataattttttttttattttttttgaggcagagtccctcactgtcacccaggctggagtgtgatctcagctcactgcaagctccgcctcctgggttcacgccattctcctctctcagcctcccaaatagctgggactacaggctcctgccaccacacccagctaatttttgtatttttagtagagacggagtttcaccatgttggtcaggttggtcttgaactcctgaccttgtgatctgcctgcctcggcctcccaaagtgctgggtttacaggcgtgagccaccgcgcccagccccaacttactgtattatgtgcttatttgtccctttcagagctgtgctttccaatatgacagccaatagccatacaaggcgattgcctgaagtgcgacaagtccaaatcttggtgtgctgtaagcagattttgaaaacttagtatgagaaaaagaaagtaaagtaccccattcataattttctgttggttatatgttaaatgagaatattttggatttggtgggggtaaataaactagactattataattaatttcacctgtttctttttgcctttcaaaaaatgtggctactagaaagttttaaattgcattgcatttccactagtcggctccttcagggcaggggagattgtctcttttatttacagcgatttccccagcatctagcagacagtgggtgcctcacaaatgcctgcagtggagtgaatgaatggacgcatttctcgtcgctgtcatctgcaccagcctcggaaaggggacaaagctctggaactctggggatactgagccttgggaggtgggggtggagttgatgcccctcccccaagtgtgcccagagtccctgtctccaggcccatagccctctccatgtgaggcctggtgcggggggagggtggcggaaggtagaagacccagcagctttaagtcccttctttccctccgtaggccttcgctggggaaggggtggggtaggcagggtagattctgtgccattggaatggctcttggggagccttggagggagcccaataggtggctgaatgggtaggtggcagggccccacacctcacccctggctctgagggaggtggctgcctgtgcagcccccacgccttcactcccactcctgggcaccgaccccagtccccttactcgcctccaaggaggaaggcttagcccaggccctcggggaaaaccgcaatttgcttctgacatgacatattgacgggattctggcggccgtggcccctttgtgtcctcagagccgcgtgggcatataagggccacccctcagctcgcgtgggtggaggaaccgacaggaggccgggagcccccacctaccccttgtggagctgcaggagcaagggtaagacagcctgaggcagccctgctcttgtcctgacgcccagccgttgaccccactgccttctgccctcccatatgaatgatgggcacggaaagaactcaccctaggaggagactgggggtaccaagagggtggatgaagagaaaaaccatgttacagatctggggcccagagagaggcaaagacttgtatatattcacagccggaggggtgggcaggggatccctgtccataggatgatcctatggagagagttccaggagtgcccatttttctcctggccagtgacatgctgctgaatttctatcccctgccccctcagcagggaccccttctgacacacaaccacgcacagaggccttagacatggtccctgccttcatggagtttacagggaagagaaataaggacacaaacagatgcataattgcaaatggagatcagcaccttaaagtaaatattctgcgtgatgtttagtgacagacggatttctttagacaaagtgaaggacggaggcctctccagggaggcaatgtttatccggaatctcaatgataaggagtcagccatgcaaagaagcagggaggagccttcctaacaaggaaccgcatgtgcaaaggccctggggtgggaaggggcctggcatgtttaagctcaaggaggtcaaaaaggcaggcagggattttgtgggtaatggcaagaagcctgggtttcaacccagggcagcggggagccactgaagggtttaagcaggagtgatgggtgggcatagatggatatgtgattgggtgggcaaatacggaactgcttaaagaaaaatcccactctgtgaacttagcagattagccatgcccccacctgccaccccattccctttttcaacaagatttggggtggaggtgggggaaggagaaagataagacatgttaagtctaagtgttgggtgtccccagtcagctagaccttctgaaacagcctcatgagccagtgggaagcagctgctggaaacaaagctctcatcctgctgtcctggagggggaagcccctctgtctgcagctgtcactccagacacccggccaggctcactgggcctctgaggatgaagatttttatgtcagatggactcaggcttgaattctgactgtctctgattagttctgtggccttggtctagtcccctacccctttcggtctcagttttcccagctgagaaatggaacccaatgagggagaggcttggaaagtgccttggagacttgagtgcattggcagctgcaccgtgccacctgcgtgttagctctgcttacatttgggaggagaaggctttcctgggagtgaagctcaatttgggctgtgccaggtgggcaggaagggggaaggctgataatgggaacagagaggggaaaggcttgagcaggagaagggtctcagagttcctccttctgctccttataggcatgcagccagtcatgctggccctgtggtccctgcttctgctctggggcctggcgactccatgccaggagctgctagagacggtgggcacgctcgctcggattgacaaggatgaactcggcaaaggtgagccccaggtgggcagtctgtgagggggctgctgcaatgtcaacgactcaatctatatgcttagagcatctgctttaagagcagataagagcaggttgtgattctcagctgcttagagagcacattctcctgggagtagctgtgcaggagtgaaagtttcccttgcaggcttgaatgggcgatgaattccctcttacgggaggtggactgggtgatatgggctgaggctgtttggggactgtgtgtggctcagggacagggacagagtgaggttgaagaggtcgaggggagggtgctagctgggccagtgtctctgcctcacatcactagggtaagggaactgtacttggcatttggtactacagagcccggtggcctgtggtgacagtctcagggatagagtagattggtcatgagcaggaaatgcttcagagaggccccctggcctgcctctactctacagggccattcctccatcctgcccttcccacagtctgcacagagtcaggcctggagtgcccaggagagaagcagagaccatctcctccaacttgattgagccctggtggctacaagctcccccttctttgccctccctttcagtgctgtagggcagtccaggatcaggagccaagttacactactgaccccaacccaatttgctgtgtgactttggacacgtctctgcccctctctgagcctcagttttcccactggtaaaatgaagggattgttatgagatttgctcattcattctccaaacacttactgggtacctcccacatgccaggcagggagggtggccacaggccctgcggtgggagtaagaggctgttatggcttagtgggttccaccatttgagtgtaacctctgggttaattccatttttaaaaagaagcctactcaatctcagaggaaggaggcagctgccatggtcctgggggtgaggttggagtttctagtaccttcctacttccactctctctgcagccatccagaactcactggttggggagcccattctgcagaatgtgctgggatcggtcacagctgtgaaccggggcctcttgggctcaggagggctgcttggaggaggcggcttgctgggccacggaggggtttttggcgttgtcgaggagctctctgggtgagtcccacctgctgcatgccctacaggaagacttggctttgcttccaggaattgaggagagattgtctctttgtaatttgtccaataggcagtgaaggttgtgtgggagggttgtgatccgggtctaaaaatgatgactctactgcatgcctggcaggacaagaacagcagaatgccactgtggttgagggttccagctctggggtcaacactagttactcactgtttgaccttggggaagttgcttagtctctctgggctaatctagctatcagcatggttccctttttcacctcctccaggtgtccgctcaaaagaggtgtgggctgattagccctttcttatccccaccatacattttacaggtttattttatgtctcctttgctagattataaaccccaggaggggtaggatttttgtctggcttattcactgttgtgtccccgggatcataaatagggacacagtgtatgctcaaaaagcttttttttccctttttttttgagacacagtcttgctttgttgcccaggctggagtgcagtggcatgatctcggctcactgcaacctccgcttcccgggttcaagcgattctcctgcctcagcctcccgagtagctgggattacaggcgcccaccaccacgacgggctaatttttgtagttttagtagagaagaagttacatcatgttggtcagggtggtcttgaactcctgatctcaggagatctgcctgcctcggcctcccgaagtgctgggattacaggcgtgagctggggtctgaatgtttgtccctcacataggattccagaagactgctacgattgtctgaatgttggcccctcacacaggattccagaacactgttaccaggttctgaatgtttgtccctcaaataggattccagaacactcctgctgtggtctgaatgtttgtccctcacataggattccagaacaccgctactagggtatgagtgtttgtccctcacacaggaccaaagaacactgcagttagggtctgaaagtttgttgctcatataggattccagaacactcctgctgtggtctcaatgttttcctaaacataggattgcagaacacagctttttttttttcattcaaaaaaaaaaagtatttttgaatgaatgaatgaagagcatcacattatagctaatatgcactaactcaatgagcacctattcagggttttctgtgtgtctagcactgtgcattgtaaatgaattatctcactgagcccagaggtaggactattatgaactgcatttaacaggtgaggagatagaggctcctggcagtgaagtgacctgcccaagctcacccagctaggggaggagatgggaatgtgtctgtgtgtttcatcacagcccatactgcctggtcaagtccagtggaaaccagtctatggctggtgggtgaattaggggaaggtcaaacaacagggcccaggcaaggctgaagcccagtgtatggagaagagtcactggacaggaggcaatggggtactgggagcggaaagaagggctgatgggtgttcacttccctaaacggaacataatgtccggaaagcaggctggtaaatgctgatgttgctcgaggttcgctgtgtgtcattctgtggtaggtgtggtcaatgtccctattttacagatggggaaaccgaggcacagcagcactgtgactagcccaagcccatccagtcagttagtggcagagctggagtttgaaccatctgccttttactggctgcagtattagcagctactcatggggttgttgccaggacagtgagttaatctgtgccaagcagctgaaatagagccgggcagagagtaagtgttggatagatattattattattattaatgcaatatttactctccctcccctgtgaaatccgctttcttggtgaggctggagtctcagacatgagcttggcattgttcgtgccttgaagagctcctcataggtggtggagtctgacagcgaagatcccatgggctcagggcagtgatggaggcagcccaggcagggtgggataggcgctcagagggcatctgcccgaggcagaaaaccaggatggaaggcttcctggaggagtgcacgtgaactgggaggagtcagcaagctgaagagggatgcagaatggaagaagggtcaagggaagtgtgttccagacagaggaaatggcctgggcaaagacccagaggacagagagtaatgacttgtgaggagtcgtgtttgagaacccactcgggttgcatttgtgtgagtgtgcaggggtatagcagggcgcaatgtcaaggccagaaaccaaaccagggctgagactgtggggatggagtgaggaaaaactttaattccttgagcctctagcggtgatgatgataggacatttgttgagcacacaccgtaccaggttctgcactcgaattatctcacttgtctttgcaacactcctgtgaggtaggaactagtatcgccccactttacagataaggaaactaggcccagagagatgaagtgatgggccaagggctcgcagctggctctgtgggtttgaggtgagataggggacaccaccaagagccactctgggcgccgcctgggctgggatgtctgggagtgagcaaccctctccctgactcccatcctagtctgaagattgaggagctcacgctgccaaaggtgttgctgaagctgctgccgggatttggggtgcagctgagcctgcacaccaaagtgggcatgcattgctctgggtgagtgtgtcctggggacctctaccctcctgcttcctatcccaccccctgacctgttggagactcctactctgctgtccccccactcccacccctctgtatcccccatttcctttcaccctatttcctccccaagggactcccaatcctactgtttcccccctggatcctatgccattgcccttccccagggacttccatttcgctcttcctccagacccggaccccaccgctcaggctcacctgagagggtcagggaagagggtgcagggaagtgcaaaatggggcagggaggcagaggctgagaagggggcacagagcctaggccactggcagggccaccctggtgggcggggccaagggtgggagctggctgcctggccacacccccagtgtcctttcttgcagcccccttggtggccttctgcagctggctgcggaggtgaacgtgacatcgcgggtggcgctggccgtgagctcaaggggcacacccatccttatcctcaagcgctgcagcacgctcctgggccacatcagcctgttctcagggtgagtctgcaggttccagcctgcaaccctgacccgctcaggatcatctcgcacccatctgggcatctcccaggtctccctggagctgccagctgcgggggcctgaactcgtcctacccctgcttgtcccgccggtttcaacccacttcacagaccgacagattgagtcccaccactgacagggactccggcttaatccatagcttgtgccacccactcctgggcaattcctctagtctggttcacgggatcctgccgtcccctctccgccagagcgggcccagggtcagctgggatccctccatttgcgggatttcagcccctgctctcagcacatgagacccaactctgcctctgacttgctgtgtaacctcagggagacccactccctatctccccattctgggcccccatgtccccatctgtatatgtggagctggatttgatgattcggaaggggctgtgacttcagtctcttcccaggatctgtccaggtggccctccctacaccttgttgaatcatcacttttttctttttctttttcttttttttcctgaggcagagtctcactctttcacccgggctggagtgcagtggtgccatctcggctcactgcaacctctgcctcccggcttcatgcaattcttctgcctcagcctcccaagtagctgggattacgggcgcccaccaccatgctaatttttgtatttttaatagagacggggtttcaccatgttggccaggctggtctcgaactcctgacctcaagtgatctgccctccttggcctcacaaagtgctgggattacaggtgtgagccaccgtgcctgacctctcaatcatcactttcatgggaccatggaggcccagaggtctccttgcctaggatcacacgcacagatccggcagggatggagaggggctgcgctctggctgggtccaaggcctctgccagcactctgagccagcccacagctgcctcccacttgtgtctccccgttctgtgtccaccttccaggcccaatcccaatcccggcccctgctccatctttgttgggtaactctgagcagtgggggatcatcaggcagttctgtgttagctcccaggaacagggtaactgggttgctcctgtctccacgagggccctaagaaagggattccaggcaagggctttgggctccttaaattccagtggttcccaggatggtgttggtgtcctgtgtttggggctctgtggttgccatcctgcaccccatggtctccaaacagacctgagcctgtctacatgcacttatcctcaggccatcattcattcattcattcattcattcattcattcatctaacaaatacttgttgaacccccactctgggggctcaataacaaccattgtcctaggcctaaatgtctcttgtctacaactgttagagggacaaaggagacagacatttgtcaagcacagattttacaccagccacatacacactcccatgtaacccgggcagcagcagctctctaaggtgggcattgtacagttggggaaaatgaagccatcccctgggtcccctcgggaggaggagccaggatttaactcaggtctccaaagccgcagtcaacaccacccccaagagaagggagaggagaaatccagagcccctagtgtccgcccgaccctgtcatctgggttgaaccgtccacctggcagccgcacccacatgtgtctccctctgctcaggctgctgcccacaccactctttggggtcgtggaacagatgctcttcaaggtgcttccgggactggtgagtgtgcgggccgtgtgccagcatgccctctcccaggactgggcctctttccccctctggttttgggtgaagtttggcgccaggcaggattaggctgtacttcccttccacacccacctggtaatcccatccgggcctgctgaccggccttcctggcgcgcctgctagtctgggggtggatgacacgatcctttcggcctgggtcccctgctcccaaatcgtaggctcctaagaagggtaagaacccctgctctgtttctgccatttgtattagtaccaactttatgtttttctttaaattagcgtgaaatgaaaattggatcacttggtgattttaaactgagccctgtgcttggcaatcatgtctagaaaaacacatgtacctttattcatacatcacaattaaacatattaagattaaaggatgcctgtccatggcctgccccagaacatcctggcttctgcactcgagagagctggtctggcccaaaccccatatcaccgaggaagaggggagggccacatagacagcaaagggcagtcaggcctcctgaccccacggcctagctggctctccctgtgcattcttgcgaacgctgctgggggcagcagaagaatgggagcctagggttggcaaaactgccctgggcttgaggaagccagtttggaaaagaagcttagcaggaggaggggcccctaagcaagaccatgtcaggcaggtttccaccagggcatgaaggtgcatttcaacggcagcccctaacttagtctctggggcaattggccagcagctaggttttgtgtgatacaaagaggttttgaaaacgagcattcattgccaacattcagcattgaagatttctcgtaacagtccagatttctggcttctgttttgcaatcagccatcctggctgcctgatacctccctcctgtaagtgggaagtacctctggtacctcccatctggtgctcagagggtttgctttctccatccccagcagagcccctctggtctcctctcatttctgtgacttgcctgaccccagaaatcctggagtttggggcccccacttgacatgtgacagccctcttttgtctctctgaatacagctgtgaccttggacaggccaccttcttctctggcctcagctggaggatgaaggggctggactgcatcctctctgaggctcccactccagtgggctatgggactcaggttctgtgattcccagacttggattctgaaagttgaaccacttgctccctattctcctagcacaggggttaggaatgaacacgtggtgatatgcagaatggacactccagatccaggcctgactctctgggtggaggagaggaggtgcccctctgtggggtcttgatcctaggcttcccagtgcccacgtagaatggcaggggatggcctgtgactttatggggaaccaaagccgcttttgcctcctcaggtgaaggccttgtccgcatgcccaaaccagcccctgaaatgtgtctcccgtggtcccccagccacctttaggggttttctaatggggctcttgtaaccaagggaagacagcttgggggccacccaaccctctgacacctcaagcccccagccccttccctgcctcccacctgtgtgtcttctgtctgtctctgccttccgccttgccttggtccccagcaccacatagcagcagatagcaaagcatttaaagaacatgcagctgtcctcgcagtgagctcttctttgccctgtaacatgtgtctccctgacacagctgtgccccgtggtggacagtgtgctgggtgtggtgaatgagctcctgggggctgtgctgggtaagtcagggctcaatgccctcctctttgccccttctacccgtctctgtatgaccccaatggggtagggtacgaaggggagccagaagcggcaggatctcagggtcctttagttcctcctcacactgacaggctgcccctttgaggagcctcatggaggaggcctgggctgaggccgcctagcagggcatgcagacccagaaccatcagttctctctatgttgggtgctgcagaccaacacttactgagcacctagtgtgcgcttggcactgtcagaaacagggggaagatataatgattacctggtcagactagatgaccgaggcccagagagctcaagtaaggaacccaaggccccgcagccacagcagaccccagtctctctgtgccttatggagacacaagtgccttctgtgttcacaaaatgggtttgggaaaatataaaaaggcacaaccaggaaaagaatagaaaacttggggccggtatgtctctatgggtggtgttatgtaagagaggcagggtagcagtgtgttagtggcatcaactctggaaaacaggaatcctggttttgaacaccgtgactgtgtggccttggcctggtgacttcccctgtctaagcctcaatttccacatctgtaaaatggggatgacagtagcagccaagtgaatgcttagtagagtgctaggcattcagcagacactcaataaatggaaataggggctattatgattgggaactgggcttatagggtcgttctcgcccccactttcccacgcaggcctggtgtcccttggggctcttgggtccgtggaattctctctggccacattgcctctcatctccaaccagtacatagaactggacatcaacgtgagtaaccagaggggcctctcctcctgctgggggtggctagataggggatgccggatcaaggcaggtgggtgagcaccttaagaccctcctcggccctgtttcctgcccctgcagcctatcgtgaagagtgtagctggtgatatcattgacttccccaagtcccgtgccccagccaaggtgccccccaagaaggaccacacatcccaggtgatggtgccactgtacctcttcaacaccacgtttggactcctgcagaccaacggcgccctcgacatggacatcacccctgagctggtgagtgtggtgcccgggggatggggatgggggctccttgccctgctgtgccttggcattactagtgttgacctaggccctgatcagccttgctgagccctcctctctataataaaagggagttgaacaagtttagagtgtgtacactgctgttctccactcctatacttaggggagacattgctaatcgatcgtggtcctctacctggttaaacctgactgggacttctgaatccttctcaacttggcactccaggaggtcactttcaattggtcaggactggcatgtggaatgaagcccactttccatacctgtatcagatgagcctttctagagtctaagcactaaagtgtgaaccactaaaatttccactgctttctcaagagcagatttgagtgggagaaaagaaaactaggcagggtggctcatgcctgtaatcccagcactttgggaggctgatgtgggaggatctcttgagcccaggagacaccccatctctacaaaaaatacaaatattagccaggcatggtggtgcatgcctgtggtcccagttacttgggaggctgaggtggaaggatcatgtgagcctgggaggtcaaggctgaagtgagctgtgattacgccactgcactccagtgtgggccacagaatgagaccttgtctcagaaaaagagaaagaaggaaggaaggaaggaaggagagaaagaaaagaaaaagaaagaaagagagagaaaagaaggaaggaaggaaggaaagaaggaaggaaggaaggaaggaagaaaactagggttggattgtaccaagagttacccaaacatttgttctgcagcttctagtacctcccaacttccattctgtccattctggcccctctgacatcctggaaagcccagaccccagaagccccacccagagacatttattttggtctcagcctgggctccccacctgtagctcaggcccaaggaaacaggggttggtcactcacttcttgcaagtggggtccagacagcactctgaaggcctctgggaggctggaacaggaccctgagctggggagagggtgtcttccagctgggggatgggggtagtcatagccaggcagagactctgcgtgtaagaacgtgcatgtctgagcggcctgcggatgtgggtgtgtgtataggagcattgggtgtttgcatatgagcatcgtggcaagagagaggaatgtcagaggcctcgtcctggtgctgcatgtatgcttatcctgtgtgaacagggctgttctgagaagtgggcatatgtagttcggtgggcggggggtgtctcaaacatcagggcccccggaggctgggccatcagttagcagcctgatgggactatagtgaactggagaccctgtgccccatttctcaggcagttgccactcagctgccacaaggggagggggtgcaggctcagtgtgaccagattttccaactctttagccagaaactgaaaaatttacatgtgacttcctgatttataaatactagaaataaattcatagtttttgaaaatactatttgggtaaaaggcaaaaagatctggggtcagatccctgggcctttagatcgtgagccttggcagagtaaaaggttttgaagttagcctgcccaggttcaaatcctggtgtcaccacttaccaattgtgtgacccttggcaacagcctcagtgtctccatctgttaaatgagggcaatggtagcacccacctctttgagctgttgtaaaggtgaaatgagcaaaggcgtgcagagcccctagcatctgtctggcatgcagtaagtgctcagtaattgctagctgatagaacaaacttgagtgtttgtagtgatatatgtatgaaattggcagggtagggggaagagtggtgaacgaaactgctctgagtgtgctgagggattcctgttctgtctctgtgctcaccaaccctctctcccattgggggtccaggttcccagcgatgtcccactgacaactacagacctggcagctttgctccctgaggtgagtgacgctctcatgggttttgatcattgtagctctttcctgatgaccatgaatggagtccagaatctttctcaatacagctctccaggcaactgcaattgaacagttgagtccaaattcacactaaagtgtgaatgactaacacgacatcctttcctgatagcagattttgcttagagagtaaaggattagggcttgactgccccagaaatcaactgggcatttatcctatggaaattgtttctgtagcacacaaggacaaaagtcttttcaggttactgagctcccttctaccaactggcttacttcatcctgaccttagtcttcaatgtccccagagaaaagactagggcacttgtcttggagaggaaagaaaagggagagtgtcaggtaggtctcactagtggacataagtacatgacttccaggccaggcctcagctttcccatccttcaactggggctggaccagctgctttccagctgtgagaactggaattcgtactgaagttaaaatgtctactacaaggtccttatgtaacagcaggttctgaaagaggttggaaagaggcctaggggcctgggctctcaccagagaggatggaaatgaaagctgggtttgggggcacagaggacaaactctgtgagttcttgaagttggtgattcaaagcagtctggatgaatgaggtcggggcctcagctttccagagtcccttggctaaagggcataggagcctcatggaagggatgcgattggagtcagacattcagaagaacctccagagagtaggagtggagagggacatggggcaagtggagttggctggggcaggggtatccagaagcagcaagctgggcctgcccctccagcatggggaagctgggcttgtctctggaggctgaatcctttggtctccatttgctggcctcgcagctttagagccccatgtggcttcagattctgtggcatgtgagggtggaatcaggtgattcctggtcctgatgatcctgccccttagggattctgggcttgaggaaacctagactcaaattccagcaggcaagggacatacttatgtgttccaagcttctgtggttctgtaatttccttagtctcatgacgttgcaattatgagactcagaatttcctgattgtgtgcctcatttaggcagtcagcgtatatccactgagcacctactgtgtaacaggccctgcaatggaacaagggcatacctgcagctggggctgcacaaagggcaaaaggtgaaaggagagaaaagcttctgcactcaaggggttgccattctgctggaggtgacagacattgcacaaataaacagaaacagagacagtgtcagaaggtggaagagcatggagtggcgaagctggcttaggagtgctggctggtgcttttagacatggtgctttgcaaggcctcagtgaggaggtaacatttgagtgaaggaggtgagtgagggaactttgcagttctctgggaagatatttccaggcagagggagcagcaagtgcaaaggccctggcgcctgctgggagcatccctggcagctggaggagcagccacgtggccagtgagtctggagggagaacgcagggcagcagcgggaggagagcaggtgaagtggagaggcgggcaggggatggaggacacagagcctatggcctcggggaggattctgactctgcttgagacaggaagtctgatttggcagtcctgcaggtcggtgtctccacacctgagtgtcagcctcatgggggctgagcccaggcctgtgtctttcaggctgtaacctcgttgcccagcacgttgcccagtgcctggtaggtgcttagtgagtgtttgctgactgactgactgattgtagtcctggggcatctaagttatgcccctgcatttctccaggccctggggaagctgcccctgcaccagcaactcctactgttcctgcgggtgagggaagctcccacggtcacactccacaacaagaaggccttggtctccctcccagccaacatccatgtgctgttctatgtccctaaggggacccctgaatccctctttgagctgaactccgtgagtggtcaaggggtggctgggggcccggcattggggttccaaatgggggtgactgtctccaggactgtggaggtaccgtccccctgatttcagggtgggagccccacatagtccagcacaggaagccccccgccccacaaccactgtcatcatctgggctgagacccaagcccctgcttcagttcctgcctgctccctcctgtcatgtctgcctgggcctgtttgggctgcccacactgcttcttggggatctcagacgttgctccccatctccccagcctctctgcccagctatctccctgacgaccctccagcttcctctgaccctcccgctccagtcagcttcctccatcgcacctctgcacacatctggaccgaggcaggcccctccccctatcctccaccttggctccccatggccaaacacctgagcctgacattcattgtccttctgccccatccttgccttgcccgtccttgtcccctaagcctcagctactcaggtctaccaggtcctccctccctggcttgtctgtgctaggtccaccacctggagtaccattttccccttccttccactaactcctcatctttcaagattcaactgttacctcactggaaaggccttccctcaccgtacagcaggcatgcttgaggggctctccaagctcctgcagccccagagcttcctctcctacattaccaattgccctcaattttaatactgtggttctctgctgttcaagaaaacagcaaaaccttcaaattaccttctcagggctcagcacagaccctgacacacagtagggcctcagtaagggttagtggacggaacagatggatggaggcagacccgtcctcaagctccttctgccgattgggggtgacttctgcctgctttgcccatgcaggtcatgactgtgcgtgcccagctggctccctcggctaccaagctgcacatctccctgtccctggaacggtaacttgggatcctggggacaggatcttgttcttgtctttaggaacaagaattaggggctgacaggatccgcctcccgtttcttgagcatcagcgcaattccaggtgtttttccagcatcctccttgccttcaggacccgccagggaggagacagtgttagtccatgttatagacaaggaatcgggggctcagagcagcaggctcaagagtgggcttcttccacggcacccttttgctgctgaaaacctgcctctgaaagataaacctgccgccaggatgtggagtccaaactcctgagttatcagccccagaggctaaccaagagacaaccggccttgagtgtcaggaaatgtgttgttatttatgtggacttgttacttgttacttctctattctcctcacccctgtggtaactaggcgtccatcaagataatcataatgaccagaatgatggtgttggtgacagtccttcatctacacgcacagtactttacagtttgcaaagcaccatctacatgcacagtactttacagtttgcaaaacgccgtgctggcccaggctcacacggcaggccgtccctagagcaggtctgcagtctgggcctcagtgctgtcaccatggcagggccccggcctgtctgtccctcccctggcagtagggactttcctggagattgctgagacctgacgtcctacgccacaggcacccagtgctcctctgactccgtcttagcacccccacaggctcctcaggccactgctggcctctgccttccattgttgccccattgccgactttgatggagggcctcgcctgctgcctgggtgcacctccacttcctgatggcagttcacgcctcagtcttttaggaggtagagatgcgtgcccaggctctggccctgaatctgcacttgggccagatatgatccatcagtgagttgctgccttgagtgagcacctgctgtatgcaaggcactctgtgtccagtgctcagtctgggggaggtcactcctctgaatggttcagccacctgcccagggtcaaatagctgggagtcagacaaaggcgccaaggccagaggtggtggtcatgatgcctcagaagggaggttaggtccctttgggtccattttacaggtaggaaaactgagtctctgagtcaaggctggatagaggcagagtgttgggctggtaatcctgtttcctgatgatgagagctatggtggggcaggctgggggtgggacaggggtggttgggggtagcgggggccccagcatctctcttctctccaccaggctcagtgtcaaggtggcctcctcctttacccatgcctttgacgtaagttcctgggagggtgaggggcttggcagtgatgagagtcttcaggtgtggcatggaaagggggtggccatgagtcatgggccatatgactgagctgacctcaggactgggatcctccccaattaagccagagtgggcaaatatcagggcgggtgtgcgtgagagagagcagggggtgtgggcagtggggagagagagagagaaacagtgatcatcttaggaaagtgaatctcatgatcttccacggtcttggaacctcacaaagttgtggacatctagaacctcacaagggtccatcattctggaacttctcccaagtaataaatttcccgaactcagcaagttccatttcagagctcacagagccccgaggttcctgcttcttacagagttctgaggttctggaatctcaccatgggctcaggttctagaacattctcagagtccctaaactgacaggaatctaaggtcagaccccatagactggagctgggcacatttccttccctctttcttaggcactgcccacctccagccccaacagagtcttataggaaggcacttcttccaagctcatggggcctggggtaaagccagcctaaatcacagaatctctttcgaggtcactggtggacagcccaggccacccccaagtgcccagtgcctgccaggagctgtgtcctcaggcttgggggaggctgaggcagctgggcccctgggtttctctccctgggaacgggatgctgctgcctgtaaagccacaccccagagcaccacccccaccaccctgtgtgttctgttgcagggatcgcgtttagaagaatggctcagccatgtggtcggggcagtgtatgcaccaaagcttaacggtatggcaggttttgctctcttggacacatggagtgtctgaatttggtattgtctagtctgttgcctctctttatggttctgatggggacactgaggccagagagagaggtcgatcctcatttgcaagatgcagaaactgaggcaccaatttttccatttaaatgacattgattagcacctacatcttgccagcctatggacttcaagcgctgatctgacctcagtcctgccttaagctcccacagtctagtaggaaataatcatataaacaaatgattagaatatagatgacccagagtgtgtaagggattgatgaagcctttaggaggcttgacacgggggcaccactgacacaatacagaatagggacatttttgtttgggtgtaggaggatgagtaggagtttgccaataagaagctgattctgtgagaagagaactggctggctagtgaaagtgatggaatagggtcagcagggtccgagggttcctagggtccaagagctccccaccaatgtacctttgttttcaacgattctcttttcacagtggccctggatgttggaattcccctgcctaaggttcttaatatcaatttttccaattcagttctggagatcgtagaggtgagccttctctgcagatacggcccaggtgggccttaagcttgtctctggaaagctctgcttgaaactaatgaggggaatgctttgcttcatcctcttgtctgtccctgatccattttctaaatttctcagtgagttacaaattgcctaacttaggaatggcaaatatatgacatgtgtgctactactcctccatttcttgcccatggcagacatcatcaatcaatcacggagttctttcccattggattcagagacatgtctggcctctagaatggaacctaagattcactcacagaatcacagttcccctggtccaacagcaacaaatacatatgccatctctcccttatcttgtgtctgcagcagatatgaccaatggatcatgaccctttttcttgtggaatattgatatggcctcacaatccttttcaaaccagcccaactttgggtggtggaatagctctaggaggtgggcagagcagagagttctgtacccatttctcagatgaggaccaaggctgaagtaggtcagatttctggcccaagttcaccagtaaattaatagcagaaatggcagttgaacttgagtctattaagtcctcaagtcagagcctgtcccacactggatgtcattttttcatcattcatttattcatttaatgagtgcctgctgtgttccaggtacagggccaatcccagggcaggggagtaaagatggctgcagggatggggcattgcagagactcaggggtgtaaccaagagcggttgttccttacagaatgctgttgtgctgaccgtggcatcctgaggctgagacatggccaccagccttccctgttgactactagagaccacctgtctactctgcctcaatttccctcccagtctctagctgatgttggtgacagtaaaaatgccctctggccctgaagcactactccaagtttggggtgggaactgcctggctaatcatagaactgcctcagagagagctctggggcctcagtagcaaaccctgagctttcaataaatgactcctgtatctcggtatctcctggctggtttattccccagtcacgtaggacttgacttggcctttgcctccagtgccctccttagctccaggtaggagcttctgggaggtgaggggactcagggccttgtcattgtagctttgagtcccaaactgaccttgttggcctgggcagcctctgtgtcctgttctgccttcctctctgtccctgccccccttgcctccagctctctctctctctctttctctaaatacttctacttttcactctctctctctctgagtctgcatttttctctgtttctgactttgggatgcttatcagaagtgacatctgagctgaattttgaagggagaataggagctttccaggaaacaaaggcactagcaccccaggaagcaaggatgagtgagacttgttcttgccctgtggtgtgggggggtccctattggctgcacatcagacatggacacagctcagaacagagctgtgccaaacgctcttggtgcagatggggagactgaagccagagcagggcttggctggccctggtccacacagcggcagagttgggatgagagactaggggtcctgcctctaggtcctgggcttctccccactgcttacgatgggcacctttggtgaaaaatatccccaagttggcacttacagatggcctgagtgaagaagtgccaaccaagttttgataactggctcagaggatttgaggctaggcaataggtaggggagacttggagctcatctgaagatttatccacaactcattcattcagccgaccagccagccagccagcctcccatccatccatccatccatccatccatccatccatccatccatcccccctcccatccagcctcccatccatccatccactcaccctcccatttagcctcctattcaaccattcatccaccctcccatccaactttctacccatccattattctatccacccacccacccattctcccatccatccatccatccatctatccatccatccatctatccatctatccatctatccatccgtccatccactcatgcatgcatccatccattcatgcatccatccatccatccatccatgcatccatccatcttccccccttcttccttgcttcccttcctccttcccttcctctgtcccaccctcccttcccttttctcgtcctttcttttcattcatccaccctacatttattggtgcctgctacatgccagtgccgggtgacatgctcgggtttatcttcctgtgtctgatttccagacacttccagtgctactgattcccatcatggttaaatgagtggcttgagttagctgtccgtgttcaaatcccttcctggcttctggttagccatgtggcctcaggcaagtcatttcctctccctgagcctcagtttcttcatcagtaacttgaggatgttctattatggctttgaggattaaaccagcactcaggatggtgacccatctgtaagaagcccccagttccagttagctcttgttacggttgcattattctatctcctctccattcacagccccagctgtccctcctcatctctcacagggaacacccttccctgactcccacccttctctctttcatcccatccccctcctgcccatccttgacctcctttgaccgtctctcactgtcacagacagccctgcagtggctggattcctggcgccaacaggaaagcctccaagctccgaggtttggcatttaaggctgcctgtgacctggcctcagctgattcctcctggagcatgcagagggagcagagctgtctctgtgcctcgggctcctcgtctgcgaagtgggaatattatagtatttactcacgggtcatctagggatgaaaccagacaattcttgtaaagttctgagaagagtgcctggcacctggaaaacgagtaacaatgtgcagccaggcctttgcacggctcttccctcttcctggaacattccctctcctctcctccaagtgtgcctggcaaacccgtgccatccttcatacacaggacagcgcctccccgtgtggcagcagggcccagtattgtatgggccacactggtcactgcctcagtttcactctcccacttgcccaagagctcctcaaggtcagggacagtgtctgcttcatcatggtgagtcctgcagctgcagagagtagaggtgagagcagttaacctctgatgagtgcttactgtgtgctggatgctacgtcagatgcttagcatcccttagtgcacttaatttcacagcccccaggatgggtggatattatcatcctgttctacatataaggaaactgaagctcagagaaatggaatcagccagcttctaagtggcagaagcaggatttgaaccagatccctctgactcgaattccaaagtctgggctttcactgctatgccagaaagttcttgctgcatttattgcatgcttactaagtgccagacactgttctaagtgctttaggtacgtcatgtcatcagcttcttgaatcaggcctgctttctaggaactgtcttcaccttcattatacagttgaggaaaccgaggcatagagaagttaagtggtatgctcaaggccacacagctaggtagtgacaagattgagatttgaacctagtacccagtctctgaccccctgcctctggaccccagtctctgaactccgcccttagggtgaggaatcaaacaagactgaagggagccccttgcagccctggagggctgacagttcatggcaggggggcaagggctgagtggagttttggtggtgggtctgatctgttttctaatctcagcagccccagtgtgaccccctggctcctgtgtggctgagtcaccttggaggtgagtcacctcccagggaatctggatgtccttccagccgtcccccactaggtccttccagctccagacaaaggtaccttttggaagctaagcccaggtgatctccccggcgccagggctgccctaatcctctcagggtggccaggaaggacccaggggacaggctggcctgaggactgagaatgggcacagaaccttgggtgactggcaccaccttcatgtgtgcacctccctctacagtttatagtgtgcattggttcctgccctcttaggagtggggaaaggcacagttgccctctttgcattgtattccatttaaaactgtcatatatttgtatcacaaacatttttatcacacttactaagtgccaggcaatggggaaccacaacgactttaaacagggaagacccaggagctgagttactcagatgagtagcatcattttgaaatgtcctttctagtttccccattttacaggggtgcagactgaggcactgagaaagagtcattgtcacaagtttatgctgctagcaggctgggcagaacttacccctactcagtgtctgctttcatcaagggaaactaaagggggctgctgtttacggagctccgaggctccagggacattccacacatttcctatgtaactctcaaaaccctcctgggaaagtgtaattatgcccattttgcaggtggccagacggtggccagggagaagtgattgttgaggctaaaagggcagatgaatgtgggaacgcaggagtgtgtgactcttggagtccctatttcccattccaggaacccctccagcccgcacaggaggcaatgaggtggtctgggctgaagctacttcctcatgcccctcatcgccctccagacttgctgccgtgtgggacccaggatgataaggacgtaaatgccactcgctgagcccagctgtgtgcaaggccctgttcccagagctttgcaggtcaggacagttccaatcacaatcttacaaccaaggaaacagggagaactggcagcagaagtcaagcccagcagccagctctggagcctgtgctcttaacggttccatcaatgcacccactgcagatggggaaactgagttccaaggtgggactggcccagtggcacagaagtgaggggtgacatcggttgagcttggcaggacttatatcaatgacgcctgccttagagtccccactgcctccagggaggaaggaggaggcatctccttggggagtcaggggcaaaacacgtttattcccagtttgacttgaaagcaggccttggtggagacagaaatgtctcctgcctctcagaattcacagacgggcagggttggagcagggaggaggtggcattgattaaacatggaggtaggacctgggttggggctatggggtgggaagatagggagcactttgtccagtggagagcgaaagatgagttaattaattcattcacttgttcatttgttacactggcatctatgcctgtgctggcctaggagtggggcacatagctggttcgcctggagaaacaacacttcactatgggccccagggatctctggatgggccagaggaactgtaggggctgggggaagcttcctgcagctgcttacctttcacccttagaatctggagagggctttgtagacagcagggactgcacatgcaaaggcccagaggcagggagcacagggggtgatgaggaggggatggaaggaatgagtagctctgtgtgaagagaggactgggatgtgtgtacggaaggccttggatgccaagtgaagtggtctgggctgtgtcccagcaggttttggagggtgcaactgggaaaaggcagacggaacattctggggtggtggaaatgttctatattgtgataggagtgtgggctgcatgaccgtaaaaaatggtcaaaactcagcaaatgaacatttaagatttgtgcatgtcactgtatttaaagatataaagaaaagaatctgaatgccatgcagggtgaagtgtttagtggtagtatactgatgtctgcaactttcaaatgcataaaaaataaaagatggactaacagatggatgcaaatatgacaagaatgtaaatggtgggtatagttggtgggaacaacgtgacaaccatgtgtgtccgctgtacatttccttcacctttgctataggtatgaaaatttcatgaggaaatagttgggaaaaaccttgttgtatctcatacatagtaaacactcaataaacagcagctattgttattactttgggactattatttcagacccctaagaaatgagtgaggaatatttttcagataaaaaaaatgcacattcgtgcaccagtcccaagtttgaggagctggattcatattcgtctcctttagtcctaaaatcagccctgtgaggcaggtattatactcatttgccagatggaaagaatgtgaggctcagaggagggaagtggctggcccaaggtcatacggtgagttgggggttgagcagggtttgaacctgggtcatcctgatgctgagtccagcctgggcacctcctgtctacccagatcatctggaatggctagtgcctgccttagagttagaaactagatgcatctgggggtgattccagttccccaagcttgaggcctagctggggtctctgggaatgtgcccagcccaagggctgataaaacccagctcatgtgacaccatctggggctgagtgcaagtcttggaattagccacaaaccgcaaacctttatggttttggggctcaatgcccaatttgcagagcaaatctgaattccggtctcttgtaattacacagtgtttccctctctggggtctgggctcagcctcaggctgctatataagactgatctgtgaccagactcagccaaaagcagaggggctggggaacaggacttctcaagactcagcggcagggacctcctaggggtaaggaggcgcaccttgtctactcagtgtccggcaggggaggcacaggcctgggaaggtaataaggagagagagtcccagcctggagatccatcaggatggcccctctccaagttcaggggtcttgtctgtagcatgggcctagtcaggagagcctcttgggaatcagcaaaaaggcctgggttatgccaattacatgcatgcgcagagctgcactcatctttcccagggacgttgggtaccgagggcctttgctacctcctggagactcctcagctgtttgctgatgccagaaatcttccatcggtgcccatctttttaactgaaaggggtgattcctttttgaacacagctctctggaaagtgaggttaggatgaggtgaggaagccagaaaaaaattattgcatatagtagtcctttatattctagtgtaaatgaatgcctctaatattcttctgggagcagataggagtagggaaagaatttgggggcgctgtgaagtccaagagaaatggggacagaaaaaagaggagagtgtgcctaaacaaaggtggctgaaaccaacaatttcttggctcagatgagaggccatgccctgtgctgactctctgaggttggtggatgtgtagccggggctgatggagtgagagaagtggatgagggcacaaaaggagcaaaagaaagtttcccagaggctatgcagctcgttccaaaatgcatgtttcacctccccaatctcataacattcctcacccacttcttaggggtctgaaataacagtcccaaagtaataacaatagctgctctttattgagtgtctactatgtatgagatacaacttgtttgtgatttgggagcagaagttcaaaaaggtaaagtccctttcctaagcattaagacccagatatctctgacctagagccattaatattaaccacgtggtgtagaactgactcctccaaagagatgggaagagtgtttgctggtgagctggatgtgtggaagggtggctagatgaatgcattgatgagtagataaactgatggaaagatgaatggatggatggatggatagctgggtggatggatggttggttggatagatggatgggcaggaggatatatggcttgccagctgtttggatgacagatggatgatagatatatgggaagatggatggatggtgggatgggtggacagattaataaatagagggaggagaatgagttgatgagtggatggatggttggttggatggatggttggttggatggatagatatatggcttgctgggtgtttccatgacagatgggtaatagatagatggaaagatagtaggttgaatgtatgggtgaataggagaataaatacgaaggggagaatgagtagatgagtagatgggtgagtgatgtagaggaatgagtagatgagtagatgggtagatgctggagagagttccttagaacctgcgagctcccagtttggtgtttttgttggaatccctattacccatctccctgatgctcaatttgtcaattccatcttgggagataattagacatccattctctgaaacagtgtgtttaatgggtctgctttgtgtcaccagattcatttcaatttgaaaaactcaaaaggtagtatctggaattctggaccctgccttagtatgtgaccttggctggtttcccctctctctgggtcccagggtcctgagatgactcttggctggggctgcctagtgctacctgctggccagggtggtggcgcccagccacatctgcatctgcactttctcctccacagggaagcagtgccagcatgtggatggcctggtgtgtggctgcgctgtctgtggtggctgtgtgtggcaccagccacgagacaaacacggtcctcagggtgacgaaagatgtgttgagcaatggtgagtccagccccaaaggggtgagggttggcatggggtgagcagggcagctctgccaactctgaagtacccaggaacctcctcctgctagcagagttcacatcgggaggctgggtgaattctactctctgggccttagtttctcctttttcttttgactaccatttcctgagcacctactatgtgccaagcaccatactggtgactttatgctcattctttagaggcaatagagaacaatgattaagagccctggatcagccttcgtggggttcaaatcctgactgtgtgaccttaagttcatgacttgagttccctgagcctcagtttctttatctgtaaaatgggtgtaattatagtctctatctcagagaactgatatgagaatgaaatgaaatgaccttttgaaaacttagcacagctcctgggacttagaaggccctcaaaagtgggagctataattattcttgcctccaattcttaggaccttgcttttgtcatctagcatgtgaggacatactttctccctcaacacccatcccaggctatcatgagcataaaaaaatgagattatttcctatttaagtgatctctgagtacctcacaggcctcaatctttctatccatcagacgggtacacttctggccttgactatttcccaagaatcagttgcgataatacataagaaagtttattttattttattttattttatttgagacggagtttcgctcttgttgcccaggctggagtgcaatggtgcgatctcggcttactgcaacctcctcctccccgtttcaagcgattctcctgcctcagcctcctgagtagctgggattacaggtgcccaccaccacacctggctaatttttgtatttttagtagagacggggtttcaccatcttggccaggctggtctctaactcctgacctcataatccaccctcctcagcctctcaaagtgctgggattacaggcatgagccaccacgcccgtcctgaagtcaattttttaaagctgtaaagtgcagagcacttagaagggagggcgatgaagaaaatccatgaagggctggctgatgtccaaatctagttaaagtaagaccagacaaaacccagcagaaaatgagctggccaggatgccagggctagatcagcctggagaagtcatcccgttcagcctctgctcttcgctggtgggaaaagtgaggcccagggagctgagcaacactgcgaggtgctgcctgggggctggaggtggaaaaaagggaggaaccctggactgatgcccttgcctctctgcagccatttcaggcatgctgcagcaaagtgatgctctccactcggccctgagagaggtgcccttgggtaaagcccgtggtgatggtggtgggcctctcctgggcggtctgcttggtggaagtggaagtggaggtggtgggggaggtggtctcctggggggcctgcttggtggtgggggtggagggggtggcagtgatctgttgggtggaggcttactgggtggcagtggcagcagtggtggggagttgctgggtggaggaggtggcagtggtggggggttgctgggtggcagtggtggggggctgctgggtggcagtggtggggggttgctgggtggcagtagaggggggctgctgggtggcagtggtggtggtcttttgggtggtggccgacaccattacaatgactacagacgcattgaattcccccgaggtgttggtgatattccctacaatgacttccatgtccgaggaccccccccagtatataccaacggcaaaaaacttgatggtatttaccagtatggtcacattgagaccaacgacaacactgctcagctggggggcaaataccgatatggtgagatccttgagtccgagggaagcatcagggacctccgaaacagtggctatcgcagtgccgagaatgcatatggaggccacaggggcctcgggcgatacagggcagcacctgtgggcaggcttcaccggcgagagctgcagcctggagaaatcccacctggagttgccactggggcggtgggcccaggtggtttgctgggcactggaggcatgctggcagctgatggcatcctcgcaggccaaggtggcctgctcggcggaggtggtctccttggtgatggaggacttcttggaggagggggtgtcctgggcgtgctcggcgagggtggcatcctcagcactgtgcaaggcatcacggggtaaggaggggacgggttctccccagaaagcccccatacacctccaaatgggggtgatcactccctgaagctggggttgccggagggaaggtcttcagagccccacacacttcagggtttggcctcaggattggaagttttaagacccccaagttacatggtttgggtcttggcatgaaacagtcctaagtttgagacccagttcagcttttcatgtttgcgtgtgactttgggccattgatatcatctctcgagtctcagtttcctcatctgtagaatggtcatagtaatacagtgtagtggaaaagaccccaaggatttaaaaactatacatatatatcataagttctatgctcagcctgttcctcatagtcgatgtttaatttaacaaatatttaaagctcctgctatgtgcagagtactgtgttggcactggggacatgacccaatggtaagccaagaaaagacacattctctgtctccacggagcttgcaggttgatagggtacatgggcattgataagaagcctaaacataaccatgcagtttcaacagtggcaagaagttcatggagaagtaagaatctctataacggggcagctcacctacctagggaggtcaagggaggcttcctggaggaagaggaccttaagttgaaatctgaagaatgtataggagggaattaagcaggaggaacctatatgtataggagggaaccaggcaagaggggcagggatgagcagagagagggaatggcatcttgacatgcagaaaagattcaaaggaaatatacggaatgcacacagtgggcctctgggcattgggattacaggtcatggcatttttgccttaatttctctgttttccacattctgtccttgaactgcaggtgtctagtgtctttagagtcagaaggaacagacggggagcagagaaagggggtgtaggggagggcgctcgggtgagtgggtggtagttggggtggccggccttctcaccactctgtgtcccgagcaggctgcgtatcgtggagctgaccctccctcgggtgtccgtgcggctcctgcccggcgtgggtgtctacctgagcttgtacacccgtgtggccatcaacgggaagaggtgcgtgcccttggccctggaggggtccccaccaccctatggcccaacctctgtatccataacacagaggctaggaagacctaaacttctgccagtgcatgcccacagacttgcaccagaggccatctgtcagcggtgaaaacagcctagcacagtggttaagatctgggaggctgggctgggagtggtggctcatgcctgtcatcccagcactttgggaagccgaggcaggcagatcatctgaggtcaggagttcgagaccagcctggccaacatggtgaaaccccgtctctactaaaaatacaaaaatgggctgggcgtggtggcaggtgcctgtagtcccagctacttgggaggctgaggcaggagaatcgcttgaacccaggaggcggaggttgcagtgagctgagatcgtgccactgcactccagcctgggcaacaagagcaaaactccatctcaaaataaatacataaataaatctgggaggctggagtcaggtgacagcttgggttcaaatcctgattctctcataagctgtgtgaccttgggccagtcccccagtgtcactaaatcttagtgtcttcactggcaatgggataatgaggtcacccccttttccaggtgactgtggccgtaagtggggaaaggcaagcaaaatgcttcctggaatagggccttccatgcactaggtgctgactagaggacctcagagggtgggcttctgtgtggacttatccccgtgggatgaggtcgtgtccaccaagctaggcaattgggagtcaccttggaaaccagaatgtgtgctgagccctgttcccagcctttgaagctcatgggctgagggggagatagacttgttcacgtgtgacttgagggaccagggaagagttctgggttgggttccttagagatgagcaaggagcgtagcagatggcagggacagcaaggacaggcctgggtaagggtgagctcctggcggctgggggtgactcatggtctccctggccccttggcctcctccagtcttattggcttcctggacatcgcagtagaagtgaacatcacagccaaggtccggctgaccatggaccgcacgggttatcctcggctggtcattgagcgatgtgacaccctcctagggggcatcaaagtcaagctgctgcgagggtgagtgctagccggcagtggagtgccttgggggttgctggaatggtctgtctttggcaaacaacatgacgtcacccacctgcccataggctctggggtgggcaggacgatgatgctgtggggtggtgagtactcatgctgagccagctgtactctcacctctgtccctgacctggcacatgcctgatgggaattcatggcctgcaccttcaaacccaggatggggccttcgaccagcctggaaaatatgtcatttgcgacacacattctttccagctttgaaaaggttttgatctgaatggtcaggagcatgcctgagactcacatctcagttccatggttcattgctgtgtgattttgggtagctctcttgccctctctgagctccagtttcctcctctgtgaaatgggtaattctttttccttcaggaattgagataaggaatggaaaacacttagtgatcagctgggatatcttgagagctgatgaacgtacgtccaacaggggttgtgtgcgttggtgccccagatcacaggggcattccccacttggttctgcccagttcaaacctggtgaggggatgagagttttcctatgacgtgctccttacaaaatgtccaagtctccatcctctggcgaagtggtgtcaagtgttcatatactggccagcacgctgtccccaggtggtgctcttggatgagtacacactcagagcggagtctctttctgttcactccctgccctcttctttggcttctctcttggaggcctctgtccccacttcttcctctccattattatccatcttttggcccagtccccccagcccttgaaactcattgtgcaacttgaaccccaaactttctgattcccgtgggcttcttggagactttacttctgcttcagagacgatggaggcaaagaaaatcagctcccagggtccaggcaaggagaggagggtgaggaaaaccatggaaacctcacagatttttaaattcacattttcactaggaaatagatatttggtattgcatggttcacaaacataaaataacaaaaaggcacagagcacagggcctcctcctatcccacctccctctgcctccctcccaccaagctcaccagttattcatctctcaattctccttccagtttctttgtacacatgaaacaaatatgaacatagattctcatcttccaccctccttttatgcaaaggggcacatactataaatactgttttgcactttgctttttttcatttaccctattgggagaattttctgcatccaaacatcgagagcttccttgtttaactttttacagctacgtaatattccattgcctggatgagccatctcttatttcgctggtcctctattgttggatataatttgcctgatcttgtgtcctgacaagtaaggtcacaatgaataaccttttacatatgtcatttcacaggagggtcgatgaacctgttggataatttcccagaagagaaaaagagtttatgccctgaatgtacataaaggaaagtccaactatcccctcaacacacacacacacacacacacacacacacacacacaagcatgcatgcatacacacacatatatattctcaaggcccttatcatctgaggagaggtggaaccaggataagcccgtcaaggtgaatccacttaaaagggggaccgaaatgcatagttagctttgggagaaatgttctaattagggctttatttcaagaaattctttgctttgctgaattggcgcagctctgaacagtcagccacaacctcagaagcgggaacccaggcagggttcggtggcgagggacggagtgaagttctcaagaggtccggcggtcagagacattttggtgtaggatgatcatgtttccttcgtcttcttatcactgcaggcccctggaaacaaattcttagaccaaaaatctgtctgcccatctatacatcttgtttatcgtcgattttcctccttaactaacagcttgggagggttagttaagagctgggtacagttatgtgcacctgtagtcccagatactcaggaggctgaggcaggaggatttcttgagcccgggagttcaaggctgcagtgagcggagattttaccactacactccagcctgggcaacaaactgagactctgtctcaaaaaaaaaaaaaaaagaaaagaaaaagaaaaagagctgcatggcttacttctgtggacctcagcctccttgtctgtaaaatggatcacctctcccaattgtttgagcaccaactatccatcctttcttgtggatcacatgagcacattttattggccagtatttctccttccctcccttccacaaacatttactgagtacctactatgtactagatcttgagtcagatgcttagataaataaacacgttcgttttccctttggaaacacaacataaggctgcagcaaatgacccatttgagggtcagatcagcagatgggaatgacttttgcagttgaaaatcagcaacattacagcctgggcctgacccattataaagctccagacactttgtttattgaatgaatgaatgcatgaattcatgaaaagccaaacaatttgcctgggtggcctgtctagtcagtccaaggtgaaggtactctgtcctcccagctttcgaacagttttccagcactcagaggttctcactgttcagagcctggactagtgacccacagggtggacagccttggtgagccccacatggctgcgagccttgacctcatcctgctcctgtctccttaggcttctccccaatctcgtggacaatttagtgaaccgagtcctggccgacgtcctccctgacttggtaagaagctgtcccagtatgggagcaaggggcacaggcttcccccagactgaggggccatagtccagcctccatccctgggggcctgcaggtaacccagagggacagagagagccaaggcctggggcatgtatttggagggtctggggaggaccctgaggaacacgaaaggacagattagtgaagggctaaggagagggaccttgagaattgcacagttccgggtttgaatcccggcttgggcacttcctagctgggtgccaagttgcatcatctttctgaacctcgattttcccatctgtaagtgggaattagagacagccttccccacagggctgtggtgaggagagtgcctggcacagagcaagcagtcagtaaattttagctatcgttactcttgcgtccccgactcccttgctcctactccctgcagcgtcaacaaggctttgtgccatttctcccctgcagctctgccccatcgtggatgtggtgctgggtcttgtcaatgaccagctgggcctcgtggattgtaagtccaatacactttctccagcctggggaaggcactgaggaccgggccctttctgggaggagggctcaatgtggtgggggccacagacctgcccttaggcccttgaagtgaggagtggctaatgccacaagggaggtgccacctggctttccctcttgctcccaaacaccccccccgagtaccagagggaggagcttccaccagggtctgggagtcaggggtctgggaagtgatggctctgtcctgggagtcaggggtctgggaggtaatggctcgtcctgggagccaggaagctgggtttgagccccggttctgccctggcagctgtgtggacttggagagactcttcccagttttctcatctctcaaatctctcaattcacagaggggttggagagtgactagcaggagacacactgtggagactgaccacggcctcagaaccaggctctaccaccatctcggaccctgatttctgagtgaacattcctgaaagcaagcccgccctgtatggctgtgccatttgtgcactgcaccattccagggacctcctttcacatggattacagtgcaatggcagtgcctcgagttgtgcagtgcacagcctccacagccacacagggcagccgtctctgatagtgttcccatttctctgggactctaggcagtttgagaatggctttccaagacagggaaatctccttccctttgtggccagagatgaggaaggaagagcccaaaagctggggctgttcattacacagtcaaggaaatgacagattcaactaagcaccacattgtggaaccctaaattccttccctggtgcacagcacttcacagtttacaaagctcatcaacatccaggatattgcacccccctgcccccaccaacgtagtcccagaggttacagtaaacccattttacagaggaggcaactgaggttcaaagaagtgcaatgacttgcttgggttcacacagcaaggaagaggcagagctgggattcaaacccagaacttttgctcttttcatggtgtctggagctggagcctgggcctaccttgtccatccccagccccagtgtatgaggagggaaggcatctggatggtgaggggacctccctgtgaccctctcctttgcctgcagctctgattcctctggggatattgggaagtgtccagtacaccttctccagcctcccgcttgtgaccggggaattcctggagctggacctcaacgtgagtgcctggggttcagggcaaagggtggtggccctcctcccaaaggcaggagtatcagtgaggccctcccagggcttctgctgaatgcctgggaagtaacacttgacaggaccctctcgattagaagaaggccttctaagagctgtgttagaaaacataatcatggccagcattccaaatgcttactgtgtgccaggcacattctgtgtgctttgtgtcgattaactcagcctatcttcacagcaaccatatgagggaggcacttcttattgaggaaactgagccacagaaaggttaaatcacttgcccaaggtcacacagctaataaatgtggacctggggtctgaacccaggcaatcgagctactaggtgctaaaagagctgctgctgtgggattgggtgtactggaggaataaatgtggccagaggtatgctggtaagcatttaaccatcatctctccatgattaaaaaaaagtcctgatttgtagcattggccaatatccatggtatcaaaactcccatcatggacagcttcaagttaccaacatgacgtcagtggatgcagagttgggaagagatgtgtgaaatctgaccatgtgaggtggtatgagctggctcctccagcactggcctgcatctggcccctaattttgtatggggcacgcacacatatgtactttccctaggcttcatgaacacagatgactccacacttgctccagcagatacagagatgcaggagtgcatccgtgctcccgtgtatacaggcgcccctgcgcatgcatatatatttccagcacctgtgcatgcacacctaatatattcataaacatacatctgttgaagagatattcattggtcacccgctgtatgcctgagctgaggctgagtgaggctctgggctgagtgctggaagtacagtgatgaacaagacaaagtctctgccctgatggagattagaatgttttggaggggacaggccataaagaatcactcaaacaaatatgcaattctaagtcatgagcacggtgatcaaggatccgaggctatcagagcctaaagcagggggtgtatgatccacccagggaagtcaaggagggcttcctggaggaggtaacacttgagctgagagctgccagatgagtggaacttaacaaaagaagaatgtggggaagggaatatcctgtgggaaggctccatggtgggggtagtggtgttgtggggagactgcaaaggccctggtggctgtgtagcgggaaggtgagagacagagtggcttggaggctggagaggtctcctggagcagatcacctagcaccttgtagaccgtggagaggagtctggtctttagagggtagatatgcattgtacagatgcatacatatgctagttcatcactgcagggctgagtttggagaggatctgtcataccatggctgtaattgtaagtgaccatgaagcaggaactgcgaaaggttccactgcatcataaactggaggagagtggggaccatgcatcaaagagccactcagactcagtgggtttaaccaaaaatggctgcctggaggcagattcagggcctcactccagccttcagtccccttctttccatcttctccctccctgtgacccctttcttctcttctcccccagacgctggttggggaggctggaggaggactcatcgactacccattggggtggccagctgtgtctcccaagccgatgccagagctgcctcccatgggtgacaacaccaagtcccagctggccatgtctgccaacttcctgggctcagtgctgactctactgcagaagcagcatgctctagacctggatatcaccaatggcatggtgagtcacagccccaccagggggaggtggctgggcagcagacagctgccagtgacccttctcagtctccacagacttggggaatttgctgtgaagtgagaactgcagatggtccaccccttgactcacctccagctcatgggtgtgcgtcaattacgtcagtacttgccaaagtggtgcttgggaggatttcaggtggtccacagaccaaatctcacgatgagaaagttgctccctattcaattttatttaactttatttcaattgttttttaaaagcataacatatattcacatatatgaacctcaatataaatgtttagaatgttttcatttggtaaacactaatacataagtaacaaaatgacacataacaaaatatcacccttaggcatgctccagtcattttctttccaaactttttcttttgaaaactttcaaggcttcagaaaagttgcaaaatgctacaactgatggacatatatccttcacttagatccactagttaaaattttgccacagttgcttcatatctacctatgcgtccattcaccctcctacccacccactcctccacccatcaacccacctatccacccacccattcatccacccatacatccatctatttatttatccatccacccatccacccaccctcccattcatttgtatatccatctatttatccaccagtccttccatctatctatccagccatccagccatccatccacccacccacccatccaccaatcaaaccatccacccattcatccaccaattcatccatctatccatccatctgtttatctatccatccacctatccacccactcacccacccatccaccgtcaactcattcatccatccactcatcaacccacccatccttccatcaacccatccatctatccagccatccacctatccactcacccacccacccatccaccatcaacccatccatccatctactcatcaacccgaccatccatccatcaacccatccatctatccatccatccacctatccactcactcacccacccatttacccatcaacccactcatccatatccactaatccatccacctatccatctatccatttatctatccatccacccacccatccacccatctatccacccatttatgcattccttcacaattcatccatccatccatccatccatccatccaccaatccatccatccatttatatatccatccacccactcacccattatcaatctatctgtctgatctgtctgtctgtctctctgtctgtctccctgtctgtctatccatctatcttatctgtttttgagcaatttgagctttcgcagacatcatgacaattcattccataaacttcactgtatatctcctaagaacaagacattctgcacaaaaccatcatacaaatgatgccaacacttgcttccattaagagaaaagtctccacttggtgtccgtatatagttagccctctcttgcacttgtcgttgtccccttttaaactaagagagaacagagctcatgcccaaagctctccacagacaatgatatccatgcagaaggtaatggcattattttgtttttattgtatttggttttacagttgccatctctttgtgtcaagtggtactggctttccattttgagtatttgaggtcttaagaagcaagccaatttaaaaatgctaagtaaataatagtacaggtggttcaaggatatgacagaggtcatgaatttagtggacactgagttatgcaaatggacttgatgctggtctccttgttttaataaggaatgacatttgtttcttttctttttctttctttcttttttttttttttgagacagaatcttgctctgtcacccaggctgtagtgcagtgttgtgatgttggctcactgcaacctccatctcctgggttcaagcaattctcctgcctcagcctcccaagtagctgggattacaggcatgtgccatcatgcccggctaatttttgtatttttagtagaggcgggattttcaccatgttggccaggctggtctcaaactcctgatctgaagtgatccacctgcctcggcctcccaaagtgctgggattacaggcatgagccaccgttctcgcccaagaataacatttttagaggagaaatattcaggttttgcctgctgttctttgaaacactccttggtcagcttaagtcagcccaggtcacttaaccacaaactggctacggtgatctgcgtatggtgatgatggctgggtaggcaggacttccccaggggtctttcagggagagaagacgaagacgccctgctgggtgttgtaaagcatgtaggagtttaatcactgtattagcaactcctgtctgtaccgatagcctccaggattcacgtggcccttcttcttgtcctatagtttgaagagcttcctccacttaccacagccacactgggagccctgatccccaaggtatgtaaggtgggcaggtcccattgccttcagcctcattctctatcttgtttgagaaactggattggaagggaagatgctcagcgctggggtggggtgctctcccccgaacccctgcttgggagtgcagtgacagtgacaagggcttgcaggctagacccccatgggtgggggcgggggaagacacagagggttgaggtggaaagaccctgaattctataggtggtccagcctgcataggcctaatcctagcctggccacttcccttgctgtgtgactttggagaagagtcttaacatctctgagccttagcttcctcatctgtcaaaaaaggctgctgatacctattccataggttatcataggaaggtaaatgagatgatgcatgtaaaggtgtcaacgcgggccaggcacactcgggtgcacagctgcttagagggaaaagccaggcctttggaacagacagacatgagtcagcacatcccagtcatatgaccttagatgcacaattcctctctctgagcctcagttttctcatctggaaaacggggtaaccatgctcacttcagagggtggctgtggacctggagtctgcaccaaggcaaggagcaggcatttgatcaacatgaactattattgctgttgttaataattacacattacttctttttttaaaaaaaagcaagtgtgcttttgtccaattagtgaccatatagagttggaacaaaggcctttcccaccccagttctggtcccatgtctggttctgggcctattaccttgcacctggaagcaaagggctctgtacctagtaagtgttatgcaggtgtgaatgatggctgcaatctatagccattttagacatttttcacctcttttctgcctgccctgtttagtcctgggtggaattcaaaggctctagggggagaacaaactcaacacgtggtcactattgccctcatgtggctgcaaattgaacatcggaaggatcattctctagggtggtaacagtggcagctccagccagcaggtggacccctcaatcaactggaccttttatttactgggtcacttcctatgtgcactgcactttacagcttatgaaattgttttttagagtatactttttctttctttttttgagacagagtcttgctgcgttgcctaggctggagtgcagtggcacaatctcagctcactgcaaactctgcctccctggttcaagcaattcccctgactcagcctcctgagtagctgggactacaggcatgcaccaccatgcctggctaattttatattttgagtagagacagtatttcgccatgttgaccaggctggtctcgaactcctgacctcaagtgatctgcccacctcggcctcccaaagtgctgggagtacaggcatgagccacagtgcccagtcagaatatactttttcaattggttctgatcattccctctatccacaggaccaaagaggagaagcacaccatttacagatggggaaacagaggctcagagaggtcacatgatgaggcagtagcagagctggggtagaatagggactgagtcctcagtggcgctgggactgcagcaggggggattcaggctggacccagcaatgtgtcctggagacctgggctgcacggagtcaccaggggaggggacttctttctgtttcttttgaaagtaatattgtggttttgcccatttctctatggtcagttaacatatttaagaagtatattccttaaagtatgtatttttggtaagtcaatcatttgataaatatggcaaactgccattttatgaattgtccctttagtaaattagctttcagggaatcaaactgcagcaaacaagctcaagtccctccagcaatccgggctcgggggcagcctgtgccttgcctgggacctccctgtgggattccccaggcgtggacttctcatttcaggaacagtgttcagaggcattgggaggctctgggctctgagcccacagacatgcactggaatcttaactttcctcctggccttggacaatttccttggcattcccctctgaggccctgttttctcatctgtaatgtggagaaaaaaaaataccccatgggttgttgtaatgactgaatgaaattaagactgtccattcagcacctggccagcatctctgggagaccccatttcactcagtaccaagttttaagcatttccaggtgtcaggcattgagcctgaattttgccggcatgatcacagttatttctcatagtaaccccatgtgcaaggcttggagagggcagctccttgcccagttctcacagtgggtcattggctttgcctgtggtttgttggactcaagcaacatgagaccccggtgctctgtgtttagaggttggctgataaccccctgggtacctcctatgctaagggccctgtccatctggcctggtgcctgcccacaggtgttccagcagtaccccgagtcctgcccacttatcatcaggatccaggtgctgaacccaccatctgtgatgctgcagaaggacaaagcgctggtgaaggtgttggccactgccgaggtcatggtctcccagcccaaagacctggagactaccatctgcctcattgacgtggtgagtgtctggaggtactggtggcctccagctgggcctcaagacagagccacatggtctcctggagcccaaagaccccttcaaatcccctcaatctccaccatcatgactatgggcccaactttggggccagaggctctaacccaaatctagcctttaccacttccagctacatgactttggacaagtcactccctatctctagactagaatcttaactctcttgctggccttgcacaatttgcttggcatttccttctgagccccagttttctcatctgtaacatggagaaaaaataccacatggggttgtcgtgatgactgaatgaaattaagactgattttctcctctgccacagggggatggcagtagggcattagtaagatgctcagagcagtgcctgacataccctaaaggctgccaaagtgttagctgatattattctcacaggttgcctatacccagtgtgtggccaagccagtcttgatcattcattcagcaatatttattgagcacctactatgtgttatgctttctacttgacactggggaaaggggaaacgagacagatggtgcctgctctcttgtacctggtacctagcaggggacagatacaaatacaacaattttcacaattatttcatagaaaggaatcctcttaaaatgtgaaccatggccaggcatggtggctcacacttgagaacccagctctttgagaggctgaggtgggtggatcacttgaggccaggatttcgagaccagccttgtcaacatggtgaaactctgcctctactaaaaatacaaaaatcagctggatgtggtggcacacacctgtagtcccagctactcgggaggctgaggcacgagaatcgcttgaacctgggaggcggaggctgcagtgagccgagatcgcaccactgcactccagcccgggtgacagagcaagactccatctcaaaaaaaaaaaaaaaaaaatgaaccatgtttctcctctgcattccttcaattctgaaataaaagcccatctcctgacaatggcccacaaagtcctcatgaccatcccctcatcacctctgagctcctcagtgttcctccaacatgtcaggcactgtctgacctcagggcctttgcagatgctgttccctctgcctgggatgctcttcccccaggtatctgcacagttactcccttacttcctttttttttttttttctttgagatggagtctcactctgtggtgagaccctaggctacggtctagcttagggcccagcacacagtagatgctcagtaaacattggtcacaggaatgtgttaagctgtgttaaatgccatttctccctccatgattaaggcttcaggctttggaactcagacacttgggactctggtcccatctgctgtcttcctgctagtccctcctactcccaaagcttgagaccaaataagccacttctagttgggaattaggtgctctaggctggagcatgccaagccacagagtgtgggggttcttgtgtgggccttataagatggtcgattaaagggtcgattctagcccacgagtgggaatggctgtcccaatctgtcctccatcaatcagcctctactgtgtggagattttccatcagcagctcagaggtttgtgtgagccagcccagcaccctgcagtgactcctgctgtcccagggatgcagccctgactcctccccagcgcacagctctgcctggcttggtcccttttcactgcagcctcacgaacccttttacctccttgctctctggcctcctctctacctctctaatgccaacctcttccctgcctcctggcctttgcccatgccctccccactgcctggattactctcccaccctcttttcatctggccaagtcctacatacccttcagtcctcagtccaaacaccatttcccacaccagcttacacccctggcacgtgcacccagagcccccagttcttcatcaggccagtcatcgtggtcattgttatctactaacatcacctgaatttctcaggagcttactgttttttcataaagccaacttttaaattcaatttattttgggtgggaggcagggaaggaaaaagggattttcctacaaaaaggcctctacttggagagagagagagagatgagcctgggccttttatatcctctcctggggatgggacagttatgattggcagcggtgatgcccaatctcgtcatctaaagtgagtttcataggctacgagccactccccacccactccgaggcattgcagagacacctggtaaacaccctctataaatcatggggatcctgtgactgttgccttactgagaagtgttcactcagcccttactgtgactcacttgcaaacgatagttaatgttggcaacttattattccgaactccttccctccagaggtggtgcaaatccagtacatggtgagtgttaaccaggagtctcatgcttataaaaggaggtctgacccaggcctcggggaacaacctgccatcatgctcagggttaacgaagccctagctagcactgggcacacaatgagcctttggcaagcactggccaagacatgaaggcagtgacgtctttctcctttcctttccctccaggacacagaattcttggcctcattttccacagaaggagataagctcatgattgatgccaagctggagaagtaaggggctatgctgccttggggtcctgacggtgctggtgctgctcatggaggagccaccagggagcgggtagaggtctcctgtgtggccatcagggctgggtaaacccaaggggctgcaaaggtgacgatggctcatgcctaccattaccactgtcacaagccaggcaaggtgggtgaagccgtgaacttagaaagaaactactgccaaaatcaacagtcagtaataatgatgctggggtgtgggcacagtagcccatgcctgtagtctcagtgctttgggaggccgaggctggaggactgattgaggccaggagtttgagaccagactgagaaacatagcaagacaccatctctacaaaaatagaaaaattagctgggcataggtacacacgtgtagtcctagaaaaaattagccgggcttggtatccatgtgcctgtaatcccagctactcaggaggctgaggcaggagcccaggagcttgaggttgtggtgagctatgattgtgccactgcactccagcctgggcaacagagcaagaccctgtctctaagtaacagtgatgatgatgaggaggaggacgaggaggaggaggaggatgctggtgatgatgacataccaggctctgctctatgtacttgaagtgtacgtattatcttgtttctcccctctgatggtcccagtggaagtcagggctattattctccctttgtagggagaaaactagggctggaaacagtggatttacttacccagggccacccagcaagtacatagaggggctgtgagccaacccaggttcatgtgacctgctgcattggatgggtacaatcatgcgctttggagccaagcaatatgggttcaaatcctgatgtgaccactgactgactgtgtgatattggccaaccaacttcactctgagcctcagttttctcatctgaaaatggggataatagtcactacctcgtaagattcataaaaagaataattattattcattggatgctttccgtgtgccaggtatttggctaagtcctaggtgtgtcttcatttaattctttctttttcttttcttttgagccaggagctcgctctgttgcccaggctagagtacagtcacggctcactgcagccttgacctccccagctcaagcgatcctcctacctcagcctcccaagtagctgagattacaggcatgcaccaccacgccagactaatttttatatttctagtagagacggggtttcgccatgttggccagcctggtcttgaactcctgggctcaagtgatctgcctgcctcggcctcccaaagttctgggattatgggcatgagccactgcacccggccttcctttaattcttgatataagcctatggaaataagtactatcattatttccatttcaagattaaatgaggtcatatgtaaaatttttagcatgtgactagatcattgtaagcttttcttttacaaccaatatttcttaagcccaccaatggcagttactcgtgattaatatagtgcacatcagagacatccaggagttcccaaggaggcaagattcagcctgcagcctggataaggagtaggggccagctgggcaagagctgggtatttcctgcagggagagcagcatgggcaagcttcgcagagaggaaaagggcacggatactgtggggtgcggtgcctgagagggagagaggctgggtaaggaagtcaggaaggaagaaaacatgtcccaagcggagagtcttgtttccttagaaggtacctttatttccctcctgctggacaccgagctgatgcttctgaacagccccgaacgatttccgccccacgggcaagcccggtctggcctctctcgggtaggactgtcagctgtattgagattcaggtgcagcaagacggaggcccttatagagcagagcgagacctcaaaccccggcctcagcctcccatctcagaacagcacaacagtgagagtgcaggttcagggtgcgaggcctaggctatccctccctggctctgtggctgcagtaaattaccctggagcctgctccactggagggctggaaggattacacgaggtgatggtgatcactcatgcacctatggcagggctctggagcagcgctttatgggaatatcccctttagtcctagcagccacccactttgcagatgaagaaactgaggcatagaaaggtaaagtaccttgactaaggtcacaaagctagtaggtggcaaagctatgatttgagccttctccgtgtggtgcatgaagcccttagcatggtgtccgacgtgtagttagcgctcagcatgtgagagccagcattgttcttattaaatccctgcaggtggagagtgatcgtgaggatagtggaggggcttctcacaatttgttgcaatgcaagagccttatgattttcaggcaatccctgcttctcacaggctgttttcttcgtctacaggaccagcctcaacctcagaacctcaaacgtgggcaactttgatgtaagtaccatgtttagttcccagggcaagatcttctgggaaggagcccaggacgtgtcttccgggaatggtgttcctgtgaggctggctgggcatggggagtttgtgaattccaaagtgctcccgtcaacactatcagccctcattttgcagatggacagatgtagaaactgaggcccacaaggcaagtgaggggcagaggacagactcacagctccttctactctgcctcgggtgctgtcccatgttaactggctgccccatggggggccacttggcccaaatcgctccatttcagggtggggaggcacagtgggcagccttgtcctacaggaccactttccttctggagttaggagcccactgactcctgtgtgaccttgagcgatatcaacccactctgagcctcagtttccccatctgtaaaatgaatacaatttgagttcatttctaacctcccttcttgcccctgggttgtggaattctgcttttccaagggtccagaaatctgagatgctcacattctagcgttgggtcctgttttatctctttgttcactcttgggtgccccacccccacctaaggcttcagaaacactccttcctccccacccccccacctccgctttttataaattgacaactaagcatctgctagctttctgggacaagcttggatgagatctccacatgtgcagaaaaagtcaaacccattcattgtgttgctaattttatagcttttctaacccaaaaagctacagcctgtgaagccgatcttgccagcttcattttataaggataaactgcccaaggcttcccagctggttggggcagagttgggattagaactgaaatctctggactccaagtgaagaaaggggctgacagtgtaaaattaatgaattaatgaagctatcgagatgggccctaggcactgaattatgcttttttttctcttttaatgaggttttctcatttaatccttaccaccgtgttatgatttgggtattattattacacccattcttccaaataaggaaggtaagctcaagtgacttgcccaaggcaacagagctaggaagaggcactgccggaaagtgagtccatgccctcaccctctgcagactggaacatcaggcatgttacatataggggcttatgtctgatttttataaccaccctatgaggcaagggttactcactcctgttttcagatgtggaaaccaaggcttagagaagttaagggaggtaacatatgaaaaggctcaaggccaggagttttacgtgatctacccaccatcctcaccgcatccttgcaaactcagctcactgacccattttacagctgaggaagctgagggttagagaggtgaaggagcctgcccagaggcccacggagactgagctgggatgggaacctggggtgttggctccagggccattgggacttctgtgatgccatgacagtgccatcggggccaggccaccctgaaacctgtgctctgtgcctcccaggggaggaactaggcctccctcaatccctgcttcataggggccttgggccaccacccatgctgggcctcagtctgcccatctgcacaatgtgcaagttgatggggggcaccttaaggctgccggtgagaaattctggggtctcaggggttctgactgccagaacctagactctcccagagcaggtctgtgtctccaccttgagccaggggagcagacccaaggggccctctggagctgagcaaaccccctgcccaggctctgtcctccttcttcctctgcagattggcctcatggaggtgctggtggagaagatttttgacctggcattcatgcccgcaatgaacggtgagagcgggtgcctgtgcctctctgggagcttgtggcttgggtactgggggatactggcttgttgggcatgctggatgtgcatctatcctacctcaatagtatttctgagcacttcctttgaagcgtgtcgatgaaagcctccaaatccaaacgtggcccccaaagttccagcaccttccttatttgcttctttcttgtttggctgattgttttatttttctgattatctatgaaaattccgattatgtattaacattgtgtgtgtgcaagttttagaaaatataaaacaatttaaaaaaaactcacctcgcagaggcaatgaatctcaacatctgagcatatttccttctaaactctttttctccattgttttcccatatgattgagatctttcctgactcatatttaaacatgtatttatttttaatgatacaggaactacaggaatacattcttattgtgaaaagttccattggcgcagatacagctaaagttgctcttatcgacatccccagcctccttcctagcccagaatctgcccccctagggaaccacatcaagttaggaggttttcttgcccaactttataaacagagtagactgagcttgctttgctctctggggcgtctcaggaatgttactgggaaggctgcttgttgaactatgggggtcattggctactcacatactgggactgggaaactgcccaagccctggggtcactgggccccagactctctcccactcctgcttcctggatgagaagacaaggagggctggcacatcccagccaatgtcatcagctacaccagcgggggttctgttggagccatcttgatgtcaaacaaacccttgttctgggccctgtggtcagaggaagccgagtctcactggtggggaaagtggtggtttctctgtgagaggatggggtcaggggctgggctgggctgacctgggagggaagagacggagcgtcttgcctggcttaatcactaagagtggtgtgaacttgggggcgagtcttttaatcatactgaagtgcaattcaccattttcaaaatgagagcttggacaaggtccatagtccccaaagtgagctccgtaaagcagtcccacaaaataccctgcaaaaagcgttccatggccgagcaagtttgggaagtgctgaagatactcctgcagggtagattcacaatgtccttagctttttgaaaagtcctgctggaatagagaagtctgttaaatttcacttaatttacttcccccatccactctttcctaccccacttctttttctctcttcctgctctctttctagaacagtaattagcaggtttacttaggctctgacaatctgaaaacaaacagcacatcccacggcagagtcaatggctagggctccacgtgcactttccattacttcactcggcaaacatttgccatctcctctatgactgggcgaagggctgggtgatgctggggacacagctcttttctttcttttttttttttttgagatggagtctcactctgtggcccaggctagagtacagtggcacgatctcggctcactgcaacctctgcctcccaggttcaagagactcccctgcctcagcctcccgagtacctgggattacagctgtgcaccaccacacccagctaatttttgtatttttagtagagatgggtttttgccatgttggccaggctggtctcaaactcctgacctcaagtgatccacccaccttggcctcccaaggggacatagttcttgccttcagggaactcacaatgtggtgggcgtgacagatacagaaacagataattaatattttatggtttctctaatagagcagttcggaggtgggatgggggtgctgcaggagccttgagtcgtttggggtccagaaaaccttgcagaggaggtaacatctgaacagtctcagagagggctcagaactcaccagggatgctagggtgagagaatgtgcaccaggcaggaggaactgcaaggacaaaggcctagaggcataaaagaaattgccagggccgggcacagtagctcaagcctgtaatcccaacactttgggaggccaaggcgggtggagcacgaggtcaggagttcaagaccagcctgaccaatatggtgaaaccccatctctactaaaaacacaaaaattagctgggcgtggtggcgcacgcctgtagtcccagttactcaggaggctgaggcaagaaaatcatttgaacccaggaggtggatgttgcagtgagctgagatcgtgcctctgcgctccagctggggcaacagagcaagactcagttaaaaaaaaaaatgaaagaaagaaggaaggaaggaaggaaagaaaagaaaagaaaagaagagaaaagagaaaagggaaaagaaaagaaaaagaaaaagaaattgccaggtgtgggcaccatggctcacacctgtaatctcagtactttgggaggccgaggtgggggcagatcatctgaggtcaggagttcaaaatcagcctggccaacatagtgaaaccctgtctttactaaaacaaacaaaacaaacaaacaaaaaacaaaacaaacaaacaaacaaaaaaagcaaaaattaggcatgttggcatgtgcctataatcccagctacttgggaggctgaggcaggagaatcacttgaacctgggaggtggaggttgcaatgagccgagattgtgccactgcactccagcctgggcaacagagcgagactctgtctcaaaaaaagaaaaaagaaattgccaatcttcttacaaatactggcggcttctggtgagaccaacacctcttggaccactgaccatgtctgactgttttttattttacagctgtgctgggttctggcgtccctctccccaaaatcctcaacatcgactttagcaatgcagacattgacgtgttggaggtaagaggagatcgagctccattctgcttttcctccctgccctttgctcatcacctttgaccactgcattcaggccaggaacttggaagaggaagagaagaggagggaaggggaggaaacagggtcctcttccttccaagcatggggctgagggaacaaggagcagagctgttaaggatccttgaagacactctcccattcagtctcatttagccctcaccacaggtgtcattgttgccatcttacagatgtgagaactgaggctcacagcagtaaggggcttgcccaaaatggaatgtggtatagttcattggagcaacttttattgagcacctactgtgtgccaggcactatgcaggggcctggggatccagcagtgaacaaggacaaccctggcccttgcaaagctctcttagcccaatggggagatggccttttggtaaatattcccgaagtaattggctaattataatcatggcaggtgctttgaagttcacatgcaggggttcttgtttccactataaaaaccacccgtgctcaatatctgaaatttggaaaatatggaaaagattaaaaaaaagtatgcatccatatatatatgtctatatatatatatagacatatatacaatccagcaattccccctgagaacattttgctgcttttcattccagtctttctgaagttttatttttaaacatggctttgctcagggaatcagtagagcattggggttaaagaacgagggcttggagcccagtgaccccagttcaaatcctaactctgccagtttccagctgggtaacctctccaagcctccatttatttcctctataaaaaggggctaatcatactacctacccatagggctgcttttaggagaaaatgggattctgtgtgtaacgtgccttgcacaggcctggcacataataagcacttctggaagtgtccaccattataaataccatcactgtaataaaggatgctgcagtgaacatctcaatgcataaactgtttcttgattctagatttagttccttggaacaaattcccagaaatggaatgaatggggcctttgtgccagattgacaatttccttgccgaaggaaattgccccctcacatttgcccctcacattcatgacaggctcagacccagggaacagcccccttcccacattagggagtcagtcaagggaggtggacaatgaccttggatgggcagtgtgggcaggggtcagatgctggctctgggacagtcccctgccttggcccagtctcttgagatcctgtaggacctcggcactgctttgagcctcagttttctcatctgaaaatggggaacgataatggccacctcatacagtttgtggtgagaaattaaacgagatacagcattttattataaaatgttattattcacttcaacaaaggggttaggaaacacgaacaggattggcacaggtttatcttcatcatcatcatcatcatcatctctactatttactgagatgttcagtgccccatacatagtctttcatggacttggccttaccacatgacctttcatggacttggccatcaacagccctggttgatgtttgccctcacttagtagatgaaggacttgagtatcagagagggtaggccacttgctcgaggtcacccagctggtgagaattagagtttccaccaaaacagtgtgaagcagctcaaaccaatggctctcagtggggctgtactacaccctccctggcccccagggcctttttgaaattggtggagatgaatttttctttcctgaatgtgtgcatattttcatatcaaaatacatattattttattataaatgacttaccttttctttctccttcatattctggtaagggaattatactggtttttgaaatataggtatacacaggttatagaatctgtgaaccttattccagaataataagggagataacacaaatgcctgtaatcaaatgtgtaatgggtattgggtttgaaaggtttaaagaaaacctcagtcccaggcttgaccctgtaggccccctgtaaatggcagctgctattattattattatataggtctagccatttattttaactttttattttgaaataattttaggcacacagaaaagttgcaaacatagtacagacagttccagaatacccttctcccagctccccctaatgttagcatcttacataaacagagtaccatgatcaaaacccagaaattaacattggtacaaaaccgtgaagaatctgcagacgtattcaccagtttcccctctattgcctttggtctggttcagggtccagtcaaggatcccctcttgcattcagttgtcatgtctctttagagtcctccaaggtgggacaattcctcaccttttccttgtgtttcataaccttgacatttctgatgagtctggcctattttgtgcgatatgccctggatttgatggacacttttttcacaattggattgaagttttgtggttttggcaagaacaccacagaagtgacgcagtccccagtgcatcctttcaggggataccgatgtccatgtgacttattcctggaggtgttcactttgagtgcttgcttaagtgcttcttcactgtaaaattactatttttcccttagtagctaatcaatctcttgtgaggaggtaccaggagaccatgcaaatatcctgtttctcgttagactttctcccactaatttttgccattcagtgttcacggttttgtctgcaactgttatgactgtggtgtgtgcctaatggtgatattctgcttctccaattcctttgacatgtgtcagctggaattctaccgaggaagagctgtcccttctcttccatttatttatttatccatttaattatttatttctgtcgatagagactcacgaatttttttttttttttggtctatgggttatcatctcttacttttattatttattttgttgaagtttttttttttttttttttgagagggagttttgctcttgtcacccaagctggagtgcaatggcgcgatctcggctcactgtaacctccacctcccgggtttaagtgattcttgtgcctcagcctcccaagtagctggaattacaggcacgtgccaccatgcccagataatttttgtatttttagtagagatatggtttcaccatgttgcccaggctggtctcgaactcctgacctcaggtgatccacctgcctcagcctcccaaagtgttgggattacaggcgtaagccaccacgcctggccaaaaaattttttttaattatgaaaactggattttggaagactgtgaagagggactcaggcctacttctcttattttggggaataaggggatgggaagtgtcttgcccaaggtcctctgcacagggccagataatgacctggccaggtgctcctcgggcctgcatgacccctttatctccgctgttcagagttactgcttcctagaaacatgaccggccagatccgtaggcaggtgagtagcaaggctctagccagagccaccccacccatcaccggctactctgttctgccatccaaggaccttttggtgctgagcgcatgagtgacagaggcagagatgctgctgcaactggaagaagctggaaccagtcccagagaggctcggcctggaaacagtcccctgcccagagtcccctcagcctccatgacaggtccctccctggccccccaaccctcttcctcccttgccccaaccctgagaaagggtccagccactaccctgttggcaaacattcccttccatggtcagcctgccaggaggaggggagtcaccttggggctggaggcctctcagaccccatcctgacagcaggttgagtattcccactttcaataaaagactccactttcccggcacttgtgacgagtttccatgaaggaccctccctcagggtctggatggtttgggtttttttccctctttggctgcgcccgggcacttggcagttgtagctacaactgcgggaatgatggtccctctggggacagcgggggaagcaacctgtctcttcatattaaaacaaccacacagcattctatggagagggtcccctgccaccaggacattttcgtacttcactactctcaactctggcatcaggaggtcattaaagtgcaggagttttggagtagggaggatgaggttcaaatcccaactctgtcacttggttgtgtgacttgatgaggtccttagcctttctgaatctcaattttcccatctgtaaaatggataatagtaataattattatactccaaaatgagtgtgaggatattaaataagatcaggtatttctgaggcacttaacactgaggctgacatgcagtaggtgctcaatatgtgctcactgtggttagtaacaaagtccactaattcctaaagtgtgagcttgtggaaccccttgcctctagtcagaggtaaactgaggacaaggaggggtccttggcatgtctcttggccgagacagtgcccaggggacccctcctagggacagtgccacatctccctgtagagccatagggcacattcagagcagtttaggagagttatttgatcccagccttgaaggcgtgcagaaatactgaagtcccttttacataattaaggatttttttttcctcctagtgatttttaaaaagacttttttttatgtctctgttgttttcttttacttaaatatcaggaatctaagctactgggttgtcgggttcaatagtagatttctggcttcaccatccatccattcttgcattcactgactgtctagcaatgatttagggactgggatttctacacttgacaagggatacagggcttcctcatgaaggttaggttctagtccatgagacagactttaagtaattacggcctaagtaaacaataacgagtaaatcaataaacagaggtcatttgagattgtcatgggggctataaagggaataaacagggactcctcttggggagggaaggggaaaggaggtggcaccattgggtggtcagggaaggcgtctctgaggaggaaacacatcatcagagacccctctgggggccttcacagcccaccacccttccctccgcagcttcctgggtctaggtgcctcctggtctccttggtaacggccaaaccctaaccccttggaggaggaaggggctcagaaagaagcagggtgggacttcctgtccagcctgcccagggaagggctaaaggggaggaagtccttacttagagggtggtgcttggggaggaggctgctcctttcctgtcatggctgccctctctttccttccactgtgttagaaccacctgctataaatcctcatgaattcatccatttgtttccatccctgcaccaccctggttccactcccatcatctctcccctgggccactgctccagcctccccagtgctcccccaccttccactcctgctctgactgatggagggcaggtgagccccagaattggggcttatcccaggcgggttcttggcttctcccaggaaagaattcaagggcgagctggtggtgtcagacagcaacttttactgaagcagcaatgcatggcagcagagggactgctccttgcagagcaaggctaccccacaggcagtgtgtgcagaggagcagcggataggcttttggcagctgtatgtcaacccacttttaattacatgctagttaagaggtgagttatttggaactttctgggaaaagagctggaagtttctggaaccatttaagtaacttctgagttgttgccatggcccattgccatggcatttgtaaactgtcgtggcccagtgggagtgtccttatgcagtgagggcaactagagtcgccttcgtggccatctgctggttttccctggcttcctcactgcaccctcttttgaacaaatcctgctctgattaggagggtaatgatcaaagttatgaccagtgctcggaaaacaagtcctggtgatctcctacctctgtaccatctattctccagtcagctgtaacaggtctggatttttaaaactgcagatccaatcacttccctccccaggttttccttccgtgagcttttcatgggtgcagagcaaaatccagaccctcaccactgcccacaaggtcctgcagggtcttctcccatccccattccccagcccacctctccctagtcctctgctgaagaagggaaagtgaagccctccacggggccctcccaccctttcctcaggaggcttcacaccaacttatgtcggacatcttaaaacatacccacatcctttaacaagtttgatttattctgctattcagtttttgagaggatttttgaaacttaaaaaaaagttttggcattataaataactcatttcagccaggcatggtggctcatgcctgtaatcccagcactttgggagaccaagccaggcggatcacctgaggtcaggagttcaagaccagcctgcccaacatggtgaaaccccgtctctattaaaaatacaaaaattagggcaacccacttgggaccccttccacaccatggaagctttgttcttttgctctttgcaataaatcttgctactgctcgctctttgggtccacactgcctttatgagctgtaacactcaccgccaaggtctgcagcttcacttttgaagccagtgagaccacgaacccactgggaggaacgaagaactccagatgcgccgccttaagagctgtaacactcaccgtgaaggtctgcagcttcactcctgcagccagcgagacgagaccatgaacccaccagaaggaagaaactccgaacacatccgaccatcagaaagaacaaactctggacacgccgcctttaagaagtgtaacactcactgtgagggtccgcggcttcattcttgaagtcagtgagaccaagaacccaccaattccagacacaagatcacgacattgcactctagcctgggtgacagagtgagactccatctcaaaaaaaaaagaacaaggctaatctttcctgaacattaaaactttgcacccggtgctctccctctccctctccctccccctccccctccccctctccccacggtctccctctccctctctttccagggtctccctctgatgccgagccgaagctggactgtactgctgccatctcggctcactgcagcctccctgcctgattctcctgcctcagcccgcccagtgcctgctgttgcaggcgcgcgccgccacgcctgactggttttcgtacttttttggtgcagacggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcggcttgctacaacctccacctcccagccgcctgccttggcctcccaaagtgccgagattgcagcctctgcccagccgccaccccatctgggaagtgaggagcgtctctgcctggccgcccatcgtctgggacgtgaggagcccctctgcctggctgcccagtctggaaagtgaggagcgtctctgcccggccgccatcccatctgggaagtgaagagcacctcttcccggccgccatcacatctaggaagtgaggagcgtctctgcccggcgcccatcgtctgagatgtggggagcgcctctgccccgccgccccgtctgggatgtgaggagcgcctctgcccggccgagaccccgtctgggaggtgaggagcgtctctgcccggccgccccgtctgagaagtgaggagaccctccgcgcggcagccaccccgtctgggaagtgaggagcgtctccgcccggcagccaccctgtccgggagggagatgggggtcagcccccgccaggccagctgccccgtccgggagggaggtgggggggtcagccccctgcccggccagccgccccgtccgggaggtgaggggcgcctctgcccagccgcccctactgggaggtgaggagcccctctgcccggccaccaccccgtctgggaggtgtacccaacagctcattgagaacgggccaggatgacaatggcggttttgtggaatagagagggggggaaaggtgggaaaaagattgagaaatcggatggttgccgtgtctgtgtagaaagaagtagacatgggagacttttcatttagttctgtactaggaaaaattcttctgccttgggaaactgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaacaaaacaaaacaaaaaaaaactttgcacccatatcagtttctcttcatgacctaaaggaaaagatctgaaatcaattcaaattattaagtgaattgaatttctttggaaacaaacaccacttagaaaatcttattctcatctacttttccaaataacaagatatataatgtactatttctgcttagaacttataaaagtcttttatgtaatttttttcaccaggaaccctaaagctctcatagctctcgggagcatcagaagtagcaaaaccaatcaaatttcaaatacctggtatcctctatcaatttttagaggcttgataatggtagcttaggaatttttggataaatagagcagatagtgaattcttggaaatccataggaaacaaaatgactatttatagaaccaaataaaagccttccgttagaaactaaaaaaaatcaatggtgttttatgtgtttatataagcaaaatgcaaaggagaaaaaacagcaaataaatgaaaattagaagaaaaaaaaacaaacaggaaaccactccccaatttttctcttacttggtttacccaggaggctatagtattgcccagagcctacaaaaacaaatgatgaatattttgttcctggtacacaatttaatgtctttaagtccaccaataccattatgtattttttgcaattgagaaattcactttaggtacatgaccagtaagtactttagtgctgaaactgtctatgcagaatagcaaaaatagtgtgaagcaatgcaagcatatatgtgaaatttggctccatgctaactaaatctggcttcatgcttaactttattaaaaaagaatggccaaactgccaatgtatttctttacaatattttttattttactttcttcaagattaagaactttatgaacagtgttaattcgctgaatttctccaattttctatcagcttttaaagaatattttactatctaagctttttcaacttttttttttttttttaaataaccagtcattttactttaggacaaaaatttaccttacaatttaccatcctttctcatatgaaagtattctcttttctttatacccttccttaccaaaaacacatcttcatatctgtaactttcttttttttctttttttttttgagagggagtctcactctgtagcccaggctggagtgcagtggcgccatctcggctcactgcaagctccgcctcccgggttcacgctgttctcctgcctcagcctcccgagtagctgagactccaggcacccgccaccatgcctggctaattttttgtatgtttagtacagacggggtttcaccgtgttaaccaggatggtcttgatctcctgaccttgtgatccgcccccctcggcctcccaaagtgctgggattacaggcgtgagccaccacgcccagcccatatctgtaactttcttcacatcactctcccctacttactgattccttactactttgtttcatgaataaccttttcaagtccatattttgaattaaactttagataacttctgaattaaataaaaattattatttttctcactaaaaaaaaaaaaatacaaaaattagccaggtatggtggcatgcccctgtaatcccagctacttgggaggctgaggcaggagaattgcttaaacccaggaggcaaaggttgcagtgagccaagatcatgccactctactccagcctgggtgacagtatgagacaccatctcaaaataaataaataaaaaataaaataacccatttcattttccactgggtctgatttctcaaaagtcaaatgacatgctcatgtgttcttgtaaagtgaaaaaatggaaggatttgggagaccagggaaggaggaagagactggattgggccagatgagaatttgggcagagcagcatggggctgagtgcccagatgacggtggatggtcaggaaggcttggaattctggagaagaggagtgaagcaggatgtgattagtgctgctgactcaggagaggggcctcaacacccagcctgatggtccagggctcagaccacactgatccattcttgctcatgacagtggatcaagccatcactgcaccctgcattgacaatgacaaaaccaagtgaacggttgttttaaatttaaacacaaggaaagcctcactgagcatctccaccagtttgggatgatacagaggtttcactgatgatcatagatgctccttaaaatgtcaggattccagctgtctgtgtgtaagtgctgtgggctcctggaagccctgtgtggcagcagatttcatggcagaatatgccatgtatctccgctaatgtcttaattcagttgtagatgacaaataacaaactcgagcagcctcctaaagacttcacttagtagatgtttctgctattaatcctgagtaacaaaccatctcaaaacttaatagcacaaaacacaattttagcttcctcacagattctgtgggtcagaacagcttatctctgctccaagatgtccggggtcctcagctgggaagactcaaacaactcggggtgatttgagagcagggggttggaatcatttggagtcttcttcactcacctgccggctggttgatgttggctgtcagctgtgacacctacacatggcccctctgggtactgggtactggtatcccaagggagcaaaatggaagctgcatggtacttttgtgatctggttttggaagtcacgtagtgtcacttctgcttatacacagttagtcaaggtggtcacgagagcctttctaggttcaacaaagtggccacttcatcagtcttatcacaatggcatacaaccctgatgttaccggtgggctgggggaggtccccaaatgccaatgggaccttgactccagccagcatccaggctcttgacaccattgcaagaaggaattcaaggatgagtcagaaaatagtgaaagtatggagatttattgcaaagtgaaaagtactcactcaaaaaaaggggagtgcaggtgcacttaagagagtcatgcgaggggctttgaggctgctacctttgtggatttctttaatcaaggggtggaatgttcataaagattcctgaaaaaaagtggacatttcagaactgtggtgccattcatttttacaccaaatatggatgttcctggaactgtcatggtgctggtgggtgtgtaatttagtatgttaatgatcatataatgagggcctaggtgaaacctaggtcaaatccagtgccatgtttggtccagttggtcttagccagtttggtgcacaccatttttcaccatcttatcagctatttcaacagtttcattttactagtcatgtgaaactgctgcctgggattttctgttctcttgcaaccaccctgtattattcatatctcattttcagtgaccctagcatctctgaagtggttcactttgtttcttcttagcttcaccaccctgaccttcaatcccacactgataatcttatttgcaggttgactactaaaaagagtactatgctactccagtcctcctatttttcagatgaggcaagtgaggttcagaaagacaaagagcatcccccagaagcagcaggctggtgattcccaggaaatacttggtttcttatttcaactgcatcagaagccacctcgatattcagtagcttaataaacccaacactttattatttttcatgcttctgtggattaactaggtagttctaagtgtggcgttggctggggcactgggatagctgaacagtccaaatgacctcactcacacagctggtagttttgtcagccactgtttaggagctcagctgggactcttggctagggagcctctgttctcctccacataactgcttgagtttcctcctattatggtggctgggttcaaaacaaagacattccagaatggcgaaggtgaaagctacagatttcttaaggcctagccttggaagttatacagtgtcaattctactattatttttgtcaaaatagcccatgagtcagcccagattcaaggagacaggaagtggactccacccagcaatggaatgagtggcaaagaatatgtgatcatctttaattcaccacaggttctccagttggtagtgaagcaggtgagcaaagttgaaggcccaggtgtcaatcccagagtggtttgtaaacatgaggaacaactaatgaccaacaggaggaggatagttaaaataattatgttcaatatatgcggtggagtactctatcactgttaacaaaagacacagaaacgtatttgtaatacattgctacatgaaaaaagagcttataaaaacactgtgcagggcataatcccatttttatttagggaaaattttacccaactttacctgtatgtgcacagaaaagcttctgaaagaagatacaccatcattcttgtggtggttatctcagagggtgacattgatttctttttttcttctagcgaatttgtaccttctttaaaaaattaccacagaaattgatttttttaaataaaaaagaaattcccaaagggcaccaaaacaacccagttattctctctgggaattgcagccaggcactgcgcctgaggccttcccttcagtgtagccctcactagtgtcagtgcggccccagctcaagagagcctctttgagtaaagacttcccaaggcctcttctcctgccctgtgctcccagccaggatcctctcccagtgacttgggagtcttggacaaggcagcacccacagctcaacctaggggctctttgggtgagaaaatccttgtgccttttggtgttagtgggttagtttttggattaggtgaagtgacctcttgagtgtaaattcacggacacaggtcaggtgtgacagagaggagggtaaatgggaaggagctagtgtttattaaatgcctagcaagtgcaagagcagtgccaggcattgcccattgatacggtttcgctgtgtccccaccacaatttcaacttgaattgtatctcccagaattctcacatgttgtggaaggaacccaaagggaggtaattgaatcatgggggctggtctttcctgtgctattctcgtaatagtgaataagtcccacgagatctgatgggtgtatcaggggtttccacttttgcttcttcctcattctctcttgccaccgccatgtaagcagtacctttcaccttctgccatgattctgaggcctccctaaccatgtggacctgtaagttcaattaaacttctttttcttcccagtctcaagtatgtctgtatcagcagtgtgaaaacagactaatacagtaaattggtacctgtagagtggtgtgttgctgaaaaggtatccgaaaatgtggaagcgactttgcaactgggtcataggcagagcctgcaacagtttggagggctcagaagaagacaggaaaatgtgggaaagtggaaattcctagagacttgttgaatggctttgcccaaaatgctgatagtaatgtggacaataaggtccaggctaaggtggtctcagatggagctgaggaacttgttgggaattgaagtaaaggtaactgttgttatgttttagcagagactggcagtattttgcccctgccctcagagatttgtggaactttgaacttgagaaagatggtttagggttatctggaggaagaaatttctaagaagcaaagcattcaagaggtgacttgggtactgttaaaggcattcagatttataagggaagcagagcataaaagtttggaaaatttgcagcctgattatgtgatagaaaagaaaaatccattttctggggagaaattcaagctggttgcagaaatttgtataagtagcaaggagcctaatgttaatccccaaggccatggggaaaatgtctccaggccatgtcagagaccttcatggcagcccctcccatcacaggcccagggtctcaggaggaaaaaatggttttgtgggctgggcccagggtccctgtgctgtgtgcagcctggggacttggggccttgcatcccagccactccagctgtggctgaaaggggccaacatacagcttgggctgtggcttcagagggtggaagcccaagccttggcagcttccacatggtgttgagcctgcaggtgcacagaagtcaagaattaaggtttgggaacctccacctagatttcagaagatgtatggaaacgcctggatgctcagacaaaagtttgctgtaggggtggtgccctcatagagaacctcactagggcagtgcagaagggaaatgtggggtcagagcccccacacagagtccctactgtggcactgcctagtgatgctgtgagaagagggccaccgtccttcagaccccagaatggtagttccactgacagcttgcatcatgcacctggaaaagccacagacactcaatgccagctcatgaaagcagcttggagggaggctgtaccctgcaaagccacagaggtggagctgcccaagaccgtgggaacccacttcttccatcagtgtgacctggatgtgagacatggagtcaaaggagatcattttggagctttgaaatttgacttccccactagatttcagacctgcatggaccatgtaacccctttgttttggccaacttctcccatttggaatggctgtattcacccaatgcctgtacccctattgtatctaggaagtaactagcttgcttttgattttacaggctcataggcagaagggacttgccttgtctcagatgaaactttggactgtgaacttttgggttaatgctgaaaagagttaagattttgggagattgttgggatggcatggttggttttgaaatgtgaggacatgagatttggagaggccaggggctgaatgatatggtttggctgtgtccccaccataatctcaacgtgaattgtatcttccagaattcctacatgttgtgggagggacccagggagaggtaattgaatcatggaggctggtctttcccgtgttgttctcatgatagtgaataagtctcatgaggtctgataggtttatcaagggtttccgcttttgcttcttccgcattctttcttgccaccaccatgtaagaagtgcctttccccttctaccatgattctgaggtctctccaagcatgtggaactgtaagtccaattaaacctctttttcttgccagtctcgggtatgtctttatcagcagcatgaaaataaactaatacacccattgattattttgtgaaactctcacagccatcctgggtaataaggggtcttatcctcatttcagatgaggatgtgaggctcagaaagcttaagcgaccagctcaggtccatccagcaagcaagtggagcagctgggacatggccccaagtatgaccctagaacctgctctttttcactgctccatagcgagtagaggcacagaaaaacaagaaggaaaaacaagagggtttggagaaaagaaaaaggactagtctcatgagaacatgtgagcagcaggagatgggtatagtaaattggtaccagatcatgaatgcattgatgcctggaaggctggctgaagagtttgggttttctcttgcaggcagtggggagctacggaagtttcttggggaggagaggtacctgacattggtattggatatgctgagatggacaaagtagactggagtgagaaaggctggagtcagggccttggaggaagacaggagacccctgggggcaggggaggggatctgatcaagtggacattggcatttcatttcatgagacctccttgagtgaagtgagtgctaccgcctggatccctgaggtgtccccacttccaagccccaaggtctgagctcaggcatgaagccccatcccatgccccagctaccaccttctttctgccatgcctgaggttctccaactggatgcaggcaccctgccaatgtcaccaatgcttgctctcaaatgattaaactttctgttttgcacatgattctggagcagagtgagtgtctgtggttcactgacaccatcagcctaaaagtccccagcatggagctcaagaaatgcaagtcctctcctgcttccccccataagacctttaatttttcgtggaaactgaggcccaggacatcaaagggccacttaccaggagtagtacggcagggtcaggacccagcctctgagccctcatcaaagtttctctcacttcatcatagaagccccagggcagcaggtaaaaaaattgcagatccccaggcccacactccccagagcttctgtctcagtagttccaggatggagaactggaatccaaatttaataagctgcatgggtgggtctgatgcagctggattgggggacacttggagaaacattgctttagtcgactcttgcctttaggcagtcagggaaactaaggcttggagagggcaaggggcacacagcaagcaggtgatggagttgattgtagaaccaggtatttgatgcccacctctaagtccaggtgaccgtgacttacatgtgatggtgttccacgggatccctcaagccccaagagtgtctccctcccctgctcaaggtatgagccaagtgtgacagctcagctgtcaactcccagcccagccactttccaggcaaaaggtgactcggaaaaggacgaatacagaagctggcatggcccaggtttgataaaaacaagccgggcatttgcccaaagggagccacaggggctcagctctaaggaacacttgttctgagccctgagctgactccagacctgcctccctccccgccccacctgaatgctgacatctcacctgttggcctcaccagatgccatatatctgccccctgggggattccacacctccctcccagtctctcaggccacactgccatggccctatcagtcctcctccacctgctcttgtcctcacccagtcttgccacagccctctccacttcaagttgctgggacccttttgtcgtcactgttctggttctggaccttctttcctagtttctggacccgaaaagactcccaggtcctgtctttgcccagatctgccctgtcatgagtcacagatctgagcatctgatccttcatccagtgagcattaattgagcaactactatatgccaggttatgtggttatgtggacagcctcccttccctattgtcatccaaatttaggcagctctactattttgtgggccaagtgtggacctggaaatctttgccaagtctgtgattcccccgccaacctccatccactaacccctgggggtctattatttctccagtgtactgccaggggtccaggagcaggttcccatgctcctccgcacacttgggcagtgccctaccccacaggagggttataaagcatgttgtggttgcaatctcacttgaccctcatctgggaactgagagagaaagcagagattcgaattcccatttcacaagtgggggaactgaagcatgggaaggtgatctggtgaggaaaggcagtgttgggatggtgattcaggcctcctgatctcgcctgcagggctctttcctctgatcattacagcaacaatggatcgagtctactcggtgcccagcttagtgataagctcctggcatgcactcattcagccatcacaacggctcctcaaagcaggaacaaccattatctctactttacatgtgagggaattgaggcccagagaggggaattgaggccagagagggcacttgaggtcacctggtgcatgatgagcaaagttcggtttcaaatgcaggttgtcctgacatcagagcgccagatcctaacctaagccacagagattatggggggaaatttaaatccagccataggtgtggtcctggaaagtggccagaggaggtgggggtgaggttaggagtcagtccacattgcactatcagcattgaaactgacacttgaataatcctatactcaaacctatggagagttttcttgtatccctgctgcaatttacctgatataagacacagcatggccgtggcttcagatgggggtttctgggctccctgatagaaaaacaggtggagctgctgtggggcttggaagccctgccctgcagaccctttcacctccaagactgcccctacttaatgaggataacacggcaaccatggtgatagctctctactaaaggaagatggacaggatggtcacagtcacagctcggatggtcacagtcgcagctcagatgttccgagcacttgccatgtgccaggtgccacgtggccaagccctatatttccctatttctttactttttcttgtcctcattttacagatgagaaattgaggtttagtcaagttagctgaccacttcaagagcatactgctcataaatggaagactcaggatttaaacccagtgcccacagatgcctcgaccatctttaatccagtggattggagcagggatacaagaaaactgtccacagatttgaatgtaggattatttaaatgaatccatttctgcagtgtcatcattcctgtgttctcttttccaagaatcttccttttaagggtggcttctcctttcccatctttttttccacattctttctcctgtttttttcttttaagtacagggataatcgaacattttgggaggccaaggtgggcagatcacttgagctcaggagttcgagaccagcctgggcaacatggcgaaaccccatctctaccaaaaatacaaaaattagctgggcattggtggtgcgcacctgtggtaccagctactcaagaggctgaggtgggaggatcgctggagaccgggaagtcaaggccacagtgagctgagatcacgccactggacaccagcctgggtgacagagtgagaccttgtctcaaaaataaataaataaattaattaatttaaatacaggaactcgctctgacacttgggctggagtgcagtggtgtgatcataattcactgcagacttgaactcctgggctccagcaatcctcccacctcagcctcctgaatagctgtgattacaggcatgagccactacatccagctaacatattttttgtagagatggggtctcactgtgttgtccaggcagcctgcccacccctggccttaagcgatcctcccacctagtgctgggattacagataggagctgccactgaatctttctgcttcttagcatttctctctttgtccccaacccctactcaagtgcattgcctggggggctcaacctccagggctctgaacaaagggacagagtgatgctccagtggccaggaagcaagccaggtggttttcaattagctttcaacaaaagaggagtgttgctgctggtggtggtattaatctgctggaattgttgcaaaaccatttttgataaaacatcatcacatgatttttggcatttacattgaaagcagttcaaagaattgagcaacactgttttaccaaaactctgttcattcttatctgctgacctgtatttgctaaacaaataagcggatgttttttaagagcgcttaggtctctaaaaatgaaaattaggtctctgatgagtgctaaacactgcctccttctagcaataagcaaattataaatctgttaaaagaactaattggaaaaaagcccaatccatgtcattaacacatccatttccaaatcaatattactttgtgtttaattattatcaaaatttgttttgataaattgtatatcactattaatagtaacaatctaaaagattattttaaatacatagtgtccactggtcaaaggagatttgaaaaaaatttaatcaagatacatatttttttaatgtttactttttaacaaatttttatatttccataggttttgggggaatggtatttagttacaagagtaagttctttagtggtgatttgtgagattttggtgcacccatcacccaagcagtatacattggatccgatttgtagtcttttatccctcacccccttcccaccctttccccctgaattgccaaagtcattcttttttttttgctctgttgcccagggtggagtgcagtggcacaatcttggctcactgcagcctccgcctcccaggttcaagcaattctcctgctacagcctcccgagtagctgggactacaggcaagcgcctctaacacctggctaatttttgtatttttagtagagatggggtttcacgatgttggccaggatggtctcgatctcctgacctcatgatccacccgcctcggcctcccaaagtgctgggattacaggcatgagccactgcacctggccgccaaagtcattcttatgcctttgcatcctcatagtttagctcccacttataagtgagaacatacaatgtttggtttttccattcctgagtaactttacttagaataataatctccaatcccatctaggttgcttcgaatgctattaattcattcctttctgaaggaatgaatatgcccggccagttcacatgtttttaaatggatgaaggtgctgagtagtattccatcgtatatatatacacaccacagtttctttattcactcattgattgatgggcatttgggttggttccacattttttgcaattgtgaattgtgctgctataaacgtgcatgtgcaagtatctttacacataatgacttctcttcctctgggtagaaacccagtagtgggattgctggatcaaatggtagttcaactgttagttctttaaggaatctctatgctgttttccatagtggttgtactagtttacattcccaccagcagtgtagaagtgtttcctgttcaccgcatccacaccaacaaagatagatatttctgatgcagaagagtctacctctctccttccctgtccaacttcattctctgttttttccatttgcgagcttcacaccagctttgctggcctcctaactattcctgtaatgcaccagcaccttccccaccccagggcctctgcatgtactgtccctctgcctggactggtcaaccttcaatagtattatggctgcctctctcaccctctgcagtcttcactctaagtcaccttctcagggaaggtttctctgacctctgtatctaaaatttctcctccttcccctcaactcttttctccttctgccctgcctgcctccccctcactccaccaatcactgttatacttatttgctttgtttatatatcaactaaaatgtcagttatatgagaacaggagcttttgtctgttttgctcacctggtgaccccagtacagagcctggcttgtagcagacgttcaatacactgtatttagatgaatggaggaatgagcaaatgaaggaatggatgaatgagtttaatcaacatcggactttcaagcataaatatctattacattagactaaaactctgtggggacagtgctttttgtgcaatgcaaatacaaattcaaggagaaaaaagaatgccacaaaatttctgactgttaaagaatttgttcacgtttttgttgttgttttttcttttttgtggtttttttcttttttgagatggagtctcaatctgtcacccagactggagtgcagtggcatgatcttggctcactgcaacctctgcctcccaggttcaagtgattctgctgcctcagcctcacaagtagctgggactacaggcatgcaccaccacacccggctaatttttttgtatttttagtagagatggggtttcaccatgttggccaggctggtctagaactcctgaccttgggtgatctgcccacctcagcctcccaaagtgctgggattacaggcatgagctgccgcgcccggccagttcacatgtttgtaaatggacgaaggtggaaatcaaaccactgtggaatttgtagtccattggatacatgtataaatgcacataaagaaatataaatgtattccttttaaatgtcagtatttgcaatcccctgaaaataaaattgacaactacttcaactcatgctgaaaatttgagacgtcaacttgcaaacgggtgagggtcatgtgataccaccagaatggctaaagtgtaaaatgggaaatgccaagtgctggcgatcagaacttgccttcattgctggtgagagtatcagatggtgtatgtggaaatctgcttggcagtgtctactggaactgaatactcacaaaccgcaggatccagccattccactcctgggtacacacccaacagcaataagcacacatgttcaccaaaaggcaccagaagctttgcagcagcattgtacgtaagccccaaactggaaactgcccaaacacccatcaacagtagacggaaaaacgacattgcggtaacttacacaatggagcacactcaggcatttaaaatgaacaaacaaggcctgcacacaaccacatggattaatcacacaactgtgatgttgagtgaaagaaccaggcacaaaaaggcacgttctgcacgattccatttacgtaacattcaaaacccagccaaatgaatctgcagtgtgagacatgagaatggtactggagttccctttgggggcaagttagagactgggaggggcctaagtggggctctggggatgtggacgatgccatatgttttgcttggatgctggttgggtggcatgttagcctgctcaggctgcgataacaaagtaccccagactgggtggcttaaacaacaggtgtttatttttctcatcgtctggaaggctcaaaatccaggctcaaggtattggcagggtccgtttcattccaaggcctctctcactggcttgcagatggccgtctccttgctccatcttcccatggccttgcctctgtgtgtgtctgtgtcctcatctcttcttataaagacaccagtcatactggactaggccccacctcatgagctcattttaaatggattaattacctcgttaaagacactatctctgaatacagtcacattctgagatacggggggttaggacttcaacatataaatttggggtgctggttggggacacagattagtccctaacccctgggaagtttcactttgtacaaatccctacagccctctgcctatggtatgggccctttatgtatgtctgtcctgcttcaataaagatggtgtgaggggcacatggttttaaggaattctgaacaaaacatagaggttgctctgaccatcaagtatggtgtttcctccaaaggctgtagaaatatgcctggcataaatcacagaaggctatgaacagccagagaaatggagcatccaccaggactctgcatcaaactccagggaagagctccctggaggtggaggcgctggccaggctggtctgccccatccccagcagaccaccctctggccaggcctcccacagggagctctccagcccccagatgcctgcttttctgatggtgcaaaccaagcttcaagcatgggaggccctggctccttggccgtgagcactctctccccgactcagcctggccctgctgtcctgtccctcaagcctgccatcaccccaccctggtggggccgtttttctttctcctgctgagtaaagtgtgaaacaggtgaaaaggctgcagacagacaggaggccagccagccagccccaggcagtgccccagccaccttgtggctgactcccattcccataccagtgacactcagagggcactgggtagagccagggtacctgagagggatggcaggagggatcaggagaggcccactggggtcagtgctgtgtgacatggctcggcctctctgggctgcagcctcctcctgctctgacgttcctcaaacccccaagagggtttcaggaagagtcacactgaggttgtgaatggtgacagaaagaccaacagccccttcaatgggtaccacccttcacaggttgcaagttgctctccttgtccctcagggagcaggtgctaaggccagcaccaagggggaacctgagacagagaagagtcagtcccacgactggccaatggcagagctgagacctgccctgaagccccggtgcagattccagatctggcctgggatgttccgagggccctgggtgcccctggtggggagggagaattccagtgcaatgactggcatttccagagaaatggtgacacttctgtcagccagcaccaggattccctcaggaaaaccgggatcccttgggaacattgccaattccctagaattcctgcaggatttgtacagtatcttcagagacattgacattcttatggacaatgatagctctgaggaaacactgaagcgtcattagaattccttcagaaacaagtaaaaggtcttttggaaatagggacatttcataaagaaaggctggcattcctcaggaatttgggctgtcctctcaggaatgtgtgcattctcatgggaattttgagatttctctgaggaacgatgagaccctcacaggagggcagcgggctcccccagacagtgattctctccaagaacacggagagactccccagggagctgccttggagtccggagctggcttccccgggcttaggacagcttgagcaatcagcggaaaggggtgggctcttccccatgcattgtggatattcactcagaacagagacccgccccccaagagacatacagacaagtgcacacacgtacacacacacaaagccacatacagttacatgcacagatgcagtccacacagacacacacaggcacctgcacaaaagcacacacagacacagacacacaccagaacatacatggactcgcagtggcttcaggaagtcacactcctcccaaagttgccagcccagatgacttatggcctcattcccctcagggttccagggcagggccctggatgccctccccacctccgtcctggtgtcagccagagtgactggtgctccaggagccctgctcaggcctctcaagcctctgcccacccctggccccggcccccacttggcctgcctacctgcaacttaagcttccctctgctcctggatcttactccggaggcagatgcaggagtcccaccggtcttgggtggccggaaccacatcctaggtaaggaccctgccctccctgctctcagagccctggggaatgcgcaggtgatgaggaggaaagagttggagccctgggtcccagtcctggctttgtcactgacctgccagggaacccaagggcctcaatttccagatctgcaaaatgggcaccctcggtcttttgtatattatgtctgtcaaacagccgatgcccgacctgagggagaaccaaagcccactcagccagggacccaaaccatgtcagctcatggatgttttgtgtttattttgctcgtctgtggtcctttttaagacaatgccgttaattttggggacaaaatttcttgctctgataatcaaaaataattattccagctaggcacagtgactcacgcctgtaatcccagcgctctgggaggctgaggcagacagatcacctgaggtcaggagttcgagaccggcctggacaacatggtgaaactctgtgtctactaaaaacatagattggacgggtgtggtggtgggcgactgtagtcctagatactccggaggctgaggcaggagaattgcttgaatctgggaggtggagattgcagtgaactgagattgttccactgcactccagcccagaaaacagtgtgagactccatctccaaaataataataataataatttcatcagcggcagaaaattgtaatctgtctaacatgactaagaaaagctcctacctgggggcagggacataaggactcaaagagatggtgcaggagtgctgtgtacagggcctggcgcttagaaaatgttgtcgtcatcactctatgggctcccccattagccccgaagagaacagggtccctgctttgcacaactgctttgtgtgcacaggtcccaggtgagaagggagcaccctcacttccagaaacgagttcatgcccatactctgcaggggggaagccgcgtgaggagccattcacgggggtgatgggtaagttgagtgtttgcaaacaatagttgttgtcgttccatttctctgtccaatttctgagaagagagaatttccgcctactttgtctgtagggttctagagcagacatggaaagaatgccattggctgtaaaacacgccactcttttctatgtactagcaagaaaaaaaacacactgttacctaaacacgttgatggtaagatgcattctgatttccaagagagtaaaatgagaaaaagatatgtcttcaagccaatgaaacatggtgtaaaaaccatgacggggtcatcaaggtaattgatacgacctcccagcccttaaggggcaaggagtgtcctccttcccactgtagtctttctttttttctttattccatgtttttgtttgtttgtttgtttgtttgtttgagagacagagtcttgctctgtcacccaggctggagtgcagtgttgccatctcggctcacggcaacctccgcctcctgggttcaagccattctcctgcctcagcttcccaagtagctgggactacagatgtgtgccaccacacccagctaatttttgcatttttagtagaaacgaggtttcaccatatgttggccagcctggtctcgaactcctaacctcaggtgatctgcccacctcggcctcccaaagtgctgggattagaggcgtgagccaccctgcccagcctattccacgtgttttaaatggaggtttcagttgtatacagtaaaagatgcagtaagaaagacaggtttttgcttatgtgtgcacccttgcaaccaccacccagatcaagggacaggactttcccaatacccagaaagagcccctttttgccccactgcagtcagtacctgcccccagaggtgacccctcttctgacctctatctctgtgggcaagtactgtctgctcctgaaattcacagaaagagccatacagtgtgagcgattctgtagctggcttcttttgttcaatgtcatgtctgtgagatccccctatgttgttgcctgtgtcagctttctagcaaatttatctgtttttctacatcacactaaacccggttcagaatgggtacaaaagggcatagagagggaaataatagacactgaggactccaaaaggggggaatggggaaggggagtgaggggggaaaattacctattgggtacaatgttcactattagggtgatgggtacattggaagcctaaactgcaccattgcaccatttgtctcgaactcttgtcctcaggtgatccacctgcctcggcatcccaaagtgctgggattacaggcgtgagccaccacacctggtccattgcaccatttgttatgtgcaatatatccatataataaactgcacagataactcctacatctatttttaatgaaaaattagaaaaaaaatggaaaaatctggttcaggaacccaggcttctcctctctcttgccctccctgctggggtgcactctggcagcaaacaattccccctggcctgtgcgttggctgtgcccaaggctccccactccgtctgcagggtggcctgaggggatcctgctggagcctccatccctcagcaacctgaggcctggaccctttctttctagcatgtgtcaccgccctgcatgagggccacacattcagagcttcatcagcatccttcaagcgagagctcagattttcccgttccatgtctgccctccttatgccccacatgggcaagatctgccctagcttgctgttctccaatcccaagcatgctgggcccaccttcctcctccacccatctcactcagtcctaggcctgggtttgcttgagctctcaaactggcagtcccagggatgtgtgcgggtgtgtgtgtgcacacgagagagacaaagtgtatttaaacaattttacaattttgaattagtttatagtgttttaaaaccaagagctttaatgcctcctcttgacaagttgttgttgactgtgtgctatgattcaggccccttttcagaggctgggaatacagaagtcaacaaaacaaggacatggccaaaaagaaactgacattttacaggtgtttgcattagaataataaaaaaaattcctgcttctcctaataatggaacatttcatccagaatgggtacacatatcctacctggcaacagtaagaatggatcccagatcagtggtgacctgttgaccaactgttgtctccgcaggcacctgctctgaacatggggatgtttttgtggactttcctcctcccttggtacctgcttagcataagccatgctcagttgggaggttccaggtcccaaacaggtaagccatcccatctttcctggaagctccttccaaggagattccaaaagaagcaagtttacctccattggacaaacagtcatctgtcatcaaatctgattcattagaagagcttagatttgcaagtgtcacaagaggcaactggaggcaactcagaggttcctaatctcctttagatcacctcttggtgtctagattatgtattatattaacacaaaccacatgcactctctgctgtcttaatcatagtattccattcttacacttagttcccaggtaaatctttctagccttaatcactgatgatctgagtcccatgagattgcagaaaggagcttgaccagttgctttgggaccacatatcacagatttatagcttccaattttacaataaagagctcgtaaaaaaaatcacccatatgcttcgagtccacagcctgacccatgttttctctgaaaatttcttatctgtaacccaactcctggtaccagtttctgtcttagttattggtttggttgcaaggagcagaaacttttctgacaaaaaagaaaacagtaaaaaaaaaattgtgaaaagggaagtagggttatctctctgatatcaaagtttatacatcccctggacctcccagggcattaaaaacaagatctgggaaactaacaacaactaaagcagccacgatgcttctttttgattctctgagcataactatatcattgttttctctttattgtttatccattccaccatagatggcccaagtgtggtcaccaccatgtatctgacttttcattgcctcctgggtcaagtgctcaagaaaatctagtgcaagattgagactcagttctaaatttgcaagggtaattcttttttttttgatagtgctgattttctttttttttctttttttttattatgctttaagttttagggtacatgtgcacattgtgcaggttagttacatatgtatacatgtgccatgctggtgcgctgcacccactaactcgtcatctagcattaggtatatctcccgatgctatgcctcccccctccccccaccccacaacagaattcttatcctgattcctgaatgtggtcacagagctggttctgggttgagctccttactcctatgttcctaatgggagtgtgtagccttgagttcacctatgtgtctctgtcccaacaggtagtagaaatggaggtctcctgggcagcagtggtctcttgggtacaggacttctcaagaatggccaggtgctcggcaatggtggtgttcttggcacaggccttctcagtgggaataaccatcaggctggggccaacagtggttccccaactacaagagttgctgctcacctctctgagccaaaccaccttgagaatgaccaggaatacatttatctgagttcccctcatgccgaagatgccactgagtacagcatcaagcctgggaaatccagtatgttccagatgcccactctgctgcccacacccccagtgagaatggctgcttctgcccctactccatctgtgagaatccatgtgaccaatcaagacactatgggtaaacttggtcagagtgagatgggcggtccaggctctactgacaaaagtgctgtgatcagtcaaggatccttaggtcacaaaggaatgactacccctggacaattaagtcagaaggttataaagagccttggctactctgaccacaagtggatgacccaatctggccatacaggtgtgggtgatatgagcttctcaggcagtggtcaaccttcagatgcttcttcaggaaatgctgttgtgtctggggtggcttcacctggcagttacggtcagtatggggctgagtcatctgatggtttgggtcaatctagggcaggactaataactgatcatcctgggactgggaaaaatgatgattttggtcagtctgaggcagggttaatgagttatcagactggtggtaggtcatctggttacggtcaaactggggataggtcatatgagtatggtcagcaaggaaacaagtcatttggagggtatggtcagtctggggtggagtcaataaacagcctgagcctgggtcatctggtggcttgggtcaatctggagcagagccaatgaatggtaagtaaggggctggatcatttaggggtttgggtcaatctggggtaggttcaatgaattctcagaccggcaataggtttcctagtggttatggtcaaactgaggctgggcaatctggtggctacgatcagtttgggacagggtcatttggaaggtatggtcagtctgaggcagggtcaataaatgttcaatctgggtctagaccatctaatggtatgggtcaacttggagcagagtcaatgaacagtcagcctggggctaaaccatctggtagccatggtcagtttgggacagggtcattaggagcgtatagtcagtctgggtctggatcatctggttctttgggtcgatctggagcagggtgagtgaatgatccaactggatataggttatctagtgcttatggtcaaactggggcagggtcactaaatggtcagtctggggttgggttatctggtagtcttggtcaatctggggcagggtcaatgagtggtcagactggggataggttatctagtgataatggtcaaactggggctggattatctggttgtcttggtcagtctgggacagggtcaatgagtggtcagattggagacaggtcatctagtggttatggtcaaactgggccagggccactaaatgatcagtctggggctgggttatctggtggtcttggtcagtctggggcagggtcaatgagtggtcagactggggataggtcatctagtggttatggacatcttgggacaaagacatctgtaagctatggtcagtctggggcaaggttaatgaatgttcatcctggagatgggacaactggtagtattgatcaatctggggtagggtcaatgaatggtcagcctgggccaggaacatatgctggtgacagtcagtttgcactaggagcatctggaggatatggccaacctaggtatgggtcacctagtcattttagtcaatctgagactgtatcattgaatggtcagcccagagttaggtcatctggtgtgctgggtcagtctagggttgaatcaatgaatggtcagcttggggtgggactgtctgatggctctgttcaacctggggcaagatcatcaggaggaaatgttcaacttggagaagggacatctgatcgtgatatgcattctggggctggatcatctataaattctggtcagtttggggctgggatatctgttggctatggtcagtctggagctaagtcacatgacagtcatggtcagtctgaagctcggtcagtctagaggttatggtcaatttggggctggagtatcttttagctgtggccactcaggagctaggccacctaatgattatgacaagtctggggctgggttctacttaggtcacggccagcctgggcgtggcacccctggcccctctggtccacctggggaaacaccatctggagatcttggccacatgggatccccagtggatgataaggctccccaacacaggagtccagtcaatggcaacacactgcctcccccggttcatgatggtcaaggaggggggtataggagcaggagctggaaacacactcagtcagcaattgccaacaactgccctcaacaaagacctcctggctcaggaagggctgcttggagccatcattctcaacaaccagaatctggttagggagagagagatgctacttaagatcctcctgggcagcaggaccttacctactggaaaagatcatctgctggaggcagcagggtctctggctctggaaggactgctctgcaagggttctctggggggcctctgtggccacgggagtcttgttggcatcaacaatgttctgaagagcacttctttcgggaaactcaacagctggtaagtttaagtccttcatcaataaaacagtttcccaatgcactgatcaacaagggttctaggtgctcactatatgttaagtgttggagtctgactcacctaattggaaggcagacagtaagaaggcagcctcagacgccgcctcctcctgcaaactctcagcccactgcccagcatcccatcattatggcttcaccccttggatttatgaaggtttgtctaagcctccactaaattacaaatagcattgaaaaggggtacagcagaagctcttcccagctagtactttagttattatttaataccccagtggttaaaaacagcatctttgtatgctaacactgtaatttccaactgatgctttgaatttgacatcttaattttcctttaacatcttaattaactacaaaagtgttagttatcagctaatgcttttcttgtctaggatttggaaatgggatttagaatggaaatctaggtcaaggatacgaaggcccaggatagaagaaaagccatgttgaagtttgagtaataagtcgagaagactgggaagttctgcttttccacttcaccttgctcttcccattcttcaggctcaaaatcatcaactttgatatcatccaggtggcgtggaagaaggtctatcctttatccaacctccaactagaatttcagaccaggttgactatcaaactcccagggtgagtaacttattcatggcaagagaagccaggtggaagagaattcttggagatagtaggcagtttttttaaatgtttaatttttgtggaaacatagtaggcatatatacttatgggttacatgagatactttgatatgggcatgcaatatgtaataatcatatcatggtaaatggggtatctatcccctcacacacttatccttggtgttatgaacaatccaattatgctcttttagttatttttaaagtacaattaaattattattgactataatcaccctgttgtgctatcaaatactgggtcatatttattctttctaatgatttttgtacccattaatcatcccttccccactcctatcacctcactaccctttccagcctctggtaaccatccttctatcactatgagttcaactggtttaatttttagctgcacaaataagtgagaacatgcaaagtgtctttctgtgcctggcttattatacttaacataatgatctccagttccatccaggttgttgcaaataacaggatctcattatttttatggctgaatactacttcattgtatatatgtaccacgttttctttatccattcatcttttgatggacacttaagttgctttcaaatcttggctattgtgaatagtgctgcaacaaacatgggcgtgcagatatcccttcaatatactgatttcctttttaggagtgtatatactcagaagtgggattattggatcataaggtggctctatctttagttttttgaggaccctccaaactgttctacatagtggttgtactaatttatattcccaccaacagtgtacgagggttcccttttctccacatcctcgccagtatttattatttcctgtcttggataaaagccattctaactggggtgagatgatatctcatcgcagttttgatctgcatgtctccaatgatccatgttatcaagcaccttttcatatgcctgtttggcatttgtatgtcttctttacagaaatgtgtattcagatcttttgctcattttcaaattagattattagatgttttcctatagagttgtttgagctccttatatattctggttattactcccttgtcagatgggtagtttgcaaatattttctcccattctgtgggttgtctcttcacttcgttgattgtttcctttgttgtgcagaagcttttaaacttgatgttatctcatttgttcacttttgctttggttgcctgtgcttgtggggtattactcaagaaagttttgcccagaccaatgtcctggagtttccccaatgtttccttttagtacttttatagtttgaagttttatatttaagtctttaatccatttttatttgagttttgtatatggtgagagataggtgtctagtttcattcttctgcatatggatatccaattttcccagcaccatttattgaagagactgtcttttccccagtatatgttcttggtacctttgttaaaaattagttcagtgtatggatttgtctctgagttctcgattctattccatagatctgtgtatctgtttctatgccggtaccatgctgttttggttattgtagctctgcagcataatttgaagtcagataatgggattcttccagttttgttccttttactctggatagctttggctatgctgggtcttttgtggttccagatgaattttataattatttttctatttctttgagccatgttatttgtattttgatagggattgcatacaatctgtagattgctttgggtagtatggacattttaacaatattgagtcttccaatccatgaacatgaaatatctttcaattttttggtgcctttttaaatttcttttgtcagtgttttatagttttcattgtagaaatctttcacttatttggttaattcctaggtatttaattttatctgcagctattgtaagtgggattactttactttaatttctttttcatattgttaactgttggcataaagaaatattacggattattgcaagttgattttgcatccttcaactttactgaatttgtttatcagttctaatagttttgtggtggagtctttaggtttttccaaatacaagatcatatcatctgcaagaaaggacaatttgactttttctttccaacttggatgccctttatttctttctcttgtctgatatctctagctaggacctcagtactacgctgaataacagtggtgaaagtgggcatctgtggcttattgcagatcttaaaggaaaagctttcagtttttccccgttcagtattatactaactgaggatctgtacatatggcttttatcttgctgaggtatgttccttttatacccagttttttttgtggggggggggggtttatcgtgaaggaatgttgaattctatcaaatgttttttcagcatcatttgaaattatcatatagtttttatccttcattctattgatatgatgtataatactgattgatttgcatatgttaaactatccttgcatccctgggataaatcccacttggtcatgatgaatgatctttttggtttgctagtattttgttgaggattttacatcaatatttatcagagatatagagataatggcctgtagttttcttttttttgatgtgtctttgtctgggtttggtatcagaataatactgacctcataagaatgactttgaagtattctctcctgctctattttttgaaatagtttcagtaaaattggtattagttcttctttaaatgtttggtagcatacagcagtgacaccactgggtctcagcctttcttttactgggcgatattttattatagcttcaatctcgttacttgttattggtctgtttaggttttggatttctccatggttcaatcttggtagattgtgtgtatccaggaatgtatccatttcctctaggttttccaatgtatcagtgtatagttgctcatagtagccagtgatgatcctttgaatttctgaagtatccgttgtaatatctcatttttcatctctgattttatttatttgagtcttctctcttttttcttagttagtctggttaaaattttgttcattttatttatcttttcagaaaatcaacttttgtttcattgaacttttgtattgttttcttcatttcagtttcatttatttctgctctaatctttactatttctttttttctattaacttttggtttggtttgctcttgctttgctagttctttaagatccatcattaggttatttatttgagattttcttctttttctgatataggcacttagagctataaattttcctcttagtacaactttcactgtatcccataggttttagtatgcggtgtttctattatcatttgtttcagtaaatttctcagtttccttcttaatatagtcattgacccactggtcattcaggagcatattgtttaatttccgtgtgtttttaccatttccaaaattcctcattattgatttctcatttatttcattgtagtcagagaagatgcttgatattatttcaatttttaaaaatgttttaagacttgttttgtgacctaacatatggtctatccttgagaatgatctgtgtgttgagtagaagaatgtgtattattcagctgttggatgaaatgttctataaatatcaattaagtccatttgttctatagtgcagattaagttccatgtttctttgttgagtttctatctgaaagattcgtccaatgccaaaagaggagtgttaaagtcgatctctcagctttatatacctgggtgcacaagtgctcagcaaccttaggactctaccaggaaagcacacgccttccctgacagtgccctgcctatagcgagtgtggtgtgctcccttttctgtgctcacgtcaagagatcctggacaggatctctgtcaaatcacttcccatgccatgttgtaattgcctgtatattgcctgtgtgagctctacaggagcagagactgccttagacttatgccttagcccacgggagctctgccaggccaccatccatgttcacttaaagcccaagggcgcctcagtcagcttgtggtgaatgctgcccatgcctgggactcatccttcagggcagtggcctcccgtctggcccagtgcaggtccacaaatgtctaagagcccaggtctggatttggggaccccaagagcctacgtggtactctacccctctgtagccaggctggtacctaaggtgcaagatggagttccctttatgtttccctcttcttttttcaagcagaaagagtctttcaccattgccaccatagctgagagtgtactgggtctcacctgaagccaacacatctcagagtctcacccaaggctctgacatagcacctggatatcactgctggttattcagggcctaagggctgtttattcagcaggtgatggatcctcccaggactggctccttcccttcaaagtagtaagttcccttctggcccaaggtgtgtctagaaacatggtccaggagctagggcctgaaacgccagcctcacgactctgcctggtgccctatcctattgtggctgagctggtatccaagatgcaagacaaagtcttctttacttttcagaaggcagttttttaacaactgacaaaatggcctttggttattcttagcatttgctgacaattcttggcaatatctgcctaaacagcttcttagagatggctgttaacaggaagttaggtgtgagattaatttttttctttttctgctatttctttatgtcttattgtaacaaacttggggagaaaaataaaatgcggcagaaaaaaaaaatctctaatctggatgggcacggtggcttacgcctgtaatcccagcactttgggaggccaaggcacgtgaatcacctgaggtcaggagtttgagaccagtctggccaatatggtgaaaccccctctctactaaaaatacaaaaaattagccaggcatggtcgtgggcacctgtaatcccagctacatgggaggctgaggcaggagaattgcttgaacccaggaggcgatggttgcagtgagccaagatcgcaccattgccctccagcctgagcgacagagcgagactccgtctcaaataaacaaacaaaaaaaatcactaatcttgcagcttggagacaatgactattaacagttttgtttgcttctttccagaccttttccagcactattttgaatgtcaataaatattccatacatagatgcaccatgatacatttttaaccattctactgttagatacttgggttgttttcaattttcacgcttataaataactttgtgattaatatcttgaggaataaacctttgttcatatctctgtttacttactaattctcagaagggtaatttatagcttttgataagtattgccaaattatcctccaaagagatgacggtggtgataaaacatgaccaatgttactgagtgcttaaaatattctaggccccttgttaagggcttttatgaattgtctcatatgatcttcaccagaaccttagaaacgaggtactgctattctgctcattttacggaacaggaaaaaaaaaaaaactcagagaggttaaagtcaattgtgcttggggatgtggatgtgcacatatctccagaaggaggcatgaaaaacatcggttgggtaagcatagacacagaatacacaaagaaagacagaatggaaggaggggagaaagggaggaagggaggaagggaggagggagggaaagaaggagggaaggaagggaaaaggaaggaaggaaggaaggaaaacattggtgaggtgtgtgatctcaacagggttactgggtagcgaggggacattggtgggggccaggctcttcactgtacgtttttccatcttttgaattttaaaccacagcaatgtattccgtattcaaaaataaactaaaacatttacttaactcacttcctatatacattcaaaaacaaatcaagacgggatgtggtggctcacacctataattccaggactttgggaggccaaggtgggaggatcccttgaacccaggagtttgagaccagtctaggcaacatagtgaaaccccatttctacataaaatttaaaaattagccaggtgtggtggtgcgcacctgtagtcccaactactcaggaggctgaggtgagaggattgcttgagcccagaaggtcaaggctgcagtgagttgtgatcacactgctgtactccagcctgggcaacagagcaagactctgtcaataaataaataaataaatttaaaaatatatactgaacagcaggcatcatttaaaaaattttgtatatgggccacctctctcacacacaaatgccagtacttgtttctgagtttgagaaaagcctttagaacatctccagacacctgctctgggaggagagtgttgcttacatcactgaggtggagaagaagagaccagcgatttgtcctggacctttcctggaactctgggtgcaccctggcaggtgacatcccaggccattcttgctgagccctccctctggtgggtccctgggctcagctcagccagccctcctgctgtgtgcacaggttgcttggcttcctcagtggctccacagtggacgtgaacatcatggctacctttgtgctctcccagaccaagctgggtcaaatctctcttgacttgcagaactgccagccagtcttcactaggatccacatgcgagcaaggtaggtactgtgcagagcgggctgagtgccctgcagggtgcagtgcggggacagtgccatgctgcagtgatcaccaggcttactggggccagagctccagcaaactatgccaccagaatacctttcttcttatttcagagtcccctcttctgcccaggtttctctaccagggaggttagatttctaagcaggaggaatgccttctttctgaaagcacatgccttccttgatagtgcccctgcctataaggagtttggcatgctcccctttttgcacttacatagagagatcctggacaggatcactgtcaaatcacttcccatgctgtgttgtaattgtctgcatatgcctgcatgagcactataggagcagaggctgccttagatttatcatttgtttattcaacaaatatggagccaggtaggcactgtgttgttcctggagaacaagacggagaaagatggatggatggttaaatgaataaatgaatgaaagtgaggatgggaggaggggtggctgggaggatggatggatggatggatggatgatggttggatggatgaatgaaggatggatgagtaggtagatggatggaggcaaggatggatagagggatgaactgaagtataaatagagcaaatgatggactatagtagactttagtagactcccctgaaaacttcagtagactaccctgaaaagactttagtagactaccctgaaaacctaagcttggctcacgagatgaggtctaaaaatacatgcttacttaatttaagagccatgagctcagggttaaccaagttctatagcactatatttcaaacagatcattctctaaaaaagcatccagaggctgggctgtgtacccaatcaccatgatgatctctaaggtcattatttcatggttgagaaggatgctgtaagcctcagggaggtgctataaatcaggagtgctacagttcaatttcatcatgggtttaacaaggtaggcaggctaacctgagagttcaaccacatgttctctgagatcctttctaactcccagattctgaattcaatgccttagaacatgggtcacatgctcaaatgcctattaggggtaggaaagtggcataaattagtaagcggggtccagtttaaggaaatacaacattcaagttcaatttcaatttttgggatgcaatagagagtggtgggcactgtggcgaattggacagcacatgtctcatctgaagtgggcagcctctccttggctccagttgactatggccatatgggaagatgggcccagtcttgccagttttctgtattttgaagaaactggaacgtaaattttgaaacttcactgtaaaaatttaaaagactatttttgcaaaagaaaacacacctgtgggcctcgtgtggcctgcagcctgccattctacagtctctattttagaacatgatttctaaggagaaatgccctctaagtgccttagctcaagtcacaaagaatgtaaaacacaccccttgtttaagagaaggcaggtaccctgtggtaatgggttgaatgcactccagccaatttcttttctttcactcatttagtcttcacaacaaccctattttacattttatagataagaggcacagagaggttatataaattggacaaggtcatatagccaggaaatagtgatgctgggattcaagcaatctgtgtttttaactattctggtagtttgagttaatatatgccatgaattgagccgggcgcggtggctcatgcctgtaatcccagcactttgggaggccgaggcgggtggatcacgaggtcaagagatggagaccatcctggccaacatgctgaaaccctgtctctactaaaaatacaaaaaattagctgggcgtggtggcgcacgccgtagtcccagctacttgggaggctgaggcaggaaaatcgcttgaacctgggaggtggaggttgcagtgagccaagatcgcaccactgcactccagcctcgcgacagagcaagactctgtctaaaaacaaacaaacaaacaacaaacaacaacaaaaaaaaatatgccgtgaacttagactagtccccggagcaaaggaaacattttgtaacctttagctataattgttattgtttctaatgctcctactccccagcctgctctctgcagtgatggagaccatgttgaaatggatcctggatacctccctacccaacatggtaagtttgaaaagggaaactaggcagaccctttgcagctgaagtatggaggggtagccaagatgggagaggcagccatgccagttttattcctgggctctctaatctctcagagttttctttcctgtcctttttatgagtccctgatactgggcaaggcggagagaaagggacatttcatgagggacaactatataccaggtagtttacacctgtggaagatgaagatttgcattgtgttacaaattctgatagaatcatttaatctcatctgataaatttattcttcaaagagaaaggcatacagattttttcttatcaagagaattcagcatctgtttactggttacaatttgatcaatgagctttccaccagcaagttcattattacaaggttggtaaacaatcagcttcttctggcaaacatgggtttacaacttaaacaaacaatcgcaattccctacaacagcctaataaacgcagtgcctccatcacaaatatgtttggattaagggtataggttgcaatgcttgcaaaataacaagaattttttttttgaaaaagagcactgtgtcctgctgaccaggtttggattcctccaggagcagacactgaaacaagggtttgaatgcaagcagtttatttgggaggtagtcccaggaagtacaagtaggagagtgaggattagagacagggaagaggaggcagttcatatggtgtgatatcaagccagttaccattatgagcgctggagcttagtctccttggggaaacctggttcagtgcatggaacatgccttagaattaccccacccaagggtgaggaagctggggtatttatataccaactcccatcagtctttggttgagggctgctcctgggagcattgattccatggtacttccagcctatgcacaggcaggaaaagcaggttttggaggctccaatagacagatgcaagtgggagctggactcaagtggcaaaggaagggagtatggggaggtatgaacaatgttttcctgaccttcttagcaacccagccagaaatccaattttatgatgacaagctagagaataaatataaatttcacctaaagcatttaccccacctgaataaagctatttatccttggttctcttacactgttatgtgaatctccaacttactcccttatcttttaactaaaggtaataattagctcttaggatgcactcacaaaagcatcttgtcaagtctttttcttaaaagtttctcattaaaatgccatcacatctactgatttgtgcttctgttctttaaatttgtcaaacattgaattaatgcatttgaggcttatcagaatatcctataattggctgggcaccatggctcacggctttaatcccaacactttgggaggctaaaaagggcagatcacttgaggtcaggagttcaagaccagcctggccaacatggtcaaaccctgtctctactaaaaatataaaaatgagcctgtcgttgtgacaggtgcctgtaattccagctacttaggagggtgaggcaggagaatcacttgaactcgggaggcggagattgcagcgagctgagatcgcgccactgcactccagcctgggcaatagaacgagaccccatctcaaaaaaaaaaaaagaaaagaaaagagaatgctataataattaaatatttgaggcttataattttgtcgcccacatggccatgctatgaggtgtagactataattccttccatttttgagatgagaaaaaaggctcagagaggtggggtgacttgcccaaggacactatataagtgttagctgttatcattgctaaatagttcattgctgagtggagctcaaactgattaaaacattggttctcaactcaaggcaagtttgcatgccaaggggtgttggcagcatctggagacatttttggttgtcacaactaggggagtgctcctggcatctagtgggtagaagccagggatgctggtaaaaatcctacagggcacaggacagccacgcatgacagagaatgatctggtccaaaatgtcaatagtgccaacactgagaagccctgaatgaaatggttgatgttgatggtggtaatgtgatgatatttctatcatgcagaaaatggcagagctcagactggattagattgatttagtcccttgatggggacctggaggcccatggagagataggatctatctagggtcacacagccaggtggagacagctgggctgcaagggtagcccaaggctcctctcaccgagatctctgttcctctgtatttcagctgtgcccagtggtccagttctggttctacattatctatcaacagttgaacgttctgaaaagtgagttgtgccgatggcttgagaccaaatctgtttagaccgttgcatacccccttcccccactcctgctttctccccttcatggctgccagagagatttttctggatcacatctctgatcaaaatcttctgcagatgaccaggaggatcaagggcacacccccaaggctggcagttgagatctctcctgcaactgctccatccagccttagtcttgtctttcttcttgctgctccagctggttggcctcagccacccccatacatgccagccccttttgagacacaatggctttgctcttggagacttcctacaccctctttctgtgcctggaaaactcttttaccccttcaaggtgtgactcccatgatttgtccttccaaaacctttgcagatctctccaggcagaaggactccctcctgaggacttctgcaggactgtgcacacccatctggtattcatcatatagcttagtaactctctgtttcttggctgtgtctttaatctagaccagaagcttgttaagggttgagactttgttgtactctctcttgtatttgtctcatagtccttgctgggcacagagtagacccaccatgtcaactttgttggcataggaactggagatgaaaggaagaaatgtggatggacagaagtatgaatgaatgataaaatagaaaaatgaaaagatgaatggaagaatgtatggatagaagggtggatgagtgatatttaaatagaaggaagtatggatgtgaaatgatggatggagaacaaaggaagggagggagagaaggagggagggagggagagaggaagaaagggagggagagagggagggagggaggaagggagggagggaggaaggaaagaaggaaggaaggaaggcaggcaacttggataaaaggtgaagaatatgtggatggatggatgggagaagcaaagggagaaagttggagaaaagtatggaaagagaaggaaagaaggaaggttgaataggaggatgaatggattaaagtgtacataaatggtggttggagaggtgagtgaatgaatgaaggaaagatttattactggatgtgtgggaagatgaatggtggctaggtggatggataaataatagatggattaatgaatgggtgaaggaagaaaaaagctatagagatggatgaatgaaaaagaaggaagaaaaaaaggaaaacttggtggctgggtggatggatgggaagatgtgtagaaagatgctggttaggcaggcagtaaggagagcttcatggctggacaaggaagagagatggattacaacatgccaagttgagaacgctccactgtctgagccagaagacagtgggctttatagctgcaatgtaacagtttgggaataatctccgtctcctgcataaatctatggatgacaagggaaaatgaatgagcttcataagtctccacctcagttgacttatctcttatgtttctcttgtccgcccttcccgtcgccccctgtctccctctgtctccatcagatgtccacttactcagattatttagggaccacctctcacctctctcccaaatacccctgttgtctcagcagtatcactgcctggagtttcaggtaggagcagctgcttctctcctaaggaatgttctgggattcgcctctgagattttcttcacatctgaaactagctcaatggtgccccatcactcacttgagtctcccaagcaaatgtgcccacagctgtccccttaaaagagggagtatgtgccatggcttcagagccaggcaggctctgcttctgcttgactgtgcaaccctgggcaaatccctttacctttctaagcctcggtttcttcctctatcaggtgaggatgattagcattccccatataaagctaattcatcacttgcaagacgtgcattttccttacattgtaaatatcttaaattggaatgcattgtatattcaatggcatttcataatttaattggcaatttaaaaatttcttagtggcacattaaataatgcatatcttaatcaatggtattctagtgtgtgtggaatataatatgatgattagatgagaacatgcttggttatttacctagcacagcctaggagctcaaacactagtggtttattcctctttacctttattattattattttttgtatttatttatttttgagactgagtctcgctctgtcacccaggctggagtgatgcaatcatggctcactgcaacctccacctcccaggttcaagtgattctcctgcctgagcctcccgagtagctgggattacaggcacgcgccaccacacccggctaatttttgtatttttagtagagacagtgtttcaccatgttggccaggctggtctcgaactcctgacgtcaggtgatctgcctgcctcggcctcccaaagtgctgggattacaggcgtaagccaccatgcccaacctgcccttagtttaaaatattaaattaagtgagttacttggcatcacaatattcgggggttttaagtccatgatgggcctgcatccctttcctctcagcttctcccaagccttagcataatcctgccggcccctctaactcacagaaattcttgaattacagagaatgtgttttgttccacaaagtagaaccttcagggatcttggggcagagccatctctgagtctcctttccttgtccataattcttatattgcaaggttgttgtgaggattaaatgagaggcacatagtctagcatacaataggtgctcaactaatgtgggctatctggttttttccccaggacaaatacttcccaggctctttcattaactggctgcttgaaagtaagttttgttttctcatatccaccccactgtctcccagtcctgcctccctcttcagggcaggacagtccttcctcaaacattggtgtaaaaccgtaggacctcagagcacctacctgacacagaatttgtgccctgatcaatagcaccaaagcagggtttctgaatagtcaatttcatggtgaccagtgttgcagtgtggttcctgagatagcccactccactatgattactgttacaatgcattctagggccatcctattccgtagtgattcttgttattgagggatctctggagtgtccatcccatagtggccagtgttaggttcgtgggatagcccactctacagtgatcagtgttagggtgggtctcctgaactgacctactgcgcagtgaagggttttatcatgagcttcctgtgatcacgcactccaggatgactagtcttctggtgaaattgctgaaatttcccattccataatgatcagtgctgtgggattcctgggatagcctgccccacagggaagactattatagtgaaattcctaaaatatttcactactgtggtctgttattgaaataactgactccgtaaagaaggcattaccatcggactcaggactagccccttcccttggtgttaaagtgaaacgttatggttattacggttttggtgttatagctacgttcctgggctatgccactttttggtgaagaatgcagggctggaattcctgggatagcccactgctctattgtgagaagctttccagaactgatttctgagtctggaggaatttttaaaaaatcactgtgctttcattacatttcccaaatctcctatgcttactgctgaggcaagagcggagggaggtaggcaaagaaggagagttgtcctggaccaaacttctggactaactgccgttatagggtgccttgtgccacttctcagtttctcaccgaggctgggcaccaggcaggaggcaggagaaaagatgggacactcctctcccccaagcaggcggggaagcctattgttcccctggggagacagggaagcttttaagccctcttgctgtttctctgggacttctccaacattatggtgaaagccagaaaaggtgagcagaaacagccctaagccaggcatcctgagacctaggttttaagacccagttcagacactaactctctgggagaacttatgccagccccaccctctctctgggcctctctcctctcatctgtaaagtgtgccgagtctccaaaggcctttctttcaataagaatgttgggaaggtgaaaagcagggcaaaaccttggccgcaacaagtctttctcatggtggcgtcttctaatgtcttctgtgctgtcggttgcagtgacccctcagtcttcctatttctaggatgagcatgggaccccgccaagactatggtaaggatgttcaaacgctggagcatcactgtgggactcccctctaagtggctgtgaccttgatctacccaccaatgatttcccgcagccaaaccacaaatagttccttcattagagcttatgtttggatatgcccaaagctgataagctgggaaatttcccaagggaaggtaattcagcatggagctgatggaggtagaagagcctctaagaagcagactaaaggaatggtgcctgacaggggaagggaagtgaatgccccttccacttcagacagatggtcggatttatagcttaggatttgagtattcttgaggaccatctgaagctgatgagatgttccatccagcaggtcaatggccttgcagtaagatgtatgaagccaggttacaagcctgactttaagtctgttagaactaaaggaagtagaggccaggcatagtggctcctgcctataatcacagcactccaggagcctgaggcaggaggatcgcttgagcccaagagtttgaggccagcctgggcaacatggtgacatcctatctctacagaaaatacaaaaattagctgggtgtggtggtgtgtgcctgaagtcccagctacttgggaggctgaggtgggaggatggcctgagcctggggaggtcaaggctgcagtgagccatgattgcaccactgcactgcagcttgggtgacaaagcaagaccctgtctcaaaaaaaaaaaaaaaaaaaaaagacctgaaggaaattggtgctaaatgtaaagttacctggaacccttggactgtctgcatttccaattaaccacatctctgcactctgctttcctctcctgcataagcaaggtgctcccaagccactttctcaatgagtaaggttcactttaggatctgccaagggaaataaagtaaagaatgccaagattatatacatttagaattccagaaggtcagaatcttggccttagagatcctgggaactccaagaccttggcaatgggtgggaatgagcagaggtgctggacctgctgggtccacaggattgaagccctgcatcctttaattgcatgaaactctcatgatgcagtagtgtgttgggaactgggtggcccctgtcatggctttttggtgtggcagtgaaagggacaggctttagggtcaggtagacctaagttcaaattccacccttccaatgactcggaatctcaggttcctcttccacaaaatgagagtgagaatggcacctattttataggaaaattgtgagaaaatgcatgaagaaagcctatgctcagagcctgggtgacagcgtgagatgctgtctcaaaaacagaaaagaaaaagaaaaagaatgaaaggaaatgagcgctaaatgtaaagttacctggaaccattgcatttccagttaaccacatctctgcactctacctttcctccagagaaccagagggtggtaaagcagctctacctcaaacaccccaatccctgtggtactaatgggggaaacagaccagaagggcatggaagactcagcgaagacactgtagggtgccccctgcctgaggctccggtcacctctcccctcctgcagctcctgcctgctgtcaagaggacctgggtgtgaagcccagctctgcatccttccagctgtgcagaagtgggccaggcacctcacctcactgggcctcagtttccttgactgttaaacaaatatgaccactggcagattgtctaaacaccaccaggcagaggggacaggcagcttgagctaaggtgtggagtggggaaccgcaaggggctgtgagaacccacaatcacactctctgcctctccctgttccccgtagacaagcacagtgacagaagctggacactgcctgtccttccacgtctctcccgctgctggccacacacagggagcagcaggtatggcctgggcaccggcagggctcccaggcggagggattggggtgagagcaggcacagttctcagattttgccacaaggtagagttgtgaccctgctactccatgtttctcatacctgttagaatttaaggatatttgcataatgcagcattttatttttatttttattttttatgccaggcactgtgctgggcatttggctttcaggatcgcatgtgattttcatagccacctctcaaggtcagcagtatcattatctctattttagagatgaggagactgaggttcaaagtggtgatgggactgcatggatggactggggagtctgactggggagtcagaattcggctcaaatcccagctcttcagcctatcaggacacataacctctcgtgcctcaggctccaaaggggaaaaatggggccaatgatagcaataatattttgaatagaccttagctctttgtggattgtttatcctatgcccagccatggatcatttcattccgccctttaccccccttaagaggcagctgttgatacatattcattctgcagatgaggaaactgaggcccagtgaggttagctgctgcctggcccacttctacacagctggaaggaggcagagctgggcttcacacctagatcctctggcagcgagcaggagctgcaggaggtggtgggtgtctggggcctggagcaggggggaccctactgtgtcttggctgagtctcccatgccctctggcctcagtttcaccactgataccacagggattgggatgtttgaagtggagtgccttcacggtcccctggttctctggagaaaaatgcagtgcaacagccaagaagccatatccaggaggctcctggagttgcgggggtggaccctgcagcaagaagagggccctcagctcctgggtgtctccccatgccccagccaaagccacccagagctcagtccacactgggcctccctagtgtcacttgggtgcatggctgatgacacatatgaccatgtttgttttctcaaccttttcgtcaggaccgcctttgtgaacaacctgagggccctgcaggctgcggggagagtcacgtggagcctgagggtggcacaaggaaggcagagaagaagcaagtggagctggccttcagggttcctgagtctccacaggcccagggcacctgttcttggtccagcaataaatgctcagatggatggcgaggacttgggtcaccacaggatccactatgggaggctcctgggaaatatcaccatcacgacattcattctttcaggcagtaagcatagccaggtcccatttgatatgaatctgacctgcaaatctgcaacagtgtcctgcaacatattaagttttacatggtgaccagaaagttaaataaaacatcccctccccccaccttttccattgttaagaacacacacctaacttgctcaagtccctcccttctcaggaagaataaaggtcccttctgtaattccacactccctccaccaacctccttccctctctcgtcccttcgcagccaaagttccttagagctgtgcttctccaccttgaacacacaaatgagccacctgggctcttgttaagatgcaggttctagagcagttggtctgaactagggagaggccagcggtccatgggccaccctttgagcagcatgcttattttggatacatccaccccaccacccatcttgtttccactggttgccccaccaaactcggccttaccaggtcctccgtgatcaccaggtagaggaagtcaatggatcatagatgaggtcagcctcatcttgaccatagcacacataccacttcctcctccatgaatccagttcttcccttggccttactcccctggctctcctcctcctcctcctctgaccattctacctctgcctctttgcagatgtaatattttcaaatcggccaaccagtggcttccttcaccctggccactttggttggttcattgctccgcatgtaaccccagcaggaccaatgggaatcagtcctagaacttgtgaagagatattaggaaagacatactttcttctgctagactattaagagagaatgtggacctgaatctgttggtggccatctctgccacctctttggggaagtcagtttgaggagaaaccccaagccaagtcatggaaagaaacaaaggcctggagatttcttttgagcacctagattcagccatgcctgaaacccgttggcctgctagttacatgagccaatgactttctttcacatctaagtcactttgggttgtgttttcaattacaaatataacccaaagaatcctgacaaatgcaactgacaaacatttcagtttattggcaagccatggtgggaaaccagagatgaaccccagagagaacttggcctcctggagttgacaatggagaagagacagctgtgggtgtgtaggcaaggaagacacctgttcaaaaatgacaaggcagaacgtgagaaaaggtcagctgggtggctcaatgaaggctttatataagaggtgcttgcaggatggggagaatttgcaggggggtgacatcctcagacctggcccttggcactgggaagagttgatgcaaagaaattctgcgaggccagagaggaggctttgggaattgtccagcagaaacagagaagtctgaggtggtaagccaagaccccacagaaacaagtccttcgagggtcccggacgaaaagacaaggagctatggtacttctcccatggttttgatttttttgtttttttgagatggggtctcgctccgtcgccgaggttggagtacaatggtgagatcttggctcacttcaacctctgcttcccgggttcaaatgattcccctgcctcagcctcccgagtagctgggactacaggcacctgccaccacacccggctaatttttgtattttcagtagagacgggatttcaccatgttggccaggctggtcttgaactcctgacctcaggtgatccacccgccttggcctcccaaagtgctggaattacaggcatgagccactgtgcccagcctctcccatggtttttattcccccttttgattgagtggccaccacacgatgctccaggattctgcattccccctttaatttaatgcctccccagtccctactagccaggattagcaccgattttagagagcagaagacactgtctcagacagcggccatgccttgcctaacatcacacagctggccagtggcggaatctagaatgaggctctgccctctttcccacccttaatcctgccgctgggcacagcacttctgagttatctttactgagcacttatgatgtgcccgacactgggctaactcttttccaggcttaagtcccagatcagctatgtcaggcagatgatcatggtcaccattttgcaaatgaggaaatgcaggcccagagaggcaatgccaccattccagagtcacacagctagaaagcagcagggttaggacccaaattgaggtctggctggttacccaaagcccctgcaagataaatatacccagacttagccacgttttggaatcctcccatcatttgtcttctacatgatctgtctccacctaccccacagtgtcatagcacttcctctttcactcccaaagtgctaacttcgaccccattcagtgcttaaaggaaggaccttcaccagggctgggcactgtgccagggacagcagctccccatttgcttggggccatcaatgcacagaaaatttgcaagaactgtacctgctttgtggaaagtaattgtcagtgtgcgtgttggcctctgcccctgctggtggggtctaaggatggacacatgtgggggtgctctgtggggcccagagccccacacaggacaggacccaggtgagacgctctgtaagtgtgtgacgaatgaatgaatgacaggatgggtgggtggagggaaggaaggactcttcttgtgattctgggtctcatctacattcatctattcagtctgtggattaacttgcttttctcactttaattaattgtggtatttattgggatccaccaaaagccaggccccaggctggctgctgaggacacacagatggcagaatcatgatccccaaccttaaggagccccagtccagcggaggagaaagggctaacccacaacccttcaaccagtaagcttttatgaagggatttctctgacacaggcttggggctgggggtgctagcgcaatggagatgaatcgaaaggacccacacagcccagggaggattccgactgttagaatataaatggcagtgctgccgggcacggtggctcatgcctgtaatcccagcactttgggaggctaaggcaggcggattacttgaagtcaggagtttgagaccagcctggccaaaaggtaaaaccccgtctctactaaaaatacaaaaattagcagggtgtggtggtgcatgcttgtaatcccagctactcgggcggctgaggcaggagaatcacttgaatccgggaggtggaggttgcggtgagccgagatggactttgtttaaaatatatatatatatatatgtacagtataaatggcagtgcactgtgagtagctcagagcatggactccggagccaggttttctgagttcaagccccagctctgccacttactaggtgtgtgaccttaggcagtacacattacctctctgtgcctcagtttccttgtttataaaatgggaataagacagtccctgcctctggttgctgggaggagtaaatggagagaatatgccttcttgccagacatgggccgatcgaatcagctcacctactgccctggagttggcctgtctctgggacaaggactgagcttcagacatctttgaccccatcacagggcttggggtgcccactaaagggttgtcaaaagcatgagtggctccagcagaaaataatttgcacttgtaaagtgaatgaacaataaataaatggacagatgactagatacagggccaggcccactttagcagggaggatctggaagatgagagagggcacagagagattgaggggccaaattccagggagtgaggtgagaacagggagcgacccagagagctcgctcatgtcaagaggcccacccacctggggaagacagaaagtcaatgcccatgaggggaaccagaccctgtgctgggtactgggacctcggagatgctgtggtcttgccctcagagagtgggactggcgagacgtggctgacctccctccctcccttcttctcttccttttctcctccctttcttcttctctctccacatcccctctctctctttctttctttctttctttcttccttccctctctcctttcctgcctttcttccctccctccttccctctctttccttctttccctccctctctctttccttcctctctcttttttcctccttctctctctctctttttcctttctttcctgccacaaacatcatttgactcctgctgtagaccagaccctgtgccagctctgggggaacgaaggtgaacgaagacaaggtgcccagacttcaaaggacccaggggaggaccctgacccggtgaaaactcctttaaattttctctgggagtgttggatgaagcattcagggaacattccatgggacaggaggaagaagactccagcctgcagtggggcaaggccccctccatctgtcagtccataggaagtggctctccatattctaaaggcaggacttgagaggggtctattagtgtccagatgtggaatccgggacttagggaaatacttgagcgctgaaagaataaactgtgtcaccagaagaaaacccggcaaagtcaaaattaccaaaagttgaattaaaggtcttcagactgtaacattgtgacaactttattaattgctctatttagcagtcacaggaaggacagtaacgtgtgaacaggttttgttgctttgatctttcttatttgcccagaattcctgagtaggcagttcaagtgtgagaaaccaggacctactagaaattggatggatgattcgtacttgactgatttcacaggcaaaatggtgacaagcctttcagcaattttactagcaaaataaggcaattatctttgatgggtgcaatgggagtgcacacctgtgtgtttgttatctggagaaggggtgggggctgcttctgtccacaggagaaggaaggtcagtgggcagtctggtcagctgagcaccccccagcctggctggcccctcatgcaaccccagccctgtcactcgctttctctggtctcagtaggctgcatgacctcttaggctgtttctagccagggcactgagccaggtatggaaaaagataccagcttggaggttaaggctgggccagtgggatcaggaagctgccccagctggggattagcagtcacgcagcaggtaggatgtcctagtcttggcacagctaatctttaatgcctcactgggaattttcaataagaaattcatctcgcgaccctcatggctggggcctttgtccctaagaggcaaacatcttctatgtgagaagactttgtgtaacctggagagggaagaagaggaggaggaggagcacacaggaggagttgtcactgtttctttttccggaatgactcagaccagccagcctgaacctcgggtgacctctgaggatcccaacctccccacccaccaaggaccctatattatatattatataatattaatcttatgacagatgctcctcattttattttatttttgtttgtttgtttgagacggagtttcgctcttttgcccaggctatagtgaagtggcacaatcttggctcactgcaacatccaccccctgggttcaagtaattcttctgcttcagcctccagagtagctgggattacagatgcctgcccccacacccggctagattttgtatttttagtagagacagggtttcaccatgttggccaggctggtctcgaactcctgacctcaggtgatctgcccgcctcggcctcccaaagtgctgggattacaggtgtgaaccaccatgcctggccagatggtcctcattttataatgggttgtgtcccagtaaacccatagtaaagttgaaatattgaagtcaaaccatcgtaagccgggaccatatgcgcacatattcatcagcatcttcttcgccatctttgctgttgccgtgcatcatgggcctaccctatgctaagccttcatgggtattacactaatttgacctcacagcatgcccttgaggtgagcactgttcttagtcccatttcacagataaagagcctgaggctcagcaaggtgcggtctctggcccaggtcacatggccagcaaccagcagagagagagtattcatgcccaggacagcccaagcccagtgccaggctctgagcactgccctcaaagcccctcaccatcgttttgatttcctaggtccttgcctgtccaccatgcctctgagatccaggaacagcgtgtttacccattttacagatgaggcaactgaggcctgggccaacaccaggtctcgaggtcactgcatcatgctcagcaccctgggctatgttcctgggctgggacaaactgccttcacaagatttcagcacagcccttggctctgtgcttcacaactgggggaagagcggggctcagacgtttggagaacccggtgtcaggcagccagggaaggaggtgtgacaaccattcaagaccacaggcaagactgcagcaggggtctaatggtctgggctcttggggcctggccatcaccttcctgcagccgcccagctctgtgctgtaacagtggagccatggtcagtgtaggaacagccagctcctggagccactggtcttgtcccaccgtttgcttggttgcatcattttgaggacaggccccccaggtccttgctgaattgcaggtgggtgagcagaagggcagagacctatggtgaccctgagctctgtgccagtccttcccagcctgaggccaagtgggcacccacccgagtttcctgtgctgttccgggttgacacaggcccaatgcagcaggcgttacaaccaacccaaacatcagtggccgaagcaaaaacaggatactcaggcccagggactctccctctctgctaactgacctcagcctgatatgggtggaagggtcttccctggtggcccaaatgcctggttcctgtccttgcaagtatggacaagccacctccctctctgaacttcagctttctcaactggaaaatggagctctgaaaacctgccttacagagttttcataaagactaacagaaaagtgcatctaaagtgccctttagggacaccaagcccagtgtcagcacaagcagctgccaggcatctgctgcacctgccgggtgcagacccctgggggcaggacccctgggaggctgtctgactccttgtgggccacaattctagacccatctcggtccctgtcttgctgaatgaccccaggctggtggcttcccctctctgagcctcagtttccaaatgatgacggagttagaccggatggtcattatgggtcctcctgccaggacattctccaattcattcattctcagtcttctcccagtcctcacccacaaggaccaaggaccaccccctcggtagctgcaggctccatgaggacctggtcttagtcttggcggaaagccctctccatagccatccgtttcaattcaagcatcctgggtgacctttgagttggaaatctctctctctgctcatcctggagaggggttattttccttggagtgtccttggatgatcccagaaccaaggcttgcttctgtgggcagccttccatcccatctccaccatataatagccgccaccattcagcagaatcccagcagactgtgcagtggggcaaggatttcatgagcatcctcctctaaacgcgtgagtggcgtgctccccccagtggcaccacacgtggtggtctttggaaggctttgggggcaagaggcagaggggtgggattgcttgggttagctaatattttgaatacagcagagataatcaatatatctctaaatgtgctctaaatggcaagttcgtgatgagtactcactaaagattccatttccctctgggcaattcttactcctgttcttcccatgactgtccaggtgtcaagacaaatggcaaatcagagtaaatttagagatctatagattatattaaaataagtgtcaaactaatgaacaatgcagggtcatgaggtggtctccattgatttgttcatacttatattcaacaaagatttattcgtttactgtactgtactaggtgcaggctttttactggcgcctgaggattcgacagtgaaataagtcacagtccttcctctaaggagttcacagcctggtaggaaaggtggtcaaatcatcagggaagtgttatccaagaccttgatcaggataatgaaggcagcaaggtgggactcctccaacctagaatctgggaaggggcctacagtaggcttcacagagggcatgatgtaggaattgacctaagtggaaaagtaaagaagaagaaaaatattttaggcagagaagacagcgtatgaaaaggaactttgtgtcaagagtatgggcttggagtcaagtctgacttttcaaatcccagctcctctgctcactgactgtgtgtctccgggcaagttgctgtagctttctgaccttggctgcccatttgtaaaataggaaataaccacatctatcttaatggaatgctaaatgttaagagtgatgggaactcactgaagagtccatttccctctgggcaattctcactcctgttcttcccatgactgtccaggtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggtaaatcaacaagggtgatgaacagtgtcacctaaattagcctcctaaacactatgcctgcattaccagaggctgccaccaggggctactctttatgggcggtttactgagaaaagtggctattcaattcctgactcattcgtttatctttctagaaacaagcaatgccacaatgaatagccttttacatattatatcctgataaacgtgcataagataaattcctacaagtgggatttcaaaagttcaaaaactatgctgttgacaaataatctcctatgttaacactttctccaacagtctacgaaagtgccttttttcccactccttttccagcactgggtatggacaactttaaatattctgcctgtctcacagatgaaaagctataacttatttcactttgcattcctctaattatgaaggagccctcttcttttttcatatatttactatgtacttacatattttaacttgaggattttgtctatattcttagcatatttttcttttgggttgtttaatattcttttatggacttgtgttaattcagtgaaaattaaggaaattatccctacctagccttggtatctgtaaagctacctacctttatatttatttatacctcctttttatgctaacctattaaaataacttggctttctttttgttttatggaaacattagcagcacatcaaaaacagtttttgtaggaggaggtaacttctgcaaatggctgcctttcaaaccttgtcaagggcttaggtaactttcaaagatgcagaaaggactcacactctaatttcacagctgagaaaactgaggcccagagacagaaatgtctaaaccaaagtcacctcgtgaattatacgattagacgtagttatatcaccaattttatttaaagtgtcattctctgaatcattataactaggtagatattgtccattacagagccaagttacaatattatgattacatctcttttcttatacggtatagtcttttgtttttccttaagttagtaattgccctgttgtttctcacttgaattattttcttctcatatatacttaattattttcatgagcatcatcctgtatctatcatgacatttattattttttgagacaaggtctcactctgtcacccaagctagagtacactgccagcctcaacctcctgggctcaactgatcctctcacctcagcctccccagtagccgggactacaggtgcacaccaccacacctggctaagttttacattttttgtagcggtggagtctcaccattttgcccaggctggtctcgaactcccggcctcaagtgatcctcctgccttggcctcccgaagtactgggattacaggcgtgagccaccacacccagtcacgacatttattcccatccccctgttctccagagacctatcataaagacactttgtcctcctcctcctataagaattattgctttcttttggtgcaactgcttttggtgtcatgaagtctttgcccgtgcctatgtcctgaatggtattgcccaggttttttatggttttgggttttacatttaagtatttaaaccatcttgagttaagtttttaataaggtgtaaggaagggatccagttccagttttctgcatacatctagccagttttcccagcaccatttattaaatacagaatcctttccccactgcttgtttttgtcaggtttgttgaagatcagatggttgtagacatgtggtgttatttctgaagtttctgttctgttccattggtctatatgtctgttttggtaccagtaccatgctgttttgcttactgtatccttgtagtatagtttgaagccaggtagcatgatgtctccagctttgttctttttgcttaggattgtcttgctatatgtgctctttttttggttccatatgaaatttaaagtagtttttttttctaattctgtgaagaaagtcaatggtagtttgatgggaatagcagtgaatctataaattactttgggcagtatggccattttcatgatattgtttcttcctatccgtgagcatggaaaattaacaaatgggatctaattaaactgaaaagcttctgcacagcaaaagaaactggcattagagtgaacaggcaacctacagaaggggagatcatttttgcaatctatctatctgacaaaggtctaatatccggaatctacaaggaacttaaacaaatttacaagaaaaaaacaaacaaccctatcagaaagtgtgcaaaggatatgaacagacacttctcaaaagaagacatttatgtggccaacaaacatatgaaaaaaagctcatcatcactgatcattagagaaatgcaaatcaaaaccacaatgagataccatctcacaccagtaagaatggcaattattaaaaagtcaggaaacaatagatgttggcaaggctgtagagaaataggaacacttttgccctgttggtgggactgtaaattagttcaaccattgaggaagacagtgtggtgattcctcaaggatctagaaccagaaataccatttgacccagcaatcccattactgggtatatccccagaggaatataaaacattctactataaagacacatgtacacatatgtttattgcagcactatttacaatagcaaagacatggaaccaacccaaatgcccatcaatgatagactggataaagaaaatgtggtacatatacaccatggaatactatgcagccataaaaaagaatgagatcatgtcctctgcagggacatggatgaagccagaagccatcatcctcagcaaactaacacaggaacagaaaaccaaacactgcatgttctcattcatgaatgggagtttaatgatgagaacacatggatgcagggaggggaacaacacacactggggccatttgggggcttgggggcaaggtgggggagagaattaggacaaatacctaatgcaggtggggcttaaaacctagatgacgggttgataggtgcggcaaactaccatggcacatgtatacctatgtaacaaacctgcacattctgcacatgtatcccggaacttaaagttaaaaaaaaaaaattattattattgctctgtggacctgctggaaagctgtcattctgggactctcgttttccagtttcatggattggagccattttttctcctggattctagatttttcatttcttgagtgtattctctcattctttctagtttttcaaactcacgtgagcatctcacttagcacaatggacccctaagtcactcctagacactggtgtacaatcaatagcaattgcctggccaactggttgattgcactgttgataaataatcagtatatattattaatagtacggaggcagtatggaggaaacaagagttccctggctgtgtggctagacacgtttcttaaccatctagagcctttatttccttagctataaaaaagcagacagtgacaatatctacttcactgagttgttataaagattaaatgaaataacataggcaaacagtcttacccggtacctggagcatcgtagctacttcgtaagtggtgcgtgacacaaaatggcgattgtttttggcaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggtgagttggtccttcagggtggagatctttgctctaaggaaagggaaaacatatctttgaggaggtaagtttaagatgaaagacagatggacaagcctcattcccctcccacagagccaaggtggtctgagcaaggccagacccaccagagcttgagtaaattagaggcagggctacagagtcaatccgggcatcttatgggttcgggcttccgctttctttaatttcagggtcagggtgaaggttatatttatccttacctctacccatttgctggtacacaaagtccctttccaaggaataaaacttcccttttccatatataactgggggtaaaagcccagatccccttaggggaagggaactggagtcttcgccacataaccccaggcagtggatccactcacatacttttattattattattgttattattattattttttgagatggagtttcactcttgttacccaggctggagtgcaatggcacaatcttggctcactacagcctcgcctcctgggttcaagcgattctcctgcctcagcctcctgagtagctgggattagaggcatgcaccaccacgcccggctaattttgtatatttagtagacacagggtttctccatgttggtcaggctggtctcgaactcccgacctcaggagatctgcctgccttggcctcccaaagtgctgggattacaggcgtgagtcaccgtgcccggtcccactcatgaacttttaaagtcagatagttctggcctcaaaatctgcctctggcacttactcccctaggaatctgggggaaaatcacaccagcctgagcctcagtgtgctgtgccataaaatacagagaatcaaacctctgaacagggctatagtgaagactaaagaaggcaaggctgacgagacccaaacgctcagctcgaggctggcccagggaagtggttggcaagtggctgtcatgaggagtgacaagggtgaattgtgggtttcacacaggttgaaaatcagcaactccctcatcctggatgtcaaagctgaaccgatcgatgatggcaaaggccttaacctgagcttccctgtcaccgcgaatgtcactgtggccgggtgagtatgcactagaatctgagatttgggaaaggcagtgcaacctggccgatggatgcccaacctgggaatcgggcacctcctcccgctgctgggtgaacttgggcctcagtttcccaatctgtgagtgagagaacccttctgggtctaagatcttaacccttaaaatgttctagagaactctggccataagcaagtgtcttttaaaaacaatgctccattgaatatagttttgaaatcatgacatttatctggttttaaaatttgaaaagttgagataacaaacatttatcattctttggcaaaatttcctccagcattattttgtccctcaagattctctctaagttgcagtgaccactacagaaaaattcatacaataatacacagtgtataataaagtgtgtgtgtgcaaaatataagtttaaactcttttaagtttagctgggagtggtggcttatacctgtaatcccagcaatttgagaaactgaggtgggaggattgcttgagctcaggagttcgtgaccagccaggacaatatgacaaaaccctgtctctacaaaaaatacaaaaattaaccaggtgtggcagcacacgcctgtagtcccagctacttgggaggctgaggcaagaggattgcttgagccggagaggtcgaggctgcagtgagccgtgattgcaccactgcattccagcctgggcgacagagtgagaccctgtctcacaaaaaataaaaaattttaattttaaaggagatagacaagaaatgagcatgtgtgaaagcacttctgtaaactacatgcactaatgatgccacccattatttagctatgagatcttgggatagttacttaacctctctgtaccaaggtttcctcattcagaaaatagggatagtaataaatgaatccaggtaaaatacttttttaaagtacctacacataaattgttgtcaataaatgttaactattattattttacttattagtgtaatgttgtataaaaaattcatatgagctaaacccaagtggccaggagaagaagcccctaatataaacatgtaaatctcatagaggatatggaccatgttgatattacctgggccatgttgacattacacatagacattctgactcatgtccacacaggtggaggaacccaactgggcaacaggcaggaacttctagactttgttcactgtgcatcttacttcctgcaggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaagtaagtcccattcatcttagtagagctgggctctcagggaacttgaggacccctaatttcagctctagtcctctacctaagaggaggcctagtggtgaaagtgttcaggctctggagtcatgttgaccttggtttacacatcagctctgccactaacttgtaactttatcaccaacttgacccaggcctgttttcacatctgtaaactgggggtgttcataataactactcataggcttctgagatgaccagatgagaaaatacaaatatttagcacgcagcctggaacatgctgcctctctgcctgctggttctctccattactgagactggagtgttgagctccccaccataatcatggatttgttcatttcgcctttcaactcggtcagtttctgcttcataccctttggagctctgttgttaggtgcatgcacattaggattgttatgacttcttggagaattgtccactttattgttatgtaatgtccctcaataataataataataataacgataaaattatatttaccttcttgcctccagttgggagggagaggggagagtaagtgcctgccacgggctctaatttcagattgtccccaaatcatcctccacccagtggaaatttcctgaaaggagatcttgaaaacttaatcctctccatttgactcactgatcccttttaatccacaaaatctacatcttaagctctgtgcctgaaagagcaggtttgactcaggcaagagggtggaaggagaaagagtgatgctggccgatggctgggagaggatgaatgacccagaagctgagggctggggctacttggccttggccaggagcaaggctgggtcctcagctctcagcccctgtggccatgagcagaggacactccactcgccctgcactgagggatctgaacacaggttgctcaaagacccctgaaaaccaaagaaagtttccatagcctgatgtgagttgcgaaggccggggtgtaaattcagaggctggagcctggctgggtgctatcttcccaagtagcctcagggacgccatcctgctgcactaggtctgtgcccacatctgtgagatggcaccactctgaggctccagatcctcccagggtctttctttgcacttgtggttcaatcccaagtgctccccatggtcatgaaggctctgtttgatctggccccacccttgtatccctgtaccctccccttactcactgtgcccagatacagtggcctttgtgccatgtctcagataggctgtttctcaaggctctttcccagcttaagacctttgcctggggtgctctggctacctagagcaccttcttctcactccactttgatggacttttgcatccttcagggccttcccagggctcctcctattctctctcgtaagagtctaactcttgcctttaaagcactcgtcacaagttctcaatatatatttaattgtatgttcacttctttcattctttcagccaaaaatgtattgaggctgggcacgatggctccacaccggtaatcccagcactttgggaggctgaggtgggtggatcacttgaggtcaggagttcaagaccagcttggccaacatggcaaaatcctgtctctactaaaaatacaaaaattagccgggggtggtggcggtttcctgtaatcccagctactcgggacgctgaggcacaagcattgcttgaacccaggaggcagaggttgcagtgagccgagatcgtgccactgcactccagtctgggtgacagagcaagacattgtctcaaaaaaaaaaaaaaaagtgtattgagcatctgctgtgtgccaggcaggcaccattctgggctctggagaactgattggtgatgacagacaaggtccctgttcttgcggagcttacccaagggaaagctaagctgccgtggatctgtgtccacatctgtgaaatgacaccactctacagctccaaatcctctcagcgcttttctttgcactttggatccaatccaacccaaattcagtccatcggtaaagaacgctccagggaaatgagtcctgcagaaagcattacccttaactgggcactgtgatagcaaagctctctcttaggtaagcagtcagggaggggtgccctgaggaggtggcaattatactaagagttgaaggtgggaggagccaactttggcaagatttgtttaggtaccacatcagggtatgtttggacccttaatgtttaggtaccaggttaggggatgtttgtactttacttattcggtatcctcagggcccagctaggttcctggtgcatagctggtgctctgtaaatacgggttgaatgagtgaacgaataaggtctctgcgctgagaatctcatgaggcactggggtgagccgctggtcagatgtgggagtctaagtgatgatccatgtggatgggaggctctgtctgttaaagtgtctccatgtccctggggtttatctgactccacagtatttcccgcaccgcccccaactttttggcagttctcccatctcttgcccacttgaccagactttaatagttccctgtgttttccagacacagccaaatcatcaacaagttcgtgaatagcgtgatcaacacgctgaaaagcactgtatcctccctgctgcagaaggaggtgagtctcccactccttggagcccagatccaggcctggtgggggcaggtgggggaatttgcaggcctggctgtatcctctgagcacttttccttcggaggtgaaagcttctccttaggaggtcagctggagcttcctcctctactaatcagcctggtgggtagcagggtagagcagaggcctgacattagctgaaattgccaggtcccaaacttgagcctctcaccatatccacgcactaccaatatgcttttgtagctaacatcttcaacacaattttacttaaatatgtttctttagaagcatttatttttaaaaataaaactttatatccctatcataaatagaaaattaatatcacatatcatacaatcaatggacttataaaatagttttaattttttttccatctgtgcatcatccaaaaccataggtaccatgtgcaggattactaggcccaaagttgcagagattctaaatcagtcattctggaagcagacccaggaatgtgggtttataaaagaaaaatcctccggatggctctgtgacccactgaaccggagtttagttatattccaaaagcgatcctccaccagcttcagcctcagctgggtgcttgataggaatgcggaatctcaggccacaccccagacctgctgaattgcaatctgcggggaactgtgtacacacaggagcaagagatactccgctctacaacctcagggcaaatgcctcagggcaccatttgaccctttaaaattccagggttccaaagttcaacatgggaatgttaacaatctagaatgtagatttttgaggtcctagaattctagtgttctaaggtgttaggattctaacaccctagggtttccagatttaagactgctgggatcccattgttctaaaatcctaaggttcaggccaggcgcggtggcttatgcctgtaatcccagctcttttgaaggtcaaggtgggcagatcacttgaggtcaggagttcaagaccagcctggctaacatggtgaaaccctgtctctactgaaaatacaaaaattagccaggcatggtggcatgtgcctgtgaacccagtttcttgagaggctgaggcaggagaatcacttgaatctgggaggcggaggttgcagtgagcagaaatcgtaccactgtactccagcctgggcaagacagtgagattctgtctcagaaaaaaaaaaaaaaatacaataaaacaaaataaaatcctaaggttcaaagattctaagatccctagaaatgagctcatctgtgggtggcaagcaatttgttctcagctgagaagaatgatctgttcttcctcctactcctgaccctcctcttcctcctttctccgctgtcagatatgtccactgatccgcatcttcatccactccctggatgtgaatgtcattcagcaggtcgtcggtaagtcaatggggaagtggggaccttctgaggcaggcatggagctctgtgcccaccccataagcagttctggtcaggggaccctggagaagcagaaggacccactgtcctaagcaaattgggagccatggcttcccctccacaggcacccgggggctccctttggcttttgggtctacaggcatggctggggttgctggggagaaatggagtaagtaaagctgtcaagaccctggaggtgacccttctatgaaaatagccacaagtcagccaggcgcagtggctcacacttgtaatcctagcactttgcgaggctgaggtgggcagaccacttgagttcaggagtttgagaccagcctgggtgacacggtgaaaccccatctctactaaaaaatacaaaattagccaggcgtggtggcatccacctggagtcccagctactcgggaggctgaggcgggaggattgcttgagcctaggaggcggacatcgcaggtagccgacatcatgccactgcactccggcctgggtgacagagtgagaccgcaatctcaaaaaaagaaaaaaaaaaagaagaagaagaaaggaaatagccacaagtccagtcccttaggcagtcactttgtgctctgtacacactatctcactggatccttgcaacaaccctgtggggaaggtactgtcattgtacccactttacagatgaacaaactgaagctcagagaggtggagcaacatccctggggtcccacaactgtcaggttaccggctggagagcggcatcttttggagtctggtctctattcaattccagtggcagagactaaggcctgctattgattttgtttcttcagataatcctcagcacaaaacccagctgcaaaccctcatctgaagaggacgaatgaggaggaccactgtggtgcatgctggtgaggagccagtctctgtgccccaatgcacaggggcctatggtgaagtaaaagtcaagcgtggcttcccttatttttgtgttagaagactgtgccttcatctcagtcatagattgagccctggcccccatcccaggctaggccctgattctggtcacactctgaacactgagccttaatcactgaactctgattctggccccagactgagcctggatcctagtcacagactgagctttgatgccagttattgactgagccttagtcttggtcacagaatgagccccaaccttggtctcaaatggatatccatgattctgatcacatattgggccctgaacctggctccagtagtggcctcaatcaatcttttcacatctaccattgttctgaaggagggtgaggggaatgaagatgagtcagtgccaggtgctaatgaaagaccccaaaccacaggtgccagtttcttcttcccaggacttaaaccgcatggggtattgtgggaaagagctgggacactggagccaggtcaacttgggtcccatcaagtgcccagtggatgactgacagctgggtgtaagggcagcctagcagcaaatgtcctaacccccttggtctcattccagattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgcacccttctgtgtggcttgttgcattccctccatttgggatttgttggtgggaactggggagggaggttgggggctgcaactagggtgggagagacctggatccagagctagaaggctcagtgggaatatccagccacatctcctggttctataaagggggccactgagacagagagggcaacaaactagcccaagtcacacagccaatctgtggcaatagcagacccctgatctatccattcatgcattcaacaggtatgtagtgaacacctactctgtgccagacaggcaatgggaactggaaagtcacattctggggacagccccacccagcactttcctccattcctctccaggggccctgaggattcttggagaatcaggggacacctagcctgactggagtcaggagtatgagacagagtgatgcagggtcagaggcctgtggccccatctccacctgccctgttagccctgctgccctctaggggtcccactggagcagagatgtcttttccaggtggtgctgagagttctcagtctgtagcaccctcacccacccctcccatcacctgagagcctgtgcacccacttgccaggctgcctggaggcccagcctccctagtgaggtcgagaaccctgggatgctcacctatcctatggagaccagcttctccctccacccaaggcccctccatccacaccccagaatgcagctcggcccatgctgcaccaggctgtggcagagacagcatcacgctgctcacggcaacacgtcatgggggactgcctttgtgcggcccacgggctccattgattccttaccacacccatgcaccaggagagccattatcacacccatttgacagaggaggactctgaggctgatggaggcaaagtgactcctccgggtcacacagtgagcaagaggcagagccaggctttgaatccacagctgtaggacccctgaatttactacaaatgaagacattgaggcacaaagagggcccaggctcagagaggtgacatcctggcttccaggcactttggccgctactcttgccagcctccagcaggctccacttccctggcccaagacagatgaggtactctgggtgctgttcttctcccccaagtgtagaccctcggctcttcctttgctctagaaggggcaggacactgtccgctcccaacaatcgcgttggcctcagcagagatgcaacacgggccacacaccaatgcacaccatcgcctcaggatcccagcagcctctcctttccaatagggaacccagccccaggaacctttgccgattttgccaagcagccatctcattactctgcacaactctaggaggcaggaatgtctcttgtccccacgagaaactcaaactcagagaagccaaggccacactgaagcctgcacccagctgctaattcactcgagggcctcctctctgatgaaggcagcctcactgagtcaggtgacctacagggtcctttgattccttgaagttgcctagagagccttggaccagcaagctgaatcctctcctgagcccctctgctgaagacctcagctctggttatgactgtgagttgcctgacacagggtaaaactgaggacttaggcagatctgagctcgagtcagtccctgccactttctagcagtgtgatcttgggcaagttacttaacctcagttttcttacctgtcaaatggaattaatagtaaaatctccctcactgggcttgtgaggattaaatgaagagtcagtgagtggaaagtgtttaaccagggcctcacatcaagtaagcacagcaggataaatgttggcctctacacactgaaactgctgttatgactgccatactcaggtttgttgattgactgataaaaacactaatatggtagaagaatcgtggcccaaggagatcttgagcttctaccttgtctctctgagggaggactgctaactaactcccactgtgcattcttctctccccaagttttggctagacacacggaccccagccagagaccacatctcccagcctcccttgcagctaactgtggccatgtgactaaggtctggccaatggcaaataagcagaactaattatgcaaattccactttgggctttaaaaggaaggggattccctcaacttcctcctggcattctccctcctctgcagttagaaatgggagcaactagagcaactgccctggacccagaggtggaagctctgtgttgagtacagtacagctactccagcagccccagaccactcagccctgggctcctaagggagaaaggaatgaacttgcttatttaaaccattatgttggggtctttttgctaagtctgctttgtctacattgtacctaactcattctgccaatcacatgctgtgtgaccattaggcagccgacttcctctctcagacccctgtttccatatccctgaaggttcttcctactctgacaggacagaaattaatgtttcttccataaccgaagagggaaggaaagaatagacatttattaagtttctactacatgccagacactgtattagactgatgatgactttgccttccagggaacgtttggtaatgtctggtatgaaccctgaaaatttgagacaggtctcagttaatttagaaagtttattttaccaatgttgaggatgtgtgcccatgacagtctcaggaagtcctgacgacacgtgctgaaggtgatgggggcacagcttggttttacgcattttagggatatatgagacatcaatcgatatatgtaaaaagtacattggttctgtccagaaaaccggggacaactcaaagcaaggaaggggcctccaggtcacaggtaggtgagacaaatggttccattctttcgagtttctgaaaaccctttccaaaggaggcaatcacaatatgcatctatttcagtgagcagagggatgactttgaatagaatgggaggcaggtttgccctgtgcagtttccagctagaattttccttttagcttagtgatttgggggcccaagatattttcctttatttatttatttatttatttatttatttatttattttttatttttttattttttttattgatcattcttgggtgtttctcgcagagggggatttggcagggtcataggacaataatggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaaacatctgtttaacaaagcacatcttgcaccgcccttaatccatttaaccctgagtggacacagcacatgtttcagagagcacagggttggggtaaggtcctagaacaacaggatcccaaggcagaagaatttttcttagtacagaacaaaatgaaaagtctcccatgtctacttctttctacacagacacagcaaccatccgatttctcaatcttttccccacctttcacccttttctattccacaaaaccgccattgtcatcatggccccttctcaatgagctgttgggttcacctcccagacggggtggtggccgggcagaggggctcctcacttcccagtaggggcggccgggcagaggcacccctcacctcccagacggggtggctggccgggcagggggctgaccccccccacctccctcccggacggggcggctggctgggctgggggctgacccccccacctccctcccggacggggcggctggcggggcgggagactgacccgcccacctccctccctgtcggggcggctggctgacccccccacctccctcccggacagggcagctggcctggcggggggctgaccccccacctccctcccggacggggcggctggccgggaggggggctaacccccacctccctcccggacggggtggctgccgggcggagacgctcctcacttcccagacagggtggctgccaggcggagggtctcctcacttctcagatggggcggccgggcagagacgctcctcacctcccagacggggtcgcggccgggcagaggtgctcctcacataccagccggggcggcggggcagaggcgctccccacatctcagacgatgggcggccgggcagagacgctcctcacttcctagatgggatggcggccgggaagaggcgctcctcacttcccagatgggatggcggcggggcagagatgctcctcactttccagactgggcagccaggcagaggggctcctcacatcccagacgatgggtggccaggcagagacgctcctcacttcccagacgcggtggcggctgggcagaggctgcaatctcggcactctggggggccaaggcaggcggctgggaggtggaggttgtagcgagccgagatcacgccactgcactccagcctgggcaccattgagcactgagtgaacgagagtccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgtgcctgcgattgcaggcactctgcaggctgaggcaggagaatcaggcagggaggttgcagtgagccgagatggcagcagcacagtccagcttcggctgggcatcagagggagaccgtggaaagagagggagagggagaccgtggggagagggagagggggagggggagggggaggggaagatttttctcttcattttctgcccatccgaaagctttcatcgatattttcctttcacactggcaatatttttggttgtcacaaatggatgaggtgtgtgctactccaggagagcacatgagtagaggccaggggtggtgctacccattccataatacacagaacagcccctcacaacagaagcatctaacctaaaatgtcactagtgttaagaaaccctaggccgggcacggtggctcacgcctgtaatcccagcactttgggaggtcaaggcaggtggatcacgaggtcaggagatcgagaccatcctggctaacgtggtgaaaccccgtatctactaaaaatacaaaaaaaaattagccgggcatagtggcgggcccctgtagtcccagctactcgggaggctgaggcaagagaatggcatgaacccgggaggcagagcttgcagagcggagatcacgccactgcactccagcctgggtgacagagtgagactccatctcaaaaaaaaaaaaaaaaaatgacaggacccactcaccccacccacccctctaagccaccagggaaggcaaaactaggtcatgaaaagtgctgaaagaggcaaggttttagacttagttagcttcacttccaggaatctgtccaaaaaacttaagtacagatacatttaagcacaaagacataggggtattcatgatgggaatttaaaaaacaaaaaacctgaaacaaaaagcaaataattaaacccaagtacaagattagcaatgctgacaacatttgtaatggtgagagagtgagactctgtcttaaaaaaaagaaaaaagaaaccctgtagtaggcaactggtattgactgaggacagtgagggccaggaccccggggcgcagcctcaggattccccacgcttgcagctggggagcctggggtaggcaatttgtgggtgaccatgtctgcgaaggactttgccatctgtgttttcggacctggggagaaagaaccccatcccctacccctcctccaccattttagataccccagatggactcattttggggttcccactgacatccaggaaggacacaaacccttctctgaccccagccagctctagtggccacctctctttgccacggtgaccctgctcccatgaccctgcggtgtctggagccctccaggaatggcagggaagggacgcggagccagcagggagaccacagggtcactgaggagctgtgcctgaagacggtgcgtgtctggcaaggccctgcaggagctcccacaggatggtacgggggaaatatgtccacagagccaaagagaaattaaaagaggcaccaggaggaaattccttgattagagatagctcccattcagacgacctactaacaatatctgttaaaacatcagctggaccaactaatcttccaatcaaataccaagatggtaaattcagattgcactctgtcctatgtggcaagtatggtttcatctgattgactgctatgttcagatgtgtaaggatgagcagacgggtgggaaggccccagaacagcactgctcacctttactgaccaaatcactctacccatcagcactgatgaaacaggaaaatagagtctggagacagggaacataaggccaattcacacttcagctatgacaggaaatgtcctctccatagggcctacactgagtaaatgactttgtaactttacttcatcctgttcatttacacagggcgtaccccaagtacagggtatttaaactcacaaaaactctgtaacagggcctttgagcccgtgttcggccctgctcccacactgtggagtgcacttccttttcaataaatctcttcattcctttcttgctttgtttgtgcgttttgtccaattctttgttcaagacaccaagaacctggacactgtccaccggaaacaccatctctatagcagctctgtgaacccactgctaacagacagtgatatctgggaacggcctttaccaacaagactaaaagttaattggaagaatatcagttccaggtataagtgggtttttttttgtttgttttctttgtttgtttgtttgtttttgagactagagtcttgctctgttgcccagactggagtgcagtgatgtgatctcagctcactgcaaccttcacctcccaggttcaagcaattctcctgcctcagcctcccaagtaggtgggattagaggcacccaccatgcctggctaattttttgtatttttagtacagacagggtttcgccatgttggccagactggtctcgaactcctgacctcaagtgatgcaaccgcctaggcctcccaaaatgctgggattacaggcctgagccaccatgcccggccgtgtttctcttttcctaaacatgcctcacatagcgtatctccaaatgcagctatgtaaaagggaaccaaaacttgagtgactgctctgaatagctatgcggaattctttgtaagaactgctaaagtcagtctgatttaaatgcgcgaagaggcagctaggtatttaaagttcccccagatattttcacctaagtgatacctcccttcctaaggctgaccaaggccagttgatccttttaaattaaaaataaaatgtcccatgcaaaggctggaggagtgttttatcagaatgccttgcctttctgaggttcctttctattaggtcgaaggtctatgctccaggaggagagaaagacctcctcataggaatgctaaagggatggcaggaactgagctgatcccaggcttcactgcaattttgtatgcctgttcgtcagtctcttttagggcattctatattttgcattctgatgtacctaggagttaaacagttgttaaacagatcgtgcttgtgagtatttctctctcattttctacaattaaccaaataaacaacaaaaaaaagcccatgaagccctgtatttgtctttttttttttttttttttttgagatggagtcttgctctgtcaccagactggagtgcaggggcgcgatctcggctcactgcaacctctgcctcccaggttcaagtgattctcctgcctcagcctcccgagtagctgggattacaggcacacgccaccacaccccgctaatttttgtatttttagtagagatggggtttcaccatgttgtccaggatggcctcaatctcatgacctcgtgatccacctgccttgacctcccaaagtgctgggattacaggtgtaagccaccgcacttggcctgtatttgtctttttactacatggatgaactctgtcatatgaataagtactgtactaatccattttaagggaggcttatttcagaaatatttcaaactggtgcaaatggaaaaggctttttttcttttaaagctaaagacaagaatgtcatgctatacaggtagaatttgacctctgctaataaaaaccaatgtagatatagacattttgccatttgaagtagctgtgtcccaacatgttgccattgattttttggaaatggctttagaaatgtccaagttgggctggacacagtggctcattcctgtaatcccagcactttgggaggccaaagcggacggatcacttgaagccaggagttcgagaccagcctggccaacatggtgaaaccccatctctactaaaaatacaaaaactagccgggcgtggtggcacatgcctttaatcccagctacttgggaggctgaggcaggaggatcacttgaacctgggaggcagaggttgcagtgagctgagatcacgccactgcactccagcctgggtgagagtgagactgtgcctcaggaagaaaaaagaaaaaaaaagaaatctccaagatgtccttgaattgtctaaccatggacattgtcagttctcccttctatcatgtagaatacttagacttaatattcttccagatacagggggatacttgcttgtttttcaaagtgtttatttactgctgctactatttgattacaatgtgttaaattttaaaacctgtgggagtggcgaggtggggaagaaatcctgtagtggacctcatacacatttatctcattgaattcggattttttctgagtgatccagtgaatgagtctttggataggggtggcaactcacggtcagagtggtgaagtgacttgtctgaggccacatggctggtcagaggcaaaattgcatttaatccgaagttcatctcctccatagctttccccccgctagccaaagatgaaggatgtgaattttccttgctgattataatttgtggcaatcccacctcccacagaaaatacacaaggaggtgctcgaaatttggggcttcttttgggcagtaactaactcgggtcggtgccaagccttagtccatgctgtaccaaccacctaggacaccttttcttctcccttatctgctggttaaatcctcctcaaccttccagactcactgctcaggagtcaccgcccagctaagtggggactgctccttaatgtttccaaaaatgagacactgtatttctcgactggcaggtctaaccaagctaccttgtcaccagcgtccagtgcagagagaacactcaaaaatcatcagctttcaatagcgtggcttccacttttctcattcacccctccgcccatctgccccagggcaggtgcttcagtcttcaacagctctagtgcctagcaaaggtgcaagcaaataacccatgatgaatgaatgactggatgagtgaataaatgaatgaacctcttcttgactgtacatggacaccatctctggggcagctgaatgggtgagtaagcaggaaaattctagcaaaccaggattagggggtataggagacctgcattattttctgttaaccagagacagataatggaggacaaaattgatggactatgaaccaaatgcatggctcctaggtacatgactccaggctgtggagggggtagggccaagatcaccaggacccactgaagactgatgtggccaatgtggggttggggggggggttcccctctgtgagcctccctgggaccagctctgacttctttttcaccaagcccagaatgtaaaagtggggatgtggtgagggcttcctggaggtggtgatgtcccatgaaggaggctttgggtaagaggaggatgctttgggagggagagggacacctaccataaggggatatgtgggaagaatgaaggcaaaacctaagtggacatgaggttatccagagagtaaagcactcaactctagtacaggctcttttgaagcctttattcagttaaatcaatgctgtccattaatatggatctttccaatgtttgcctgatttacacaggataacatttcaggatccaaattgttaactctatgccttggaacattttgtgaccccaggaacacatcacgaaatatttaccaaactggatctttctgtttacattacaatgatagcgtgtacatatttcactacatctttgccagcagatggaaacctttattgtaaatatttgctctgtgaatgggaatagaataaatttcataacactggaaaagccaaagttctcaaattaggggagttaattgttacaccaactcgacagactgctttctgagcatttttaaaaatggaaaaatagctgtagtttccagctgggtgggaatacagatctaagaatttgcttagctggaatcacaatgatgcaaaaaagtggaactgagaaaaaactgaaaagggatgccaaaatttgacagaagtttatttgttagacatgactcttatttctgtgttagtgcatgcaagaaaaaaaaatgcattttcaaaaaaaaaataggaagattgttgagtatctagctgagccaagcctgtgctgagcaattcagaggtgacctaagcagtgcctctccaacctcagcatgcaaggaatatgttcctgctacacctgctgcaggggctggaggaactgagaggggaaaagggctagacttgttctcaccatcaagaaagtacagcctgttcctgctgcaataacaaaatatcttagactgagtaatttataaataatagaaatttacgtctcacacttctggaggctggaagtccaagatcaaagtgccagcagacttggtgtctggtaaaggctttctctctgcttccaagatgacaccttctcactgcaatcacaagagagaaaggatggaagggcaaacagggacaactgctgtgtcctcatatggcagaagagaagtggaagggccaggcagctatctgaggccatctttataaggacactgtcctattcatgagtacagaactcttatgacttaattgggcccaacaggccccacctcttaataccactactttggggtttaagttccaacatatgaattttggagggacacatgcattcaaaccatgcacgtgttttaagacatctttgcaattaaggctttagtggggtcccaacttttcaaatggttgagcacatctgttctgaagtcttcaaggaacaaacatcttcagtgagatagagaacagttgcccctaccctacaaggaaaccacagctctgctttaaaaggaggaaattgtgatgtagtgtgaaggttacaagctttcatagaatgtagaactagattcaaatcctgattctattatacactagctctaggaccttgggcaagatttgtcttctcttgagtcttagtttcctcatctgtaaaatcaggcaaattagttcttagatgataaggatgcatttgtgaaaattgcctgtcaatgtgagctactattattatagatggagagacggagaccatgaaagggcttgggagctgtccagcatcaaacagcaagaaatgggcagcgccatgctagaattcaagggtctgggaccacaaaccagtaaactgaagctaggacaccctctgcctccccactcacagaagaccgagtggcttccttcctcggagtcaccaggcccatctcgcttattgtacagatgagaaaagcatctcagagtggagcagggatgtgaatgtgactcctgcacaccatcttcccacttgcagcccctctcggtgctctccacactctctgcacctctccatttgatggcattcatgatgtacagattcaaatatgttgttgacattcccccgggccttccaagcaggaatgtttgctttggaggtattggatagacgtggtaaaatcaagggctttccatcagcttcctagctgtccatcacccagtgccacgtctcccccagcaatgggatcacttgccatttatacagtctgcccccctacaaagtcatcgggaatcaacctacagaggccagagtgtcttgacagcacaccagagaaatccaggtaagcacaaggcaatggcactctccaacctgcctcttcatcagatgctgaaccagactaaagcttttgatacatgttaccagttattaccaattgtgtttggttctagcacagaacatgaaaaatcgtggcttcaatcatgatgagaagcccagagttaggctggcagagcctgccatctccttccttggctacccctaggatgtggctttcatcttcctgctagtaagataactgctgggctccagtcgtcatatcttatatgtaatcaggaaaaagcaggagaggaaaacaaaagcatgcaatttgcagctgggtcagccactctagagaagtttttaagaagccccgacctacaatttccatttatatctcattgatcatgcctggttgcaaagaaggttgggaaagataatttctttgttaagcacatttcttccctcaaaaataaaaggattctgtaaataaagagggaagaatgggcatgtgccctcggctctccaagcttccgtttcctgctctgtaaaggaagcatgtcaataactgtctcataagattgggatgttgtaaggaattgggggactcctccaacacccagcaggaaagatgctccctggccaccctcccctccttcagactgtctgtgagtcttccaagggtactcactgtcagaaccagggagggataaaaaggaactttaattgcaaatccaaaattaacttctatttagtggcactaggctaaacaattttcaaaatgcttcctgaattctcctagtaacctttttgagtgagatgcagattaaagtataaaaaactaaaagacgggagagccaggtgctagccactaactacagctggccttaggaaaacttaaccctgatccgagcctcagtgtgccatctgtaaaatgggtattgggccaggtgcggtggcttatgcctgtaatcccagcactttgggaggcggaggtgggaggatcacgaggtcaggagtttgagatcagcctggccaatatggtgaaacctgtctctactaaaaacacaaaaagtagctgggcatgatggagcacacctgtagtcccagctactcgggaggttgaggcaggagaatcgcttgaacccaggaggcagaggttgcagtgaaccgagatcgtgccactgactccagcctgggtgacagagcaagactccatctcaaaaaaaaaaaatgggtgttgggtgggtaagaatgagtccaaatgactcctttgcttcccccctatctcctttagctccatagagaacctctcagagtgaccctgaagctgactgtacttacctggtatcccacgggtactgccccaagatgctgaaggtctcgggcctccttatcctctgttggtttcttgccctgttgtctgctcaatatttgaatatttgacttgcctgtgggtttattatatcatatattttaatttcttggcctttagtcccttggtcattttttaagcatgcatgccttgtaaatttttattggatgctgaacatggtggtgaaatgacattatcttttttccagaaacgaagatggcagaaagatagagcagaaatggatcatgaccctgcctaggcttagctttgtgttttattaagtagaactattttggtcttgttcttacttttagagggagactatttctagggtgtggccctttctcctagagcacagtgctttatgtcttcactgagagcttaagatgtgtaccaaggttcctcccatcaaaggggccccacctcaaactagcgcttccttccccagcatcacacagtggatgtgctgatgtctctgttcagctttttaactttcacctgctattttctgccacatggctgagagtcccacactgctagggtgcagcttaaaaagctgagatttcaaggctccttccctggggaacttcctctttgggatttttgcccctcaagtcccagccactctggtagccccaaattccaacttctgtcccctcatccctgtaagactagctctttttgcttggaccctggttgacatgttggaaaatgacctcaggcaaaagctgggtgaatatggagcccgccttgaatgatgcctctttctcaagaatcacggggtttcaaattgtgcccatgtagttgctcatggatgtcctcctttgtttttacagatttccatctcttatagttgactttaattgggagtgttagtctgatgcaagatactctgtcatgatcaaaaccagaactctgcagatggaacttgaacttagatttcatagggactgtgcaacccctcatttggggttcagggatagggtgagaaggatgaacacagagaatgcttcgatacttataaaaacaggctgggcgcggtggctcacgcctgtaatcccagtactttgggaggctgacgcgggcagattacctgagcttaggagttcacgaccagcctgggcaacacggtgaaaccccgtctctactaaaattaaaaaaaaaaaattagtcgggtgtggtggcttgcgcagaggttgcagtgagctgagattgcgccactgcactccagccttggtgacagagcgaaactccatctcaaaaacaaaacaaaacaagacaccacacacacacacataaacacacaaacaaacaaacacacaaaacaaacaaacaaataaaacacacacacaaacaaacaaaaagaacttcagggttggttattcctagaaaatgcttcgtgggttataatgtggcaggtaaatgcagaaaaacacctaaggatattcctgccggtgccatctggggtaaaaacatgaaaatagcccaaaagaggagacattccatgaacatcagtcaatacataccttagaaaattctgcagacaaggaggtagacagtcctgatgtactgctacttgaataaatgcttctgtagaagcatgacaggccaatccttgtttctcatcatgttacatgaatgcacgcctatggaaagaaaaacttccaaaaaaagatacaacagaagttatctctgtgaactgatttttatttacttttttctctttgtgcatatcttcactttctaatttttctacttgcctaaaaacagatcacccaaattaaaatgttaagccaggccagttgcggtggctcacgcctgtaatcctagcactttgggaggccaagtcggatggatcacctgaggtcaggagttcgaaaccagcctggccaacatggtgaaaccccgtctctaccaaaaatatgaaaaaattagctgagcgtggtggtggatgcctgtgatcccagctacttgggaggcgaggcaggagaattgcttgataccaagaggcggaggttgcagtgagccgagatcacaccacaccgcactccagcctgggaaacagagtgaaactctgtctcaaaataaataaataaataaataaaataaaataaaatgctaaaccaaatgggttatgaatttacatgagaatagtgaccagggactgggctgagagtctgcttggaatctgtcaagtgtcgaaggagagaatcggtccctaccagcctttacctgttagtctcaggtcctaatgggaccatttgcactggcatttggttgaagtcccaggaagccacacgaacatcttcatgcacctcctttccaggaggtgtggagggtgtgtcaagatcccgagggccactcctagcccagggagtgtgccattcaagcgggcacagtaaatggtcctacagtgtccacatactccagccctggtccctcagcctgggcccttcttgtctgtgctgtggagcctactctctcccatcagctcagggaggtaagcccttgaaaatgtcaagtgaaaatcatgatcataatgatgcattagtacagtggtgaccatttgtgaagcacttacaatgtgcaaggtactgtgctaagtgcttacgacaagagcaagaggaaggtatgagtttggatcctctgcatcttccagatgaggaaagcctaaggtatccagcaagtaggtggcagagctgggattccatcccaggtctgtctgtctctgaagccagggcatatcaccaccaccattttgctgtaaaatgaggatagtgtgtcctgcataacatcgtgtggtgaagcaacttgcactaaatcccacaatcccacagctgctaacaggtgggggtcttcagagaccattgtcataactctaacattatgcagcctctcgcagcagccatgagcagccctgctggggaaggcagtgtccctgcgggaaaaaccgtatgtccagcttttgggcataaatacaggttgtgtggccttgggcaagtgacttcatctcttggaccctccctttcttgctctaaactatgaggaaaagcaggtccctccctgagcctcagtagacccatctgtaaaatggacataggtgaatgggtccatatgagttctgtggccacttcagatctgagctctgggaagaccctctgagaaagtgtccttgcaaatgacctctttgccctgatcctccacagggacctgaccgaagatgctgaatgtctccggcctctttgttctcctctgtgggctgcttgtctcatcctctgcacaggaggtcctggctggagtttcttcccagctccttaatggtgagactgtcctgctttgggtcatgcagaaccctgagccaatgccagttaagttctcattagcaaagtacctgggacacaatgaacactattaattattagccgtcctgactgcaacatcgtttaatcctcattttccgagcaccccctctttcctgtctccttgctgtgctttatctatcaagacccaccatcaaaggaaccagctctatatggactggtccctgtcgcagcctttgtacctgctgtttcctctgcctgggacactcttcccctacctgtcaacctagctgcctcccttccttcaggtctctgctcaaatgccacatttgcagaaagcccttccttgacctcctgcgtaaatgaatccctcaccctgccttttgttttttcatcataggatggactgatatctagcggcatggtcatcgtggttaaaacattgaaattttggggtatactatttgtgaagtatttcctgcttagagactctccaggtgcccgccattgccccaaccatcccagcttcacccccagaactctagcttccccatgaacgaaacaactatggagttaacacctggcacagcccggggagcccaggacctggatccagagctatgaccagtgcccctgttgagctcattgctaaatactttgaaaccaaccccttcacagcacttgtttgcaccggaatcctgcctgtccctttattctccactttttcgtctgtctctcctcagtcctgtaagaatgccagctccatcagggtggtgcccagggtggtgaacagactgggtgcatggcctgggtgcatagtaggcccctgtgaatatttgctggatgattatgtctagaacttggcccacagtccagcaagccagaaatagctgaacaacaagtcagagccacataggggacatgctcggaggtcaaggttgtatctgaggatctttggcatctaaatgtctacttgggtttgggagtggggcattctttacagatttgactcaaggactcctcagggcagactttcttcccagcctgcagacaactggcctccagaaaccattgagtagtgccttcgatggtgtatcaggcctcctggacatctttggacctccactcaccaatgagatcaacactgttaggtgagtggtctctgatcaccaaccacccccagtccaggctgtcctggtttgttggattgttagagctctccccacatttcctgacctcacagaggcccttcccttgcaaagagcctttccaactctgatggcctgagatcccctggttgggagaaactcccaccgcgggaggctaggggagaggctaaagacacaggggttcagtccccttgtctgggaagaggatggctgctcaccagctgtaacagcatcacccatctccccctttctctaagcctcaacatctgccctgttcaatggggaataatagcttctaaccccatagggctgttgtgaacattaagtgaaataatatgtgtaaaatgtttgcacatcctcctctcctcagtgagcatccaatcacaggtaataaacaacaacaggaagaatgtggtaatcctaacactagatgatgctgagctttagggttagactggccatcagaatatagaagacctgggtcccttgcctcacaagcatcttaaactcaacatgtccaaaactcaactgctgactcataccttcatccctgccacaacctgtgcctccccctgcccagcccatcttacctaatgacaactccatccatccagttgctctggccaaaaatcatgatgtcctccctggctcctctgtctcctttgtacctgcttccagcctgttgccaaaccctccctgtcacttctgcctttaaatcatacccaggcatctcaccactttttttttccacctctggtggtctgagccaccattatctccccgcttgacttacagccccagattattctgcttccacccaccagccctcatctcctccattctgttctgccagtatccagaaaaatctttctaagaagtggagctgaccctgtaactcccttgtccaaaccctccgatgtgttctcttcgccctcagaaccaagcccaaagttcttaccactggccctcaaggctccacacaatctggccctggctacctcgctcacctcttctactagtctcgcatcactctctgcctgctagccacatgaagcctgttgctgttcctcaaacacaccagccacatttcagcctcagggattttgcacttgctctgtcttctttatttttactattattattgttttgagatggggtcttgctccatctcccgggctggagttcagtgagtggtgtgaccacagctcactgcagcctcaacctcctgggctcaagccatcctcctgcctcagcctcccaagtagctggaaccacagacacatgccaccatgcccagctaattttttgtttggttgcttgattttttgttttgctttgttttgttttcgagacaaggtcttgctctgtcacccaggctggagtgcagtggcacaatcacggctcactgcagccttgacttctaggcttaattgatcctcctgccttggcctcccaaagtgctgggattacaggtgtgagccactgcacccagccttgctctgtcttaaacctgtcctttccttctcctggctatctgcatgactcattctcacttcattcgtgactctgcccaaacatcacctcctatgataaaccttccctgactaccctgtctgaaattccactcttcccaatattaccttccatcttcctgatcctgtagggccttttttttcacggtgcctatcactttctatatgtatttatttactggatttattctcctatacatatatacctgctccaagcatctgctatatatggctttcagttttattcactcgttgatttcagcctgcttggtgctgggcaaagtgctgaacgtgattattctgagatacagcaaggtaagagcttctttttgctcagggatatattccccgtgcttataacacatagtaactttgcaataaactacctggttaatgaatgagtactgatctttgcatatattcagcttcttctctgcaagggacctgccattgcacaaagtgaggtccacctgcagcaggagccacagcctccctgtgttgtgttgtttcttcacccagcatacaggtgaaaaatcctcaactcctccatgtctccatcgagagcacccctcaaagaaaggaggccactgtacaagtaccattcacgtctgagttgattgtgcagtaagtcacagctatgggtcttgcagtctccattggcttttgcataggagtcgggggatgtgggcagatccctaaccaaagggctcagcgacggactcactgtgtggttagagcaaaacatccaccctctctgggcctgagtcgccccatgtgtagaatgagaggcctgcagaacacttgagtgctccaagcttggggcctctctggggaaagcagatttcctcgcccgacctcatccagacagcccccaccttcatttatttggactttatgagttctcttagttctgattgaatgtaactgaagacaagagcaaagaatcacctctggaccccaattccgtggcactattgcctagagatcaccccaggggctgcatctgacccactgatatattttgtctggtttgcatggtgcatctgcagaggccacgcattctccagttcaccacagcctttaccgctccctgtgaaactaattgcccatctgcttcattcatttccatttcaagcctggccatcaaggcaatggagtttgagactctagaaaaggactttccaaggtcagatgcagtttctcagttttgataagatgtcatacttagaatcaacattttccttcctaactgtccccagagccagaggtagcaagtattagttagactccctgagtgcagaaccctctgacttagccactggctggatgcatgacttggagaaagccattcccattctccaggactgaatggcctcttttgaaaaatgagaaaatgaccttaacagggtggttttgaagaaccctagttctagaaacaaatgaggatgtagtaagctctgagcttctccccgacctgccttacctcttccctcctacaggctcctgaccatgaagcccttcacagctaatatgcagtcagatataaaagtccagattcgtttggagaagaatgtaggtggcagatatgagcttgcctttgggaactgcaggctcttgcccgaggctatttggatccaaactggagtccagtgagttctcaatctgtctttctctgtgtccagctggttatgatgacgtccccagtgagatttcacctgaaagatgtcaccagaaaaacaataccctaccaaattaggcttttgtgtgtatagtgatgtgtgtataataaataggactttctgtgtctttaaaattttgctttttacaaaagtaataattctatcgacatgaaaagagacttaccaaatagtactaagcaaaaaaaaaaaaaaaaagaaggattgcttggccatttgttgatagattatttctaaacttttgggctaaccaggtggctcatctgtaatctcagtactttgggaggtcgaggcaggtggatagcttgagcccaggagttcaagaccagcctgggcaacatggcaaaaccctgtctatacaaaaaatacaaaaattagccaggtgttgtggcaggcacctatagtctcagctactagggaggctgaggtaggaggatcacttgagcccaagaggttgaggctgcggtgagccataagcatgccactgcactccagccggggcaacaagcaagaccctgtctcaaaaaaattaaattaattcaaaagataaacatttgctaacataaataacccagaacattttgatacaggaaacttttccaaaataaaattacgttcttattgtagatttttaagattattccaaacgtatacacagttctacaacttctaagttttaaggcactgccaaaccactcaacaaatgccttaccaatggaactgaagcaagtggcatgtctgtagccgacattcggcagttttgtcccatatacaatcaatcccaattattctctttttcacaacatttattcttttatacatacataccttccccaagtatctctatagatggctctcagtcttactcattcatttatttcagcctgcttggtgctgggaaaagtgctgaatatgattattctgaggtatgttaagacaagatcttcttttcactaggaggaaaatcccacgaatgctattgttttcattaccttgtctaccagtagaaaagaatttcatcatttcttagtctctgatatttcctcttcagagaaactgtcttcagaggttttgcccttttattaattagagttttagtgtttacttctaaatttataatttctttttaaaaatcttctttgtaaatattttttttgaaacgagatttcactcagttgcccaagctgaagtgcaatggtcgtgcaatctcggctcactgcaagctccacctccccaactcaggcaatgctcccatctaggcctcctgaatacctgagattacaagcacaggccaccatgcctggctaatttttgtgttttttgtagagacagagtttcaccatgtctcccaggctggtctcaaactcctgcacccaactgatctacctgcctcagtctcttaaagtgctgggattacaggcatgagccaccacacctagcccttttaaaaaatttttttttaattaaggctgatatccacatttagctgaatccagtggtcatcaccagtccattttctatcctgtcttcttcttattttgattcatctcagttgctcactctttcaggaaagatctgggtgtggaatgctttctgcacccttgcacacctggtcctgtcctcctgacatgctcaaacataagtgagaaccagaccagattcacagcccatctccccttctgaaaactctgcaaatacctctctctcccatgatatactaaagaaaatgtccctcttttgcaaggaatttgagacctcaggttggaagcagtagatcgtagctgatttctatgcaaactctttaagaaataaagacataaaccctttgcctgagaataaaacagatttaccctcacatgttaaggattagggactgagtcaggaacacagaacacaaggacacctttatgctatttcctgcttctttctcctttctcccaattaaagaacgatgttacactgttccttccatgaaagcattggccctctggcagaggagataagttctactgtagcatcaggtaatcagagaaatgggaaagtgagaaggaaggagagaactgagaattggctaggatggtcaagaagagctttctggaggaaaccagttggccgggcctagcaaagtgatagaatttgaagaaggcatctccagagggagatgcaaaatagtcacagaaaacataatggtgagtaacaatgataagggcaaggtgatttaaattggaagattaattttaaagaaccctagagtgtggattggagcggtaggacacagctgggtgatggaatgccatggaaacaaggagtagacttgaagaagttcacgggcattgagcaaagaagtgatagggataaaggagagtctgagagaagttaatctgttctgcatattttctgcctcttcatttagactcgccccagcgcaaaatttgttgtggcaaacatagagagaaacctgaaaaacatagtagcccatgatctgggacgaaaagtaagtatgcaaacccagattacttccatttttgagctgagactcaaagcatgggggagtttggatcttcttaatgaagtgggaagaaatcttccaggaaggaaagttagagagagatggagtggcatctgttaagtttccattctgcaatcaggcactggtgaagtattttacagacattatttaattatttaggtcaaagtcagcatccatatgaccagaagtaagtagataaatctccccaaaactcagtttccttatctgtaagatggagataagtaatcacaaaattaacattcactaagcacgcaaacactgtgctaagtatctgaaatgaattttcttatctcatcctccaaacaatctcatactccaggtaacaatatcatcttcattttccagatttaagttccagagaaggccaatgacttactcaagtcatagagctaccaagtggccgagctggcttatgaccctagggcagtctgcccccaaaacccatctacttggttgtccccagaatgggttggcttgggagaacttgccttgctcactcccatttagactttattagtggagccctcctcttgacttttgcctatttccttgtctttcaggtgtgccctgtgattaataaatggctctacaacctggaccagcatgtggttaaagagttgattagtaagtgctggaggtgggaagggacaggaacactccagaagaaagctcagaaccctccctcaccctttgtatttcatttccccttacctcactctggcacttctcctagaccaaaaatctctttcctgctgaagtagaatggtccctaataataacaaccttaataataaactcagctgacattaactgagggagcccagtgtgccaacatgaagcactgtgcctgcactagcaattgaacgtgcacctttagctaaggacgtgctggtttcaattctattcttgctcccaaagcctagagcagctgagatatgaatggaaacttctccaggggagaaaatctgcccaattctgcctttgtcctcccctaaatttgtatgagttaaatgatgggcagaaaattggtctgttttcagcccagacaaacactgcctcctttcagtagtcgctacctcaagcatccaaagttttcatatctgccagaactcaaagcaaaaaatgcaagattgaatctcagcagctcaggcccccagcaggacttcaaacttccaccaccaaaaaaaaaaaaaaaaaaaatgctgaattgaaaggtatatgccttcattcactgaatattcactcgtcctgccaagtgccagatgccagagtttctaaaattcctcgagtggctctcccagcaagcaattttctgacttctgcctattccattgactgggaagtcactacttttttttttttttttttttgagatggaatctcactctattgcccagactggagtgcagtggtgcgatctcggctccctgcaacctctgcctccagagttcaagcgattctcctgcctcagcctcccaagtagctgggattacaggcaggcatcaccatccctggctaatttttgtatttttagtagagatggggtttcattgtgttagccaggctggtcttgaactcctaacttcaagtgatccacccgcctcagcctcctaaagtgctgggattacaggtgtgaaccaccaccagtgagcccggccagtactcactacttatgaggtaggaagcttgaggcaactaatctggatgagcctaaaaactcccaaagcttgtgttcccgggcccactcaaatgaatgggacagctcaaccaacaccttcgctctactatgggccatcacttcagagagatggccaggtgaatggagactccggctgcagcaatggcacctttctccactgtctcattccaatgtaggagctcttaagtgattagcttgggaagaagtggttgttcccaatctgtagataaggaaaccaagatccaagaactttaagcaatttatccaggattacttagtaaaaaataataacaataaaagctaaatgcatattaagtgctttactatgtgccaggctctttgcagactttatatatgttaatttgatctgtccatacaactccgtgaactaggtattatcactatcttcattttaaagatgaggaaacagaaacaaaggaagatcaaaatgtttgcccatatttccatggaagaaaatgtcagagccagagtgaacccgcatcctccagctacagagcccacactggtagtcactgtactgcatggataaagaactgtcagttaaatcatacaagacagccagtgacaaataagagcttccagcctcagccttctgtctccacaccttgggctcatttctcatccccattctgctcccagtgctgctccaagggggaaacttccctggcctctctgatcctccaccacccccacagtctgagtatctcttttgcattctagatctggtcctgctgcaggaaaagtaccaagtcaccatctaaatgtccccaaagtgaagaagctatgtgtgtatcaatccggtgagaaaccagagcatgtttccattgcttagtgatgacctttggcctttagggtcattataagtgtgttattcattcatttgttaaattttagttaagcccctactatatgctagactctattccacatgttaggaatacagcagtgaacaagatggacaaggaatctgatttcctggagcttgtattctagttgggaatactaacagtgaataaggaaataaatatatagtcaactaaattccagaggatggtgggtattcagaagaaaacaaagtaggaggatgtgggcaaaagtaactggggtgggggcagagagagagacatcaaattaatacagtcagacagaggctctttggggaacaaagggacaattcagctgagccctgaatgataaggcagaaggagttgtgccaagacccaggagaaaagtatcacaagcaagaggatgaacatgtgcaaagtccctgaggcagaaatgaatgaacttgcctttttgaagtaaagaaaggaggccgtcgtgggctggagtgtgtagggagctcagttgtaggagacatctttacaagagtgatatttggcagagaaaaggaagggagtttctataaaaggagatatcattattcattcatttatcatgtatgtatttgcaactcttcagtgctgaatacactctgctcaggtgtcaccatctcaagtctctcaaaaatggcacatccaccactctcttccctgctttacttttcttcataccactcattattatttgacttcctactatattatatgtatcttttctctccacctcttaaaagaatgtagacctcatgaagtcagggactttatctattccctgttttatcccaagttccaggattacaaaaatgaatcacacttggcccctgacctcaagagctcccagcctagcgagagataaaacaaataaatcggcaatttcatgtgcattgaggtgctcagttaaggttctatggaagtagagaggcaagacccagtagccaggggacttccaggagactttgcagaaaaggcaagatttaaactgggtattgaaaaatgataaagactcactttgtgggaaaagacattataagcagaggatacagcatgtgcaagtacacagaagcaggaaagggtctgatgctttgggcaatggggagaagctctgggcaatggggagaagctctgggtgactgcccataggagtcatgggggacagaggtatcctcccctgaggagtaaggataagcatgtaataagctatgctgtacacatgctttgtgagaacaaggtcacatgtgatgaattgggctgtaagaaggtacagtccatgacaggggacataaaaaattaagtgcccaacaccataatggaatccacatccttgagttaattagcttagttacgtaatactctaaaccaatgttatccaatagaaatataacaggagacacacaagtaattttgaattttctggcaaggccatctttaaaaggaaaaagaaacagattatattaaccttactagtttatatttacccaccatatccaaaatattatcattttaacatggaatcaatataaaagtaataaaatattttacattctatttttgcagtaagtctttggtctgatgtgtattttatacttacagcacatttcaatgtggactagctgcatttcaaatgctgatatccatgtgtgactagtggctaccatattggacaacgcagctctctctaagtaaattggctggcagttgcaaaacgttgaaaggtctagggcatctcatgtattcctgccaatatatctaggctgccacttagcacagaagtcccaaatctgtgacacccccccccccatattatattcagctcacagacatgtttggtttagcctataaagtgttttatacatgtgactgagttgccaatattaaaagtaagaaatatgtcttttgattagctagggcacctggtgatattttgtattattgtgttgtgaagtaggccaaggcgacgaggaagagccaccttaattgatgagaggaagtccagggaaacaatgagaaaacgttatccagagagaggcagtggatgggtgtcccgacaggaatagatttcagcaccacggacagcagtcacgccagtgcggagggggagggcagaagcgggaaaggctgtccgttctgaccggaagaaagggtgtgaaatttactaatacctggattatctcacacagaatcagcttctgcatcctagtctcctccctggaatgtcctccacactccaggacaccacctgcgtagatcgtgttgattattcagctgatgcctggaattgcatgacccaccctggaccaaaagagcccctgcttctccgggtatggaggttatttccctgtaaatcctcaccagaacccatgtgctgattccctgtaatcttcccacaataaatttttagcagctctgaactgcaaactgtccagcttccacagcgccatgtggatgggggcaacgtggccagagatgatggtgggtctggtcatgataacaaaagtatgaaaagcaggggaggatacttgggttgatttatccattatctcataaacatctgaacactctggtatgatgtttcccaaaggctaattaaaattttaaaaaggtttcctgtcttgtctgggatgttttctgaactgattttttgaccttgagtggctccatcctcttggccacagtctcatcactgtgcagtgggaatgttggtctcatcttcccagcgccctcaggcaggaacagcctacaaagttgtgacttatgggagaaaccttatcctggccctggtaactccatttttcttccctgtatcaccaaacttcccaaaacatatgctgctattcactgcctctccttcctcaccttcaacctctggtcattttttaagatggagttttgctctgtcatccaggctggagtgcagtggtgtgatctcggctcactgcaacctccgccttccgggttcaagaaattctcctgcctcagcctcctgagtagctcagactacaggcgtgtgccaccatgcccagcaaatctttgtatttttagtagagatgggatttcaccatgttggccaggctggtcttaaattcctggactcaagtgatccacctgcctcagcctcccaaaatgctgggattacagatgtgagccactgcaaccggccatcattttttttttcttttctttttctttctttttttttttttttttttttacaatatggcttccttctccaaagtattattctaatttaattctcatgataaacctaggaagtaactgttgttttcccttgaataagtgagaaaactgaggctcaaagaggtgcagtgatgtgtgcaagctgcacctctaagaatgagagagtcaggactcaaacttacgtctgccttagaatgaaagtctgggtcctcactgggcctgtgggcacactgtttgtgtccatatgcatgttcctgaccccgtccccaccactctccccttgtctcacttgctctggtcacactggctttcttgtgctgcctcctcagcttgttccaacctcagggctgaacactgggctggatttttatctgtcctgttcactgcttggcacatggaggggcttagtgaaacctgccaactccctgataaaggctccctcctgggagctgccacacactgcacaatagcatggagaatgtcaccctcagagtcacacaatccctctcccaaagacagctccccaattcccagaggatccgggtgaagaaatttagtgctgcagctatctccagcaaccacgagaatttaggatcaggtaaagcaaaatgagcaaatatggggtgacatgtgttggagaaaattactaaaagggggattgggatccaaaagcagaaaatggaagaagagagaaagcaagtttggtccctttgagaaacgcagcaggaagcagaagagaagccaagttggctgaagaataaaattaatgatcaaacaggttgaatgtgcatttttaaaagaaggacccatgccggtttcctcttcctactggctgacatttaagggcaggtgaggctgtgcctggctggttatccttaatgacctgccttgctcctttcctcctgagaacactcctgctatgtaagccccgggacttgacaggttggttcctgcccccttgtggtccagagtgttcatggttatggtgagacctgcagtcttcagtctatctggtggttcaactcactgaaaatgttggtatttgccatgtgtgttccacggaatcttattggcctctgtagtatataagaggaaatgcagccggacagaacaagcttgcagacccctgcgagggaaggttaagggctgtaagtgaatttatccagaaacaaggtagagcctatcagagccaggcagcccaagttcaaatcctagctccacattatcagctgtgtgtccttagacaagtgtctccagagtcagggctcaacatccatctgcccttattattcttcctgcctctccttgcaatgcttgtgcctgggggaatgggggctgaggatcatgttgggcagcagaatggggtgtgggatgaagcagttggtggggaatgagcaacagctcctctgagctcccttctgcaggccaggctacctggttcccatctgagccccacccctccccagctgggtggatttggggattttacttaacatttctgtgcctctgcaaaaggaggccaataataacagtgcctactgcaaagggttgtgttgagaattcaataagtcattacaggtaaagcacttagcttgcccctggagctcagtcagcactcaataactgttagctggtatcactgttattatttcagctaagtgatcttcacacaccgtgtgcatcagaattgtccagaagcttattcccaggatccccctcagagagcctgactcaattcatcagaggtgacctaagaatctgcatttttacaagtcccatctctccctccaaaattcggtgatgctcccctggaaattccagcatttccattttccctttgccctctccaggctaccctcagaacccagaaaaggtcaactcttcctttgtgaaacccaatatgccattcagaaacggtccccactctctcttcccctgccattttaaggaaattcgcctttggattaaggttccagcccctagttctgtacagttgttaggcatatgtatgttaaacacatatatatgtgtgtgtgtgtgtgtgtatatatatatacatatacatatatatgtgtgtgtatatatatatatcttttatatatatataaaagaatggaatgaatgaatgactagatgaataatgaattccattccttagaagagtaactctcaaagtatggactgaaccccctgcatcatctctctagggtgttcattccaaaggcagctcccagcacctccccccagcccccactaaatcagattcaggaatctgcatttaatgcttctgcctcctctgctgttccctggagtttggggacctctgccttttgctagggacctggaatttccttagagccccaaggaggggaagtggccaccccaattggccgttagagatcacaggtgtgcataagcctgcttggcccggagttctgccaagggaggttcctgcctccttgtcccactggacagctcttcctgcagccagggatgtgagacaggccctctccctgggcacatgggtacagacttctcaccccatagacagccactactgtcttcctttcttcctccaacctgccgagctctttcccacctgagggcctttgccctcatggttccctctgcctggctccccttccacatttttatactcaagcctggctccatctcctcctctcctcctgggctctgctcaaatgtcgcctgagaccttccctaatcctggtctaatgtggcctccttgctatttccaatcttacagtaagctttttccccttaatacaatttatggttatttggtttcttgtttatttcaccttgttctgattccctcaccagatgataagctgctggggaatagggtgactgttattccctagagtcaagcacagtgcctggcacacagttggcccacagtaaataatggttgggtggatggataaatgaatttttttcaaagtcaaactccttgaaagccagtttcccaggagagcaagggttttaccattgaacccatgggcatgccttaagaggtccatggcaatcctggtactgtgtgcaacattgtttggcttggtgagttttttttttcctaaaagacaaaccaaagcttccagtgcattttcaaaatgtcccccaagaaggtaaagaagcttgttttaaggaaagctatttggaatagtgaaggaggctgctaatgtgtgaggctcagtggtgttccacagcgccagtgtccaaggaaaacagtgtctgaggcagttctggggaaggcaagacagcccactgggatgccagctcagcctcttcctggctgggagcttaggcagccgctgggtttctctgggtccctgtctcctcacctttgtgggatgaggacggaatgagatagaccacagagcaggcttcacacagggaacgggtcccaacggagaaacgccagccccgccagcctccaagtatttgctcattaaggagctgtcctcaatccaccaccatccttcctgagagcaccagcgtggcgtgcccagccaccctgggttttttccttgaatgtcagctaaagaaactccacctcctcagggaggtctttttcctgacatcccttttcccccattggccaggtatcccctccctgtgccctctcacagtacctcccacctccttcacctctgggccatatttcataatcatatgctcagttgcagggataattgaagactgtgtgtctccccactggtatgtgagctccatgaggacaaggaccctgcctgaccactctctgtgggatccccagagcccacggctcctgacactcagtgttcattgattttagtggttttattcattgaatgaatgacagcaaagcccaccatctgaacagccacgcgcaagctcactccaggaccatcacaccctcactgccatctcagcctctctatcattcctgcctgccttctggagttgcatttcattcgtgaaagtacttgatagaggtggctcctgcattcattgcacacgtgtcccaggaaccatcttgggattctcatgctccatgtcactgactccatcagcttccctggtttacaggtgaggaaggctcagaggcgtaaggacaaggaggaggatcatcataataacatggttttggaggactggcccaagcatgattcgctttaatcctcactatagctctgaggtctgcactgtgatccttttacagacctgggagctgagtctgccaagagacagagtcagcagttgaaccccggtctgcgtgaccctaaagcacatactctggactgcatgtgatcctgcaccgagttggcttcaaatccagtccccagcccctgagcagggccctctcatccctccaaatctgctctctcttgtcatgcatcaagctctgaaaatctataccctccatgctgtcctttcattaggctctgtggccctgagaaccacagcctgtgatgaggtaggaccaacagctcctgccccatgttaagatgtccaaagagccaaggacaacagatttgttcctcccgacaatgcccactcttctctgttttcttgacaataaataacaaaattccaaccacttacataagaccaggaaggctagaaaaatacattttgaagtaagtgatattctacaaacatccccaaggggagcatgaactctgagaaaggacctcaaacagggaaagccaacaccctgaaccaaggctttctcagtacaatctcttacaaaaccagagtgaattgcccaagaatagccccaaggcttctgtgaaatttgcaaaggacgttcccatccctcatccacatgggaccctctatgtcgcccgtagtatggggaaacagcacagggacagtgacaaacgcctttgtctcagagctcacagcaatggcaaggtggggcccagacatccgagacctgtgctgctgcagtggagtggggaagagagagctgcaggcagtgcggtccaagaggatgcagggaccctcctgggcctgggaggtgttgcatggaatgtggcttttgctctgtgtgcagtaggaaatgctggagggttttgagcagaggagtggcatggtggtctaccttacatctttttttttttttttttttgagttggagtcttgctctgttgccaggctagagtgcagtgtagtgtgatctcagctcactgcaacctctgcctcctgggttcaagtgattctgctgcctcagcctcacaagtagctgggactacaggcatgtgccaccacacccagctaattttttgtatttttagtagagacggggtttcaccatgttggccaggctggtcttgaactcctgacctcatgatacgcctgcttcggcctcccaaagtgctgggattacaggcatgagccaccgcacccggcctaccttacatcttaaaatgactgttcaggctgctgtgtggaagagattgtgggtgggcacagttaaaagctgggaaaccagccgggacccactggcaataattcagatcaagctgatggtggctgaggagtagttgttatatgtggtcatgttctggaagtgtcagcaggatctcctgacagatgggttgtgggagatgggaaaaggggaggaaagggcagctccaccggctgggagtagaacaactagatggacttggcaccatttcctaagagtgaggacaggggacttaaactgaattctctctgaatcccaaccccagggctccaaggtcaacctgatgctttggcttcaagagtctgtaattcttatccagaaagataagatccatccatccagttattcattcatttgtagcattaacaaacattcaccagtacttaccatgtggcaaacatgggaggcactgtagacatgaggattaattagactcataccctgccctcaagaaactcataattcagaggagattcagagatcaaccatctccactcatcaattcagtcgtttggtcactcaacaaacattcattaacactcaatttctgacaagcaagtatcgtggtagggattgaagtggttggtcatgcccttaagaaagtcctaacccaattggagagcctggggttagccatcctcactcaaatgtattcattcattggttcactaaagagtcactaacatccagcctgtgccagggtctgggagaggactcctgttggatgacccaacaatagactctggtgagtgtctccaagcaacaaggcctccctctggagccctggcctcctcccagggttccacatgttgctctcccaatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaagtaagctaagccccgggctctgcctgctgcctacggggctggggaggtgggaaggtgccatctgggctccactgctaacccgctgggtgacttcaggttagtcactttccctcttctctttttcttagacctcaagtacagaaaattgaggttgtgttgatcatatgccaatttctagcacatcctcattggcacaaatcactgcaaggtcccccttttgttttattttcttattttccccctttatgacttattctcaccccatatccctactgccttggcaggcattgcagcgtgtttaatggatgtacttaaatatgcctgtgtccttgtatgtacagtactttaatttacataaattgtattgtactttaatttacataaattgtatagtgttgggtttcactcagcactatgctgttgacatctatgttgcttcagctggtgcagaaagagccataagattcatccacctcagtttatttggctgctcccctctggatggacatgcaggttgtctctaactctccatgattataaactacactgagatgaacctccttgcaagtgtccctgttacagcctgtgggagaatttccctgggataaacccagaaggagagtggttgggtcctggggtagaggtgaactcaatttaaccaaaactgccagaatcctctctagaatggctgtgtggtctacacgtgctccagtaagaaatgagcatacctgtctccccatgttccccagcactgccgagtactgagctgtatcagtcagctagggctgtcctcacaagacaccacagactgggaattaaacaacacacattcattttctcacagttctggaggctggaagtccaagatcaagatgcaaatagggttggtttctggtgaggcctgtcttgctggcttgcagacggacaccttctcgatgtctccatacagccttttctctgtgcatgcagagaaagagatctgtttcttcttataaggacaccaatcccatcagtttagggccataccctaatgacctcgtttaaccttaattagctctttaaaggccctatctccaaagacagtcgcactgggggaggagagggcacaatttgatctatgacactatttttctacttttttttttttgccagtttgatgtgtagttgagtgataactacttgttttagcttgactttatctggtgagtgggaagtttgagcatcttatacttttgttaaccattttgactttttttcttggagacagagtctcactgtgtcacccaggctgcagtgcagtggcatgatcttggctcactgcaacgtccacctcccaggttcaagcaattctcctgcctcagcctcctgagtagctgagattacaggtgcatgccaccatgcccggctaatttttgtatatttagtggcgatggggtttcatcatgttggccaggcggtctcgaacccctgacctcaagtgatctacccacctcggcctcccaaagtgctggcattacaagtgtaagccactgtgcccagccccattttgacttctttgaattccctgttcttaccttttatccatttttaaatttgcttttctgggtttttttaatcctctttgacttgaagagacattacttaattcttgacattagccctttgtcagatttatgcattgtgaatatttctcccaaactgtcatctgttaactttgtaggtccttcactgaacaggaatattttcaaattcatcaatattttgttttatagtttgtgtttggaaagtcttaagaccttgctcctacctcagacatattctactttgtttttttctaatagctttatagttttacctttcacatttaagattttaacccatctctggaggctatctttatgtatgcctgtgtatgtaaggcagagattcagcttcgcttctctccatatgactcagtttccccaactcatctactaaatgatcaaattcccaaaaatgaggattcactgctgaactccctatgctgtatctgtacatctgttttacaccaataacataatattgtaaatacaacatctttgtaaaatgctgttttatctgacagacctatattcttccaaatgaattttagagtgtgttgagttcctttaaaaaattcgtctggccgagcacggtggctccctagcactttaagaggctgaggtgggaaatcgcttgagcctaggaattcaagaccagcctgggcagcatatcaagatcctgtctctacaaaaataaaattagaaaattagccaggcatggtggcacacacctgtagtcccagctacttgggaggctgaggtgggaggatcacttgtgcccaggagtttgagactgcaatgagttataattgtgccactgcactccagcctgggcaacaaagaccctgtctcttaaaaaaaaaaaaaaaatcagggcgggcgcagtggctcacgcctgtaatcccagcactttgagaggctgaggtgggcgaatcacaaggtcaggagatcgagaccatcctggctaacacggtgaaatcccatctctactaaaaatacaagaaattagccgggcgtggtggtgagggcctgtagtcccagctactcgggaggctgaggtaggagaatgacgtgaacccgggaggcagagcttgcagtgagtggagatcatgccactgcactccagcctgggggacagagcaagactccatctaaaaaaaaaaaataaggctggaaattggattggagttaaaatgaatttgttaatttaaagagagttgatattttagacttcccaatcataaatttagtgtatctttccatttattcagattttactatatatcccataagagaattttaaagtcctatcaatgtattgagcatgatttattaacatgattcccagagaatttatagttttcattgccatagtaaatgctacctaatcttctattatattttctagttggaattgcaggtacagatggaaggaaagctgttgacttcttctgatattcaaaagccttgctgacctcttatatttttattgttttatttattctgtaggtttttctatctaggggattatattgtccataagtagtaatagctttatcttttctcttctaagcctgacacttcctgtgcctttttcttatcttgcattgtagccagagccttctacaggaatggaaattaatccagaattcccctacaagtaaattttctgtgggtttttggaatatagtgtttatcacattaagcctgttccttatgcccctagctttatgaatttttcttactcataagtcagtattgacctttaacaaatgtttctctgcatctaaaagttaatcacttttttcctccaacctactaaatgataaattgtattaatagatttttctgctgttgaaccttcctaacacttttaaaatgaaagtttttatgatgtactgttagattttttttttttttttttcaaatggagtcttgctctatcacccaggctggagtacagtggcgggatctcagctcattgaaacctccacctcccagcctgggttcaaatgattctcctgcctcagcctcccgagtagctgggattacaggtgcccccactaccacgacctactgatttatgtatttttagtagagacagggtttcaccatgttggccaggcgggtctcaaactccagacctcaggtgatccgcccgccttggcctcccaaagtgttgggattacaggcgtgagccactgcgcctggccaagatttcattagctaataatttgtttaggatcttagcaaacttttcatacataaaactaatatgtaactttcttttcttggtactgtccttgaggctaggaaagttatactaacctcagagaatgaatttaacgtctttctgtttttaaattttctttcacatttatctctttataaaagtttgataaaactctgcataaaatcttctagatcaaaagctctcagagaatgagatcttcaatcatcatttttatttgttaagaaatttcttaatttctttggttatgaatgttttctatttttcctcattgaaacttggcattttgtggttggcataaatgtatccttttcatttaggttattgaatatattggcgtataattctgaacccaggtaacctcatttatacaataagtgcagttagaatgttagttcacgaagctgcttttcaaacttaaatgctggaaagtatgtgaaaagttctttgactatgcatatgtttattgctatgaccagtagcagcttctctgcagtaacccagagttctcagtgtagggcctgatctcaggtagggtcaaggcagtgaaactatattatcagttagagtacttagctgcaggcaacagaaaacccaactcaacctggcttacacaataaaaaaagttgtcattttacataactgaaagtcagagataggacaagctccaggtttggttcagtcatgagttcaaagtttgcctccagactagattttgtctatttctcagctctgctatcatcatggttttatcctcatgctggttcccattgtggtaggaaaatggtggcccatggccattggcgctataggctgtcttgcttctttccgataggagaaacagaaaggaattttcccctcttgtttggtctgatagagccaactgggtcatgtgccaactttgaacccaaaagagtcagtgagggtgaggcacacctgatggttcagataatcaacagcctcatctagaccaggaatttaagggagtacttgaataaaatcagggttcagatgaggaaaatagaatgaataaatggataaatggatggatagatggacagatggatggatggatggatggatggatggatggatggatggatggatggatgagtggatggatggatggatgagcggatgaatggatggatggatggatggatggatggatggatgagtggatggatggatggatgagcggatgaatggatggatggatagatgaatattagactggcaaccactggtgtctgctgctcacaaattcccaagcaccactataatcatgaaccaagaactactaagagttctgggcatacctataggttcactctatccttgaaactatttgtttaatatatttctctcctagtagacataaaactggtttgtaccctcagtgaccagcttggggcctgacacccagtagatgctcaataaatatttgttggatgaatgaatgaatggtcttaatattcctcacaagaaccctgtgaggtactgcccctgttatacagatgaagaagccaagacccagggagatgatagagccaggatttgaatcaagatctgctactccagacacattcttgtttgtaagcgacagaaacaaacattgctgaaacaaacaactccaaggtgctgtcttggaggagggggatggggtatgacaaaggtttctgctgctctggagtaacccagagttctcagtgtgggaactgatctcagggcaggtcaaaccagtgaaataatgtgccctgtggtacactacgaggttcatcagagctgggtcctcatcccaggcaggagggtctagagacaaaatagaaaggacttaagcatctccatagctttaaaaattccttcctttgggagatttattcctttctggtggaagctccactgggtcctgcaatttattctagacatggtgtggagcaatttacatctattctttccaggcttacccatctaattttctcttcaaccaacattgactctgatctacatcctgtatgttagctccgtgctccagactgaaatacagtgttgggtgaactttcaaccagaataccccactttgagcagctgttgcctgccacaccctctgcaggtgtttttctttatttctcacatcaatcttgcaaagcataatttcatagatgaagaaggtagatctccatggggaggtggtgacatgcaccactcactaagcaatcagatcttgcaccagcctgcaacccaggcctccgaatcccaagccccccaccttttccgtgacactgtgcaaagtcagtggtccttgtgcatttccagttattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcaggtgagaccctgagttctatccgtggccctggaactctttatagagctctagatcgaagggtagagctgatggggggctggggaggtgcaaggcctgtgaagagggaaggtaggaagattgaaagaagagaaggtggaaggcccacacaaggaacagtgggggcccagctgcacaaatcaaaactgtgtggcactgttagggccactctggggcagcttgcagtccagggctcccgcacctgactcttgccctcagagcatctgtaaaagaatcacagtccaaatcccattgccaggccctctttatagtcggacagccttgtttctcagcaggaagccttacctgttctgaagtccctcacccttgtggggcctctgctctttccttgtgcagcatcaacatcaccaacattcagctggactgtggtgggatccagatatcattccataaggagtggttctcggcaaatatctcacttgaatttgaccttgaattgagaccgtgagtcatacagaagcagaatctgagaggtgctggccctcctcgcagggaacctgggaaattcagatctttctgatcccaacctaaattcaaatcctggcttccaaagccacttgctgtgtgaccttgggcaagtcacttcacctctctgagccttggtttcttcacctgaaatatgatgacaatcattagtcagtggaaggaagtcatttgctcattcaaacctatgagagttcacaacaactgggcttgattaaagagagaaagggagaactgctgtaatcatctcatcgcccctgctcaccatcctcctgttcaaactatcctttgacatccactgcccccaagaaagggaggatgcagctaaatgggaaagatttttgaaacagagattaactctcaacgtttgaatttccaaaggcctatttaaggggttttcagagtcactctggctacagctgttttctctttaatcactgacttcaggatttaactgggcctagtttgttgaaaggactcagagtgccaggggaagccctaacggtggacagtgcccgtctttgccaatacggagatttctactctttctctacctcctccccttgcccttcctcctcttcctctctcatctgcaggtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgagtaagaccccagctgcccctccccagagctgggcctccttcctgatgagccccagctgcagggtcacttcctgaccgtctcctaaattagtccaaagcagatctcatccttcccccgggatctgctcctcctcccatgttcccatccgtgatgaccctaccaccctcccagaagccagactcttctccctcctcactcctcaagcccatcatcacaagttcccatcaatgacttgctagtagccctcagcttctctcttttatctccatctcctactccactacctggagcactacaggaaactcacctggctttccctggcccggatctcccctcctacactccattcctcatcctgcagcagaaataactttctaacacagaaatctggccatgcccaagcccctgctccaaagcctccagtggttcccagtgccctctgggtaaacagcaactcccaaatttcactcaaggccctgcttgtcctctcccctgccaacttttcagccctttgtcctccaccacacaccgtacattttcacaccactgtgcctttgcacatgctgatcttcttgcctggaatgcccgtcccatcttctatgaagctcctccttatcactcattcattcatatatttcccaaaaacctactgtatgccagcaccacacctgatgctagggatacagtggtgaacaagacacaaaatacagctttaataaagctccatagactggctgaccaagtctttcaatttcaactgactgtaagtcccttgaaggcaagacttgtgcctgatttatctctgtaattccggaatgctgaaagcaatgaagacctcagtggatgtctgttcatttattcatcagatattcattgagtacctagattgtaccagacattcatgggaggacggtgtaagggaaagactctggaatctggtgctctattgccatgtttctaatataaccagcacttattagctgtgtgaccttgggcaaggtctgagctacccctttgatgatcactgacaatgatacttctggcatggggctgagtgaggactaaaagactgtggaaagtatactcaacacatacctcctggctttaatattgcctggattgctctgttctgttctgtgcctctacctttctttctagggctatcccaccaaagatgaatcagtttctctacaacctcaaagagaatctgcaaaaagttctcccacacatggtagaaagtcaggtaagtttagaaaaaactttgcatcttgagcatccttgagtccgagggttagggcatatatccactggcaatttagcaaaggatttcaaacattggattttagagcttgaaaaatctcaatttaaaatttcagtttggccatgagttttgccagcctatccttgagcaagagactttgcctccctgagcctcagtgttcccacctgtagcatgggatccaccatagtctctatcttatatgatgaggatttgtggagacaaagcgtcgaagtgttgtgcatgacactgagcaggtagttggcgctcactacaagggagctgctctggccacgattcctactggaaaaaatcccatggagttgaagtttcctgccacagtcacttcagttttccttttccagcccctggcctgatccttctctctgtgctgatggtccaggtatgtcctctgatcggtgaaatcctcgggcagctggatgtgaaactgttgaaaagcctcataggtgagtgtctggtccatccagtgaggacttcttaggactggcaagtggctgaaagaggtacccccggccctggagcccccagggaggcctgctaaggggcgtctgcatgtgccgtgagaacactttagaggtgaccatattatgatgaccacactgtcccccaagagagctgggacagcagaacgtacccctaccaagcaggctgtgccctgccaagtcactgaagtcatcaggttaccagagattcgagctgcttccaagatctccacccaatccagtagggaacactggccccatcccaaacctgagaccatctctactccagttacagataaacagttatagtccctgcccatatagagctcacagactagtgaagtgaagacaccaagaagcaaacaattcagcatcatttggggagggttttcacgtgaacgctcccggcacctgcctttggtcaccatggatggatgagggtttcccttcggtgtgggagttgggaggtgggcacactggtgacagacgctacctcttctccttacagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcagacctgatgaagtatcctcctgagaacaaatatccctatggttgctcatcagcccagaaataccaggacaaaaaaaaaaaaaaatgcagggaggggcctgttgagatttctcattctttcattctttcattccatatttattgggcacctaatatgtgtcaagaatactcctgggctccaagagggtgtagagaaagggtgagagagtggaaaagtgaaaccatgggcacaaacacatctgagctcaccttcaattcagctcaactggcagttccatgagggtgtaggtgccatgcagcatggtgacgcatgaatcccagccccagcatacagctggcacagagtgagtgctcagtaaatatctgtggctcaatgagtggatggattctagtcttaggatccactagctgcatttgagacaaagcttgttatctttcggtcttcatcatttgcaaaatggaatagaaatcttgcaagatgtggagcaacagaagccatcccatgctgctggtgggagataaattctaccaccactttataaagcatctcctagagttaaacatgggcttactttacaactcagcaattccactacctagtgtattctcaacaaaaatacatgcacgtgtggagcaaaaggcaaggaagctcatagcagcaatgttcgtcataaccccaaactcaacatcctcccatgcccatcaaaagaatgaataaatagaatgggcagatatcttgtgggatgggcacccactggaatctctatagtgatggaaatgacctacaattgcacacagcacgtggatgaatctcataaacagaatgttacatgaaagaagccatacacaaaagggcatgtgttgcatctcccatttatgtgagtccaaaaacagcaaaactaatccgtgccgccagagataagatagtggttaccttggagcaagggttagatgctaggagggcattgaagggggcttctggagagctgatagcattctgtttcctgatctaggtgctgggtatgggaagggatgtttggtttctgaaaactcattgagctatttacctatacacatttttcttatgtgtaatgtactttaacaattttgacaataaaagtattggccggttgtgatggctcacacctgtaatgccaacactttgggaagctgaggctggaggattgcttgaggctaggagttcaagaccagcctaggcaacacagcaagaccctatgtctacaaaaagcttgaaaaattagctggaggtagtggcacacacctgtagtcccagctacttgggaggctgaggcaggaggattgcttgagcctaggagttcaaggttacaataagctatgattgcaacactgtgcttcagcctgggtgatagagcaagaccttgtctctctaaaaagtccatatatgtatttataatgcaggatgcttgtaaggagtaaagccatgaaaaaccatttgcagtgtatttcacatgtgatgggttcatgggaaatgcttattaaatgtcacttaatccagccaggcacagtggctcatacctataatcccagcactttgggaggccaaggtgggtggatcatttgagctcaggagtttgagaccggcctggccaacacagtgaaaccccatctctactaaaaatacaaaaatcagctaggcatggtggcaggtgcctgtaattccagctactcaggaagctgaggcaggagaattgcttgaacccaggaggcagaggttcagtgagccaagttcattccactgcactccagtctgggcaacagagtgagactccgtctcaaaaaaaaaaaaaaagtcaattaatccattgttaatgatttgactcttgactattcaattattaaatatggattcccactctcctccaaccaagagttgaaaaagcaacctgagaaatcaagggaaaataacacacacatattaatcacagtagcacacattaagcacttgttatataaagagattcttggtgctcagagcttacatccagcatcttatcaatgcctcccagcaaccccaccagatacaaaatttcagctcactttatgcatgagaagcctgaggctcggagaaataaagtcacttgtctaaggtcacacagtaaggaaatggccacaatgactgcactcaggcagccagctctagagcccacactctaaaccactgtgaatcctccttccttccttccaacacccctcaccccaccacacacacacacatgcacacacgcaagcgggggctgatgaaatatgtgttcagtgggactgacaagctcaaataaggaaatgtcaacagctcagagatgagaatagggcaggagaatctcgcttctctgtctttcaattcaagctccctaatccggaatgcttcatcagggatttgcaaccctaaacgctagtgttctccttgccagctgtgagcttgtggggttcttcctgctcatgattcaaagagcaaacacaggagggccaggcctggtccccaacaaggctacctggttcactggtgaaggcagcttttgtctgccttcctcctgactcttcctgggctggcgcagggcttcctgtagggacctccttgggtttctgacattctgttttcattttaaggttcatggagcatggactcattacatttcctcccagaagggcttgttggacaatggacctctattaggatactggggttcacactgggggatggtttaaggcccaaatgcagccccaaatgttcagaacctcagtcctggctctgcccctctgagctttataacttccatgccctcccactactgggcactgactctgtgccaggtattgggctgggagctacatgtgtttccccaaattgtagccctcctgcagccctaggaggtggatgtccttagctccatgacataagcaaggacactgaggctcaaagagggggtgcaacaaagcatttctagagatctgtcataccacatcgtgcctacagttaacaatgctgtattgtacacttaaaactctgttaaggccaggcgtggtggatcatgcctgtaatcccaacactttgggaggctgaggtgggcagatcacctgaggtcaggagtttgagaccagtctgatcaacctggtgaaaccccacctctaccaaaaatattaatacaaaaattagctgggtgtggtggcacacacccataatcccagctactcgggaggctgaggcacgaggaatcacttgagcctgagaggcagaagttacagtgagccgagatcatgccactgcactcctgcttgggagacagagcaagactaagaaagaaggaaggaaggaagaaaggaaggaaggaaggaagaaaggaaggaaggaaggaaggaaggaaggaaagaaagaaagaaagaaagaaagaaagaaagaaagaaagaaagaaagaaagaaagaaagaaaagaaagaaagaaagaaactgttaaaaaaaaaaaaaaaccaaaaaactctgtggatctcatgttaagtgttcttactacattaaaatttttttaaggccatacacggtggcttacacctgtaatcccagcactttgggcagccaagacaggtagaccaattgggcccaggagttcaggccagcctaggcaacatggcaaaaccctgtgtctacaaaaaacatgaaaattagcccggtgtagtggtgcacacctgtagtcccagctacccagaaggctgaagtgagaggatcacctgagctcgggaggtcgaggctgcagtgaactgtgatggcgccactacagttcagcctaggcgacagaacgaaactgtctcaaaagaaaaaaaagaaagggggttggcaggggaagcgctccaccaacgggagggctccagggaagatgggcaggtgctttctgaactgaaaactgtgatgcaaacttgcacttgaagtaagagcactgaagccccagatgacagtctgacttcacctcttcccagctgagatgaccctgtgcaggtcacagccctccttgaacctcagtttccccacaggcttgttacaggtggcataaagctctagtgtctcacaaaaggttatcattagtagtagtatttttttttttgcactttaaaagcaagtgcaaagattaatctcaaaagcaaggggagcttgcctgaagcaaaccctacttgagaatatatatttttttcatctaagttggggtttctggctctctgggaatgctctggagcttccaaggccatctgaagaccctctgcaactcagtccccacgctgacctttctcctggggaggagatcctgcatcccattctcacattctggagaacagaccttgcataggtcagagccctttgaaaaatcaaaccaattctgccctttagaaatggatcttttttttttttttttttttgagacagagcctcactctgtcacccagactggaatgcagcggcatgatcttggctcactgcaacctccgcctcccaggctcaagcagttctcctgcctcagcctaccaagtagctgggtttacaggtgcgcaccactaatgcccagctaatttttgtatttttagtagagatgggatttcaccatgttggccaggctggtcttgaactcccgacctcaaatgatccacctgcctgggcctcccaaagtgctgagattacagatgtgagccaccacacccggccagaaatggatctcttgattgacaaaacaacctgagcaaaggctcccaaacacaattgcaacctgagaagcaggaaggaaaggcaccacctacagtttctgagaaacacatggagagggtattgacatcaccagagtggggaaaacctcttgaaatgttcgtggtgtgtccttccacttgtttcctggtgccctgagacctttcccctgttcagggcagggagcatgcagtccctgtggccacaaggaagggcagtttcaacagaagcagaaacaaggctcttgactttcaagagcctgggtttttgataaagtggtagtgacagagaacaaacaggtggttgccagcagatgaaggcagggtgtggctgtaaagggacccatgagagtgcctttggggggatggaactgttctttaccctgattatgatggtggctgactatacatgtggtaagactcaaaggaccataccactaaaagaagtcaattttactgtaagtttttttgtttttatagtcttggcttttgacttgttaaactcagggcataggagagtctgagaacagcatacacacaatgaagttgaagcaaatcttcctgcccacaaaactagaaaatgccctatgttgggttggtgaagtgtgagggtccaggagaactggaaggagcatagttctggtgggttctgatggtgcctccgtcccttgctgctcccaggcagacctgagcatgggatgaagggaacagaatcccaggcacatgtatgggatccagggacagagggcgtctgtgtccacactccctcccagagccagaagagggcatgagaccccagggagagaagggtaaagggagggtctaggtggatccaggcaggagggcttgggcagcccctcacagtcctgtatcaggcccaaggaactggcgaacagcagaacaattctgtgtcttacaaacgagttgaaagtaaatgctaaatccaaagggacctttcaccaggagggaagtacagtgtctctgcaatctaggggcagatggcacatggctgtctcctatattgccagccaaaaatagggacaggcagcctccttggtacaaacaaagcccctagcacagacatgaaaccccagggggaaattgggacatttctgttcctgagcaaaatggcatttgaaatggtaaagtatagataaatcagaaagatgtgtggacgcctgagtttatgaactgtgattcataccagctccccagacatcatctccccatagccctgtgaggcagattttatgctccccattttacaggtgaggaaactgaatgaagttcagggaactggactgacttgcccagggtcgtaggatttgaaccagggctgtttgagcccaaattcacccactttctgctgcaatacagacacagcctcccggcctcaaaccagagggtgtaagctttcattaactggctgcacaaactctactaattccttgccttatctgcctcagtttccccacaaggatagtagcaacctgacccaacccacaagagttatacgatgggaccactgtgaggatgattgccatgtacaagatgtgggcagagtccagcaagtaccttgaatggataattaagttcaaagccatggccccaaacccttgggggcaccacccagactctggagagcagtggagcaggccagtgaaggcctagtgtgagggaggcagtgtggcccactgattagcagggactcagacagacacagagggtggcagggtcaattgactccaacactcactcgctgtgtgtccccaggaagcagtcaccctttctgatcctcagcctcctcatccaatgtatgagagacaacaataccaaccactcctgaagaagatgaggttcaaatatggagagcacctggcatgcagtcagtgcttaataaaagcacatttattccttctctctccacttttgcttataaggtgttaggttttgcagggtaagagctgcgctcactggtccaggaccttggccttcctgtgtcttcactttttcatctgctgaacagactccaagggccccagtggtggggataaataaatgcctgattactccatttagggaaaggtagaagaaagggtaggatagagaccaggatgccaaaggatccctcaggcctgggaacctggaaagacttttccaggacctaaaagagaagcggcggggcactgtggctcacgcctgtaatcccagcactttgggaggctgagataggtggatcacctgaggtcaggagttcgaggacagcctggccaacatggtgaaaccccatctctactaaaaatacaaaaactttgccaggcatggtggcgctcgcctgtagtcccagctgctcaggaggctgaggcaggagaatcacttgaacccgggaggtggaggttgtcatgagctgagatcacaccactgcactctagcctgggcgacagagtaagactgtctcaaaaaataaaataaaataaaaattaagtgaaaatttaaaaaataaaaagggacgcatgaaagtgtaaagttcacaggtggggaaatcaaaatggccagcaagtgttgggaggcaccttcatctctcagtgcagtgattcggggaaaggacctgaatgtggatgtctcaccccaggcaagcactgcatctctggacaacttgcctcacactcagcctcagtttcccccttatagaataggagtacagggttgtgaggattttgtgagatgctgcctgtgaacaccatggcaggccaggcatacagcaggagctcggccagtgtctgctgttggcgttgtttttgttgttttcattctccagtcagttgcattctaactctgctgcatcctctctgggtctttcagcacttgtccccactggatctcagtttcctcctctataaaagaggaggagtcacctctccctctcagggttcttgtgaggacagagagctcctgacgtgcaataggggctctgaaaacaggagacccttgccctggaatggagacgcaccccagatgtaggatgcagtgtgactcttttgacattttaggagaaagaatcctccaactggagcaaaaaaattagagcaggagaggaaaggggccaagagatgagactgaggtcccttcctgggctctgtctggctgctcctttcaatgctccaagctaccttgggagcgtgggtccccaaccttggctccgctcaggaaaccataaagtcttgagtaacatcccatctcaggtttttctctgtttatcttgttgaccaaatagcttaactgtctcacctgctaatgtgattggcaattatttactttggagagccctgaaagacactgtcagattgcagaattctcaattatctagaaacccatcacccaacacatgcttcctcgtccccatactataaaagaggctgactcctcggcagaagtgagtgggggagagagaggagaccaggacagctgctgagacctctaagaagtccaggtaagagccatccattctgtggcccctctgctacccttaacggcagggatctcaggctcctgccctgtggggcagtgagtgatcttgatcactcactgggggctgtgcaagagaaacagacctggccaatgtcagggatgtggggatggccatttgctctgctgtcctaagagaccagtaacattgatatagaaatgggcactattaatgccgtaaatgaaagcctctaaggcataagttttagcttgaggttaccaatgtggatacagatgatccaaaaacctcctaaaattcttcacccaattttatacattttgatgcattttttctgagactaggatctttagcttccattggattcataaagggtctgttgcccaaaagagattcagaggctgtggtcaaagttacctccctaagaagggcacaactggctctttggaccaaagacctttcatttccagccttccaccacaaggatggagctttagctgagtcagccaatagatggaattttgcacaaagtcaccagttgtctccaaattgtaggtactagtgctggctctggacaactctgctggctgccaaatagacctgtgagaggtctgcaagccaaacctcaggggttgaccggaattccatccagggcagcttgaaggagaagagaaaggtgtcaaaatgatagaatgcatgtttgtgtgttgggtgaggggagggttgggagacctgccttcaaccacagctctgccatcaatttattgtatgaccttgggaaagtcactacccctctttggtctcctggttcttctcatgcaatgaagactttgatggccccaggaattccccaacaaaggtctacatgagatggtggctgtggccatgcgacccctgtattgtgtgactttcaagggcatccaccaaccatcatggcctgagctcaggccaaaggactgaacagggatgatctaaaacagttcaattcttcagcacttgcacgtttaacccttctcatttgctttgtctgaagagcagcaatgattcaaaccattgaagcaagcccgattggagaataaatctgatggttacttaatttaaccgagggttcacctggctctagcttctaatcctctgtccaccgtgtacttgtgaccttggggaaagttacccacactcggtagtacacaagtgggtttcaagaagggatgggagtatatttgaaactcccaactgcaaactcacttgacctctgtgagccttggtttctcctactggaaaatcagacaagtgaactgtgggcaagatggagtgaggtgaggctgggattcttggcaagaaggaaaaaaaccctcttctttggaatgtggtggagtggggctgtctcctttttaggcccctgatcagtggtcctcacctgtgcaatgcaggtaacaggtgcccatgtcttagggttgtgatgaagatgaaattgtgtaaagtggtcagcctgttgcctggcaaagagaaattgttcagcagtattagctattactagtgaccccctggtgttctggggagcaaacaaccccaccccccaggtgtcagggcaggtggtggataaattcctctctgatacccatgccatgttggacttgtcattctggccacagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatggtgagttttcaggggtgtatgtgtgcatgtgtgtgtgtgtgtgtgtgtgtgtgtgtgtgtgtgtgtgtgtgtgtgtgtgtccaaccctgcaaagtggggagggacagggctggatgggggagggggcctgaggatctggaattgtcagatctgacccccagagacccttacacccatttccagccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgagtgagttgtcctaaaatagagctttgatctccaccagggaaccccaggtgaagatctgccagccccaggcagtgaccctgaagcagcgaccctgaagcagcgagggagcggcctgaagatggagccaggactcagttctgagacccatctccagtttggcagggacacccgtcctccccaaaccagcaatgccctcagttctaggcatgtcctgaggccccagcatcatctataatcctcaccacaaccctttgaggtcgatttaataatctccagtttgcaaatgggaaaaccaaagcacagaggtgcctgtgttcacgctgctagagtgatgccaagtgagtaaggctctcactctactatcctaactccaaagccaaggctcttcccactacactgtggtcattttgttctctgcacctgtgaaatcccttagaacacagacggcctttgatgttagcgagagtataacctgcccaccttgatgatatcaatgtgatgaaaaacagtgtgatgtccatggaaaggtctaacgtggagtttcccatgagacacccaagagctcgcaaagcaaaaagcaagaatggaagcttgatgccagtgagccggcagagcctggttcctggataggactggatcaaagccatttccaaaatcctacccacccagggtctcactccctgacttggagacagacagacttcttgactttgattttcaaatgtacttgttggatgacctgggacaggacaccctgtctctctgtgcttggtttctccatctgtaaaatatagattatagaacccacagagaaagtgtattgtgaggactggaaaaggtgtaaatcacctggcgcagtggctggctcagtgaatggcctcacccatcaaatggcctccctgcttgatgggtgcggtcacaggcctggcttctcctggagacaacagggtgtgatgatggatggatggttggaaagataggacaatgggagaatggcttccttccaccctttctgcactctccctgacttcctgctcctcaattcccatgataaacattggtgattggccacctgacagggtgagtgattcttacccataaatgtttgtgcagatttacttccagttgcacctgcatcatccattcatccactgaccaatccatcatccagttatccatccttctacctaatcacttactcttccatccatgtacccacatatccactacccaccttcccatcaatccagtcaactaatatgaagtagccactttctttgtaaggctcttagctggcatacaggatgcagatataatccagacacagttgttgtcctgaatacctcatagactggagataaggaaagggccctgtgtgtgtgtcagatctgttccagggcagaggctggaaaagacctagtgtgtgactcagaacccacgtggcttaggctgcaagactcccctcccatctccctatcctgggtgggaagctctacctctgggatgggtactgttaggttaaagatggtttctgggtttggagctagaggagctaatgtttccccctccaatattactccctggacagcataaaggtcactgacccccagctgctggaacttggccttgtgcagagccctgatggccaccgtctctatgtcaccatccctctcggcataaagctccaagtgaatacgtgagtgggtcccaagagggggtgagaggatggctcaccgagggagaccctggtgaccatggttaaccataacgggggtattggagtctaacagacctgagcctccaacttcagctcatttgctgctatgctaagtggccttgggtcacttgggaaactcacttgacctcttaagtctttgtttctcctgctagaaaatgagataagtacaactgtgggcaagatggagtgaggtgaggctagcattcttggcaaggagaaaataaccctcttccttggaatgtggtggagctagataccagtggggctgtctcctttgcaggcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatgggtgaggccagaggagcagcttatcctgcccagagatgacagggtgtgatgccggatggatgattggaaagctgagacaatgagagaatagatgagtgagaggctgaaagggtgggaaaatggatgggaaggagggagcgtggaaagatggatggatggatggatggatggatggatggatggatggatggatggacagatggttagatggttgggttgatggagagaaggatgaatagatagatggatggatagatagatgatagatagatagatagatagatagatagatagatagatagataaagtagtacttattccttcttagaccaagctaaccaattttatgctggatctagcaacaagaaattggagtttaagccctgcatattacaggggaatggggatagagggcttcctgtgtgaacctgggtagtgcttctccaatttagttctaagcttacttatctgcaatatggaactgcactggagttattgatagaacctaccaagataacaggtgtgaaagtgctttgtcccagtaaggggtaaaatagacgtggatcctaactaggttatttatttcagttacctgtcacatggggagactgtgtcaaacctattacgcaaaagttgcccacgtggttaacttttaatgaacacatacattgggcttcacatgtgtcatctcattggatcataatgacaactacatactaagtagtatccattcatttatggactctgcaaagccttattggcacctgctttttctgagaaccatgtgtttatcctacacatacctgtgtgttcactgctgtacacaaatgtaactccctttacataagacccttgctgttggcctgcacgtgggtgtagatagacaaggctcggctttagtgactgagtgttgagactgtggggttcacagtggccccctctggagacttctccacaccatctccaggtccctgcatcacccatgacttttctctttcagacttggccccctccccattcaaggtcttctggacagcctcacagggatcttgaataaagtcctgcctgagttggttcagggcaacgtaagtaggcaaggtggggatcccctgatcctcaggttttagagcttcttgcactaaaacaaagccctgagctaagtgggtccgagtccctcaatttgataagtaacttccattcatcaatctatttgtccattgatccatctgtccatgtttcttctttacatctttccaaatgcattgatgagtctctgctctaggccaggccctgcttgtccacactgaagctgaaatggattggcccctgttctgagaaattggagaagttccctgtccagccttctatggccacagacagtctttcaacctatgcttgggtgtctcctataaccagggcactccactccacttagaatcagatgtgatgtcacagggtgaacactgggcttgttgtgtgatttggggcccttcacaacatccctcatgcctccagtttctcctcaggcatgtgtgaccattgatctgtgggattgcttagaatcactttcacacagaaaaatgacaggaaatttccccagagaacccccactagggattctgctgctccagggtgccactctgcctaactctcctctctgcccctggccaggtgtgccctctggtcaatgaggttctcagaggcttggacatcaccctggtgcatgacattgttagtaagtacctgctttcaagccctctgtccctctctgcaggagcagcaacttcccccaaggagttttttccctgcacaccctaggatactaggtccctctggcctcaactctctctattttgggcttcattttcccccgaataatccagataattttgagatagacaccgtgtctcctgcctcagccctgacactgaggacagctgggctggttggtagaaggaggcctggcttcctccaagcatgctgaacacagtcggatctccagaggcctccattccctggccccccaccttgaggaatatggactccttcacgttgagatcataactgtcgtctgtttttttattgcttgtttgtttgtttagacatgctgatccacggactacagtttgtcatcaaggtctaagccttccaggaaggggctggcctctgctgagctggtaagtgcccttccccacaccccagggttttgggggctggctgttcttctcctggtagaaggcagacgggagcttgggacaatgacatccaaagaaagagacaaacatctacagaggtacacacagggatgcacagagaaatccacagaaaagctgacagaggtggaaggatgcaggcagcacagcaacacagctaccaagagaaacacacacacaaatgcccagacacatggccactgatacagatgcacacactctcacaccagcacactcacacacatgcacacattggtggactcaccacacacagacacacacactctcacccagcaccctcacacatatgcacacatcagtggactcaccacacataagtacacgtggatacacagacacactcactcaaacacatgctcacagagccctgactccaggcctgatggcttgcccagggtctcagcctcctcctgtccctctggggcatgagtttgatgatgagtcaatatcagtaacgctcactgaccttgagtctccatcctgattagggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatcaggggccttgtcatccttcaccattacttgagggctcctgggttggaaacagccctggcctgggtggttgggcccatagcatagagtttggcacttactttgtagatctgaatagtcttgagcaggtcagggagatgttcaagtgtgtgtggatttcagaaggctttcccaggtgtccttagaaagggggaataaggcattcagggtagatataatactccaggtacagttaatgacatacaagtttgccgcaccacgaatgaaaatggcagatttgtgttagggaaatgcaaattagaactacaatgaaggccaggtgccgtgactcccgtctgtaatcccagcactttggaaggccaagacaggcagatcagttaagggcagaagttcaagaccagcctgactgacatggcaaaaccctatctctaccaaaaatacaaaaattagccaggggtggtggtgtgtgcctgtggtcccagctactcgagaggctgaggtgagagaattgtttaagcccaggatgtggaggttgcagtgaggcaagatcatgccactgcattccagtctgggtgacaaagtgagaccctatcaaaaaaaaaattaaatttaatttttagaaacacccagtaaaatgtcatctcacaccagtcagaacagctattattaaaaggtcaaaaaatagcaggtgccaacgaggttgcagagaaaaggaatgcttatactgctggtgggaatgtaaattagctcagccactgtggaaagcagtcaggagattttttaaagaacttaaaacagaactaccattcgacctggcaatcccattactgggtgtatacccaaaggaatataaatccttctaccaaaaagacacacacacattcattgcagcaccattcacaatagcaaagacatagaatcaacctagatgcccatcagtgatggactggataaagaaaatatggtacatatacaccatggaatactacacagttgttaaaaaatgagatcatggcctttgcagcaacatggatgcagctggaggcaattatcctaagtgaatcaatgaaggaacagaaaatcaagtctctcgtgttctcacttacaagtgagagctaaacattgagtacacatggacacaaagaaggaagtaatacacaccagacctatctgagggtagaaggtgggaggagagtggggactgaaaaactacctatgggtactatgctgattatctggatgacacaattatctgtacaacaaacagtttacccaggtaacatgtaccccttgaacctaaaataaaagttggaaagaaaagaagaaaatggcagatttaagagatgttcaggaggtagatctggaaggatgtggacaagggcgtaggtgaggtgcgtgtccagtgtcaggctgaggagccaagggtacctggggatctgggaggatgaactgattccgacagacaaagtatgcccttagctgtggctactctgtgtggaaatgcctgggacacccggaggatccatccaggaagctgatggtacacaagtcacctaccgcccatcttttgcttccttgcatgcagtcatactgacctcttgtcaattctctaagtaagaggaggacaaaaaatgaccaaggacgaaatgaaaaggacaaactggtgcaaagtgttcactgctgggggtttgagaaagatacaactagagttgtaagtaagcagcagcttcttgatatcctgggttggagtcatattgttggaggaagaagcctgagtttcaggtactgagaagaggaggggaggtaaggaagttgagtctgtgtatgcagataagatttatgaggccaggctcagtggctcatgcctgtaatcctagcactttgggaagccgaagtgggtgagtggcttgagctcaggagtttgagatcagcctgggcaacatagggagatctcatctctacaaaaaaaaaaaaaaagatatatatatagagagaaagaaaaattagccaggtatggtgacatgtgactgtagtcccagctacttgagaggttgcggcaggacgatcgcttgagccatggaggtcaagggtgaaataagccatgttcacgccactgcactccagtctgggtgacaaagcaagaccctgtctcaaaaaaaaagaaaaaagaaagaaaaagaaagaaaagaaaagatttatgaaatactggctgtgagaaggaaaaagaatggggctacccagactgaagaactctgaccccccctcaaataaaaaatacatacactctcattgttgaggtctttagggactagtccaaccctttcattacacagatgagatactgaggccttggggttgtgtgaatgacttgcccaaggccacagggagacaaaagggccaatgaaagactggaaacatcccagactttacagaaaaccatgtcccttgctctttggagaccttgttgagctcgtgagaatgagcagattccagttcatgtttctcaaatctctgattctaaactggggacctacccattccccaacccctgtcagacatcaatcatcaagtccagacctgccactatctccacctactgttgcctccaatcaacatggcatcatagaaggacagttgcatagctcagacttcgagatttgttgtgtgacaccatcatgtgtcttcagggagaatttaagaaagaaagcatattccacacccacaaaagttctctgagctcagatgagtaattaactcccagcaagcagctgaatgagccttggaaatgtccacctaggcactgaccggaaatgcagaaggaccttccagataggaagccagcaactggggcctgctcgtgctagagaggctccaagaataagctaccttcaggtcctctcagggcaggcactggatcagcactgagagttccctgtgtctgaggccccaagaactgagatggatggagcccagggacacacatctagaaccatcagtgctgggcctgctgccctctggccattgtactgaaccgtgttcctgcctcacacccatcccctggccatctctggatatgattttccccctgctcccctggacttcttcctatagcccacagaagggtcctcccctctctgacaagttcaatttctaattagctaatctagaattcccctggatacaagacatcctgccaggtggccaggctagtcaaaaacatttatgctatttaaagagtggaaacacatttttaaaactctctgggattatgtcagtgaaagtggcaaaggaaaggtctctgaaaattttttcctacgtaaaagcaatgagaaaactgacagaaatggtcttaactaacattttcagagctctggaaattaaccaaagcttgtagcaatctggggagagtttattcaatacaaattatggagtctcagcaagaacagagagctttgtggcattttaacctctcccatctccccatactcccgctccacagccaactcgaaaacgaaaagcccacaatctttgtgagaaccagcagcccagtagacactggagaggtgaggagggagttagagcaactcattcgcagagaattgtcattgtttgaccggcccattggtttcccaggaagacccattctcatgattgtcattacttgacctgacgcagagctcccctggtctgaacaaccttttccccaaatacatttgtcaaaaaataaccagaggcaactatttaacaccacagctgcctgaggggatgtaatatttggggcaaacaaaaaactaaccaaaaagctgacaaggaaaagctggggaataagatatctatatgagctttgaaaatctccaacatactcctagggctctaggagggcatgtgcttacagggagctgtgtttatgtaaggagtaaagattaaggcagaattgtgttaaataaaaattagaaaaggccactgttttgaactgagctcctgcactaggcccaacagaccagaccaaaccagaatggagccactcaggcatgggatcatgtaatcaaactaaactttagtaacaggccagttttccaaccaaccagagggggccaagtctacctgagccagagggtaagaaagttccctcttccttaaccctataaggaaagtaactttgagatgatcaatctattttttgtcccctgtttcttcttcttttatacctataaaacccacctctgctcagcccacaggagctcacaggagcctttctaaatctttagatgggatgctgcccaacttgctaatctctaagaaaagcccattagaacatatccctatgtttaaggtaagctttgtgaacagggtattcagtacctgtggatctcaacccgcactgagggtcactctcctactggggcccccatcagattggcaatatgtcacatgtggactattcatgcctggagggaaagctccaaatacacgggtgacaggtccacaatgtttcaaatccccacctacggctgccactgctaatcttcaccagtgtgttgtcaatctaggcactactaggtactctaatgaaacaaaaaggggaaagatttgtttccccatcctctaccctcttctcatactttgtggctggaggtgtgtctgtctattaatcggggtgctggctggctgtccaggtattacaacccaggctgtgtgtccccatcctgagactacctctgtggacacccattgcccttcctgcttgacccagaactttcagcctcaattgtccagtccaggaagggagatcatgtactgcacaaatttaacaggtctgataatgttgcccacctgagtagaaggatcagatgtccctggagccactaatgggaccctaacatcctggaactctttggtctcatccactacccctgtggagtcccataaaagagaggtgcccaggggaagcatcaccaccagattagagttagggggccccatctggggtattatgacagcctgaaccacaaactaccccagagacgtgcactccttagggaaaaagaaaaaaagaatggttgagaacacggagattggaatttcacaggcacagcctaatcaagcactgtccagtccatgtccacctcaagccccaccaagttcagtgtttcccagcatgtgctgcagtatttactgtgcatcctgccctaatcaggcaagggtaccagcccattagcagaccaccttaatgtcctttcttcagttgctacttgagttaaccgctccatcattcattggctccattggcccgcaggtgatatgagtgcaaactcacattccatgagtttgagctcattgttgtgttgcttgggcagtaaaatatattctttggtcagagtaaagtcccacaggtatccaaaaacatgacatagttctttttaagagcatctatggtagtttcagagttcacatggtggtctagaatggtaataccacagcctgagtaggtgtcaatggcaatgaggacatgagtgcccatggcaggaggccagaggcctgttgtggtcaatctgccacaccagggcagtttctagccctcagttaatgtatcccaattcctctctttgaacaatttgtgccccttagcaagaatcacaaggttgtactgtgtccctagtctcggcatcttccaggatgctcgttcttgcatctgaggcggatgtcttagtccattttgtgttgctataaggaaatacctgaggctgggtactttctaaagaaaagaggtttatctggctcacagttctgcaggctgtacaagaagcacgctgccagcatctgctcagcttctggagaggtcttttgtgtggtgacacaacttggcagagaaggccatagaggaagcaggcacatgctgagaagggccaaactcaaggggtgtcctgactttataacaaccctctcccgtgggtgctaatacatcctcccagaaccaatccagtcttgtgagagcaagaactccatcactaccaggagaatgacactaagtcatcagtgagagatccacccccatgacccaaacacctcccactgggccccacctcccaacaccatcacttctggcgatcaaacaaatgatatccaaaccatagcggtggactttcagttgtcgattgttgctggctgtggggcacaagcttaactggcacaagacttctgtccacattccattttaaaaggtcctttgctatgatcatccacaggagtgacaaacatttgtctccttccaggcagcaagctgctgtcatagtttttgttcccacacaggggattctgtgatggttcagtcactcagttaccattctcctgaccagatggctaggctgttggcaatggcccttgagtcagtgaaaatgtaacaagatatggtggtagaatggcccccacagctgtcatcactgcacataattcagctcattaggcagaatgtccaattccaatcccagccaaaagatggccatctgctggctgaggggcagctgcagcccagtggaccccatttgcctttagttttgcagagccatcagtaaaccaggtcatatagtcagtagacacatctttgaatcttgggtcccaggtagccacaggagggttcagagcatctccctgtgggttgcttggtgcttctgggaagctggctatttgttcatggagtctacttgtcctagttgacttggatgtaccatttccatttaatgattgagctctgttgagcttgtccggttttattggtgggatttgtaagcaccccagtacaggttacagcatcacaggtggcactcctgccataaaatgctcagtctcctctagtgcccaatagcaagcaaggagttgcccttcaaagggggtgtatctggtggccaccacaggcaagtcatgtgtccaatagccaagaggctggtgcacgccagtggcagtttcctgttgccacagattccaatcagcatgcttggcggtcatggacgcacggagtcccattgagctagcaggttccaaaggtcccaaaggcagtacctgagccatgacttgttgaactacttccaagtcctgctgctgcaaggggccccattcaaaactggtggttttgtgggtcaccttgacgaggaaggccaaaagagcacccagacagggcatatgctgtctcctgtatacaaataggcctatcagctaatgggcctcctgtttattagtggatgtcactagggccaacaattgtactggggatacttttttggtttcctatacaaatgacccctgggacatgcacttattgtgctgagtcctggactttatctggatttatagtccagccaacaccagttattgtatcaatggcctgtttttcagtaggccctactatcaggatatcatttatgcaatggatgactaaatcttctatgaggacttgggcttgttgagggtcaagccccacccactggtggcatatggcaggggaattgaggtatccctgaggaagaatagtgaaagtattatgcaggcagttccttgtgaatgcaaattggtcacaaggggattgagtaaaagcactaaccaagttaataacagcacgctaatctccagtaagggttcccactgcctcagtgacagtgatgacatctgacacctcatgggcccagggcaaaccccaacattcagcctgcattccgtctaccatcagccaccataccctggaggcttttcaatcagccagactgagctgttacattgacagggtagtttgtaacattcctacagaagcgcatcccaaattcacagagtaatatcctcttctccacttggtatgcagtactgtatttgtggaataacctactgaggcttggagaatttaagtggcaggtagagtggacacacctcactgttacggctcaaattctcagctgtgagggggaatatcccctcaggcagtggtgatgttctgtgctacaagcagccaaaatatcaatgcccgtaatgcactcgacacaaggaaccatggtcaccagcactcaaaatggctcaaagagcctcactcgcaagcacataagtaccacaagcaggtaagcaccatggatcaccatgttaacccccaaaccatccaatgacatcagtttaatttttcccctaaggaaatccagaaatattgtcatatgggaacgagtatccacgagccccagaaaagtctgaatctctttcttttcccatttatcttgacaggggtataagatcattggtctccagtgggaagccaggagccttggccccattcctaactgtgccattcaacctgagacatttgagtctgcaatatccctttatcaaacaaacacaccatccgggctgtattagactttctggcttttgtccacattttcccttttattgtcagatatcctcttcagagaatgacctcatttcaatagtctagttttcagcaatgccttctgttgttcagcactttttggaaacaggccttacttgaggcctgcaagcaacctggaccaggcaggattccctgcacagggccccccattccccccagacatcatctgtggtccctgggacaccatgggagttgacattatgttccatttatccctgggcagcgagcacctcagtcagtctatgacccctcagaggagctggtaccaccttgggcaatggggctgacaagcccttgcctttccaccatgtgatggtctatttccttggcaaccctgcacactatgtcaaactgttaagctgaacgtcctgcaccagtgaccagtcccaggggagaggaacaccatgcacaggttaccaaccctaggagagggctccaaacacttctgcccattttatcttggtatgggagtcaccaaggaaaatataacactttacttatgtagagaagagacaaagcaaaatcagcttcaatcgtatgcatttgtcccccatgccagcagatccccccaatagccagtgcaaggcaattggctatggacacccctctcatgccacggatggactctgacccctctcctgtggagttagaaataccaaaagctgggggcatatctgagggccattgacatatacacttaagcagaacaaaggggcacacattgaatctaaaacagggaaatatattcccatgcagggcctggaacaggccacgtgagccctttatctcttggtaaggaagtgttccaagcccaagacctgttcttatatgactgagtgggagtcgaaaggctgcatgcatgagactggttttcccaacacaatcattagctgaccagtaagctaactaagcagacacagcagtagccacacatgacaaagaatacagactttacagaatttgttcagaaaaatcagtaaacaaacaactacaagaacaagtaacaaccaaaaactctggagtggagggagaatccaatttctgaaactgccatgttatattatttaaaataccagtgttcaacaacaataaaaaaatgagatacgcaaagaaagaagtatgacttcccaagtatgacagccatagaagctatctctgaagaatctcagacgttgaacttactagaaaaagactttaaatcagcaaatttaaaatgtgttcaaagaacatatgtctaagaaaccatggcttagaactaaaggaaaatatcagaatgatgtctcacaaataaagaatatcagtaaaattacagaaattgttttaaagaaccaaataaaaaactgaagtttagaagcataataacaaataaaaaattcactagagaggctaaccagcagattttagcaagctgaataaacagaaaactttttttttttttttttttgagatggagtctcactctgtcgcccaggctggagtgcagtggtgcgatcttggctcactgcaagctccgcctcccgggttcatgccatgctcctgcctcagcctaccaagtagctgggactacaggcgcccgccatcaagcccggctaattttgttgtattttttttttagtagagagggggtttcaccatgttagccaggatggtcccgatctcctgacctcgtgatctgcctgcctcggcctcccagagtgctgggattacaggtgtgagccactgcgcccggcccagaaaacttgttttaattttttattttaatttttgtaggtacatagtaggtactatatgtctacatgtagtatatatagtatatacatatatatactacacacacacacacacacatatatatatttatatgtatatatatggtacatgaaatcagttttggttttttgttttttgtttttttgatatggagtctctctctgtcacccacgttggagtgcagtggcacagtctcagttcactgcaacctccacatcccaggttcaagcaattctcctgcttcagcctccctagtagctaggactataggtatgcgccaccacacctggctaattttttgcatttttagtagagacgaggtttcaccatgttggccaggctgttctcaaacagctgacctcaggtggtccgcccacctcagcctcccaaagtaatgggattacaggcatgagccaccaagcccagccatggaatgttttaatacaggcacacaatgcttaataaccacatcatataaaatggggtatccatcccctcaaggatttatcctttgtgttacaaacaatctaattatactcttttagttatttttaaatgtataattaaattattattgactatcgtcaacctgttatgctatcaaatgctgggtcttattcattcttttgaactattttttggtcctcattaaccatccccacctgcccccatccttgcattacccttcctagcctctggtaaccatcctgctgctctctatgtccatgaatttgttttgatttttagatcccacaaatcagtgagaatacacaatgtttgtctttctgttcctggcttacttcacttagcataatgacctttagtttcatccatgcttttgcaaatgacaggatctcatcctttttatggatgaatagtactccattgtgaataagtaccattgtgaataatatccattcatctgttgatggaaacttaggttgcttctaaattttggctattatgaacagtgctgtgacaaatttgagagtgcaggtgtctctccaacatagtgagaatcagaaaacttgaaggttaatcaattggggttatctagtctgaggaacagaaattaaaaaatagaatgaagaaaataaaaacagagtgtcaaaaggctgtggccaccataagcatgctaacatacatatcataggaattccagaacaagaggagatagagatggggatggagggagaacatttgaaaaaaaattactgggccaggtatggcggttcacacctgtaatcccagaactttgggaggccgtgtgggtggatcatgtgaggtcaggcattcaagaccagcctggccaacatggtgaaaccttgcctctactaaaaaaatagccaggcatggtggtgcatacctgtagtcccagctactagggaggttgaggcatgagaataacttggacccaggaggcagaggatgcagtgagccaagatcacatcactgtattccagcctgagtgacagagcgagactctgtctccaaacaaaaagaaagaaataaagaaagagtagctgaaatttccgcaaattttatgaaaaacattaatctacacatccaagaagttcaacaaaatccaagtaggataaattcaaagagatctacatttagacatatagtaatcaaattgtcaagagacaaagacagaaagaatcttaaaagcagcaagagagaagtgactcaccaagtacattaaaccctcaataagattaacagttgatttcttatcagaaacaacggtgttaagaaggcagttgaataacattcaaagttctgaaagaaaaaaaaagactgccaacaaagaattctccatccagaaaaactaatattcaaaaatgaaggaaaaattaagagattcctacatcaacaaaaactgagagaatctgacactagtaaacatggcttaaaggaagtccttcaggctgaaatgaaagtgtactagtcaacaatttaaatctaaaggaggaagtaaagaacatcagtaccaataactacatagttaaatataaaagacaatataaatgtattttttgtttgtaactctttttgttcacctgactaaaagacaactatataaagcaatacttagatgtgtcaatgagcatacaaatgtataaatatgtaatttgtatggcaataccagcataaagaaaaggggtgacagaggtatacaggaacaaaattcctatatactattgaaattaaattcacattaattgaaatagactgttctacgttaattataattcctagggcaactattgagaaaataactaaaaatatatagtgaaagaaatgacaagagaattaaatgggacactagaaaatatctatttagataacaagaagtaataattgaggcatagagctacatataagacataaaacatataaaaaacaaatagcaaaatgctatgagtaaatcctattcttttctatcagtaatttaattaaatgtaaatggattaaacttgccaattgaaaccagagattggcagaatggattttaaaaacataatccagttatattctttctacaagagacacattttagtgtcaaagataaaaacagattgaaagtaaaagaatgaaaaaaaaggtatgccatgcagtgaccaaagaaggctggagcggctatactaacatcagataaaatagactttatgacaaacacggttacgtgatacaaagaacatttataacgataaaggggtcaatccctcaagaagatataacaagtataaacatgtatgcaactaacaagagagccccaaaatacatgaaaccaaaattgtcaaaattgaaggaaaaaattaaaaattcaacaaaaatagcaagaaacttaaacacacaattttcaacaatagaacaactagacagagggtcaacaggaaatggaagatttgaacaggtctacaaaaccacctagagctaacagacatctatagaacattttttccaacaatagcagaatgtacattcttgccaagcacacatggagcgttctcctatcagaatagaacatatgttaggtcataaaacagtttcaatacctctaaaaagatggcaatcatacaaagtgtgttatctgaccacaatggaatgaaattagaaattaataacagaaggaaatttggtaaatttacaaatatatggagattaaaaacactgttggctgagccagctttaaagatgggctggatacaatatgtgactatcagtttcagacttctgtaatagaaagcatcctagctggattgctaagcatgagatgaagttcttggtcaggtgcagtggctcatgcctataattccaacactttgggaggccaaggcagaggttacctgcaaaggaagcaaaaccaggttggccccaggtttttttcctacaggatattagaagacaagagttctcaatggagatgggaagaaggctgagagtaaaggattcagatcagcagtgttttcatattgcttatgaaagtaataaacaagaataagctatcaagttaagtgttcaaggaatcaaaaatgatcctacacatctgtccatttttaaaaagcaagcaactgggaaatgagtctaacttaacttgtgataggaagagacacagaataaaaatgatcaatgatggttttgggaaccagttaaaacctaacatattttaaaactccctaaatttgggacactactacatgcctaattggatgacccaaaaaaagaaaaagaaacctgacaattctgagtgatggtgaaaacacagagccagtgaaactctcatacattcctggtgggaatgaaaaacagtatggcccctctggaagacggtatggtagtttcttaaaatgttaagccgataagaggcagacacaccaatatctccccttggaggccatggaaaatgagtcatggactcaggtcatgtggcagcagctccactatcacctcgcccagcttcccgagggtcagcctagggcccagctccgcagaagatcacagcccctgcatggcactgcagccaccataggcctctgcccagcaaccatggatcccacagccatagcatagcaaaaaccaaagaacaccccagcattccaaatggaacccagctattaactggaagcctggattggtctcttttatggtcagttagaaaagaaaatttaggtcaggcgcagtggctcatgcctgtaatcccagcattttgggaggccaaggcgggtggatcacctgaggtcaggagttcgagaccagcctggccaacatggtgaaatcacgtctttactaaaaatacaaaaattagccaggcgtggtggtgggcacctgtaatcccagctactcgggaggctgaggcagaagaatcgcttgaactcaggaagcggaattcctcagttgcagtgagctgaaatcacaccattgcactccagcctgggtgacaacagtgaaactttgtctcaaaaaaaaaaaaaaaaaaaggaaaggaaaggaaagaagaaaatttataaataaaatatgttttgtccattactgctaatgatcattcttcttttcctttctcactgtttttgtaactatataaaattaaaatgtagtaaaatgtgcacatgttaaatgcatggctttatagagttttaaactttatattccttatagtataccacagccttatcaatatatagatcatgtctattaacacataaaatatttccttgtggccaggtgctgtggcgcatgcttgcagtcccagcgctttgggaggccgaggtgggcaggtcacttgaggtcaggagttcaagaccagcctggccaacatggcaaaaccccatcactgctaaaaatacaaaaattagccaagcatggtggcaaacacctgtagtcccagctactcgggaggctgaggcacaagaatcacttgaacctgggaggcagacgctgcagtgagctgagattgcaccactgcactccagcctgggtgacacagtgagactctgtcacaaagaaaacaaaaaaaaactccttgtaacgttttaaccaatacccactcactctaccatatgcagcccctgttttgatttctagtaacatacattattttagccatttcttcaacttcataaaaattaatcacaatgtatacttggaaaaaaatgttaaacatacacttaacatatgacccagcaaccctacttctagatttttaggctagaggaatgaaatatgctcacaacaaaacctgttccttcatgtttggggatttttttttggcggcggggggcggggggggggcatttggttttgcgtgtgtgtgtcagagtctcattctgttgcccaggctagagtgcagtggcatgatcttggctcactgcaacctccgcctcccaggttcaagtgattctcatgcctcagcctcccgagtagctggaattacagatgcacgtgaccatagccagctacttcttctgtatttttagtagagacagggtttcactatgttggccaggctggtcttaaactcctgacctcaagtgatctacccaccttggcctcctaaagtgctgggattacaagcgtgagccaatgcgcctggccgtgttccttaatgtttatagcaaatttgttcataatatcccaaaactggaaacaacccaaatgcctttcattaggtgaataaacaaacttcagtacatctataccacagaatactactgggcaatgaagaggaacagatattggtttacacaacaacttgaatgaagttaggaagaggatccgaattctcattgtctgcctgagggatgatttgataggtatcaaaggtcaagacatgccattataaagcaggaagaagatatgaatttttatttgtttaaagctcaagtttgtgatgcagataaattctgaaaaatataaaaggaataaaaacccaggaaactcacttatagatcattcatactttaaattatgacttccttcccaatgtccctgccactattgttttcagaaccctcagagagctttctcattcactgtgtccagggtttttgtttcattcagtaggaaatacagagtggaacggcttactccatccatttccactctcccgtttgtaaaacgagctggattacggcagatgagggtggacctccagaaatttaacacagtgcgttgactgttgtagtatctttactggaacagcccaatgcagccttaggtacttactatggagcttttaatctggaaaatgtgttcttttcaatactcaaggtaacaagctcagaagcaaatggcactcacttgggataaataacggtacacactcagtcttgcccctgctctctcttgttcttaaaacaagttatccatggctgggcacagtggctctcacctgtaatcccagcactttgggaggctgaggtgggttgatcgctttgagctcaggagtttgagaccagcctgggcaacataatgaaacctcgtctctactgaaaatacaaaaattagctgggcgtggtcctagctactcaggaagctgaggcatgagaattgcttgaacccaggaggcggagtttgcagtgagccaagattgcaccactgcactccagcctaggtgacagagtgagaccctgtctcaaaaaaaaaaaaaaaaaaaaaaaaaaaaagctatccatttgtaaattgctgatttctttagggcattggctccataaacttttcataaagcctcaatgatttcaccattcacccatccaagtttcaccataaatttgatgtgtattcttgcttcaattttagcaggattcatgtggctttgatagggtttttttctaagtgatgtcttatccttcttattgcctcaaactagatcccgttcaacatgttataacaaattagttcaagtttattttggtgcaaaaagaatttggaaatgcaggcatagtttcttcataatatgcattttccataagcttttcggagaccttcataggataagagatctattgtagagatttgatcttacagaaccatgggagtgggttaaatagtccttgttaggctgttgttttgcatctggtgctggagcttcaacccagcagggcgggtagacaggaagaggagatggatatgaagtgaggaagaacaaagaaaaactgaaacctgatttagggtctctgcacctccaagtccacagatgcaggggcacaaggaaggtttcctgctccttcagtgaacacatttgagagtctgggcgtttggtaaggccatggaatagaagccagagactgggtgctagtccagacactgcccccactgtgtgtgaccctgaatgcaaagtagccaagaccagtcacaatcccacagccctcttttttttttttttgcttgaaacggagtcttgctctgttgcccaggctagagtgcagtagcgcaatcttggctcactgcaagctccacctcctgggttcacgccattctcctgcctcagcctcctgagtagctgggactacaggcacccgccaccacacccagctaattttttgtatttttagcagagacggggtttcaccgtgttagccaggatggtctcgatctcctgacctcgtgatctgcccgcctcggcttcccaaagttctgattcccacagccctcttgagtatgaacagcagtgcaaccgcagaactcactgcacaacatcctcctctttggggctcagtcttccaaggtaagaaatgggaagcttttagctgttgagtctttgcttcagatgaaactctgtccccaggaagatcaccacttgacgtatgctaaagctaaacgtagctcccttagtttctcccttgtattagttatctatcactaatacataacaaagtatcccaaaacttcatggcttaaaataacatgtattatctcataggtattaccctcatgtttctgtgggtcaggaatatagaaactgcttagctgggtggctctggctcttgcgaggctggagtcaggatgtttgccacgatcatccaaaggcttgactagagccccagagaatacaagagggttcatacacatggctgtggctggagaattctcagttcctggccaccagaatatccgcactgggctgcttgagtgtcctcacaacatggcagctggcttccccaaaacacgtgatccaagagagcaagagagagaaagaagaaagctgcagtacctctttttgacctcacctcagaagtcacacaccatcactttgggccataacctattcactagaagtgagtaaatccaccccacatgcaaggaaaggagaatgaggctctccctcttaagagggagcatcaaaggattgtggatatattataaacaactatactcccttccattccggaagttaccctgggcatttccttcaatggccaaagtcccaggagcaggctttcttaaataaatgagtctttcctccttaggtaaattcttcaatctctcttgaaagtgcaaatggctatagtccggtgtttttgttttctattcttgttttgattattcatttaatggtaatttttccttcctgcttcattcagaccagataaaaacagaaatactctagtggaagtgggggtgaggggcacagtttcaacatctctgccatctgtcgtgtctcctccagtgttggcaggcatgcgatgactttagatggttccgagatacagcatgaaacaaccttgagtcactaaggggaaatgtttctgttccttttgtaatttttctttccttattctgattgcaacaaggaaagagtgtcagttgggagctagcctgtcttgaatgctctgggtgatgctgccgcaatctcttttttatgaaagagaaaggagaagagggagagagagagagagagagagagagagagagagagagagtgagagagctggactccagttcttctcaccacattatccaggaaaacttaataacgtttttctcttccgtttgcatctacttagcagttaccctgtatttcaggaagttgatggtgaaacttaaaatatgtaaaagttcctgttatattataatagatttctttaaaaataggaagacacccaaaaggaaaatattaagtaaataaaagtaatggttgcctgtatatggcacaagtcgcagaggtgatatgtgaatgactggaattcggggagcttagggaccatgcctccaatgcctgaccagcctggctactggatttcctgaagccaagctctccaggcccctaaccttgcaccagcgctcacactgtatgtcctgtggccactagaggaagctgttgcacatatatgtacttcccagctaccaccctgggaatgaacactaacatctatgtagcagtaactcctttaaggattgcatctaatcttcccagagacggggtctctaaggcccaaagtcacagagcttgtgagcagctgatccagaatccaaatcccagcagtcagactctggagctcaggctatttgtcataggttgaaaactcatgagctccagccaaatccgatgcattgttatttttttagattttgctttgaatgcttgattgttctccagctggatgctaaatacaaatgcattcatcatatcccccaactagcataccaagttgtcttacattattaactgtttagctcctaaagcagattttcagatttaccagtaaaaatacaggatacccagtgaaatttacatttcaaatcaacgacaaataatttctagtgtaagtatgtcccaaatatttcatgggacatacttacactaaaaaaattttcatcatatatctgaaatttaaatataactgggctttctatattttacctgtcaaccttactgatatggtttggctgtgtccctatccaaatctcatctctgtagttcccataatccccacagatcatgggaggcaccaggtggagataattgaatcatgggggcagttttccccatcctgttcttgtgatagcaagttagttctcatgagagctgatggttttctaaggggcttcccccttcactgggcactcattctctctcctgccaccttgtgaagaggtgccttctgccatgattgtaagttttctgaggcctccccagctgtgcagaaccatgagtcaattaaacctctttctttataaattacccagtcttgggtgtttcttcatagcaacgtgagaacttacgcttactctaaaagcatctttgcatttgaaactcctgctctgtccctcattcccccacagaggggaatatttatagagaatctactatgtgctggttttgagtgggacgcagagaaacaaaaggctctgcagcaggctgcaaacagccctgatgcttcagctatgtggtggtcaggcagaccccccaccgccccgccatggtactgaaactctctgggatctataaagatgccatgtggactttctggcgagccccagtgagggagtcacagactgctagatttctggagcaaagccatgctgccttcagcagggaactgtataccatgagtaaaacagcttctgacatgctacagggccctggtcaggaaggggcgcctgatcacagggcatcagtaaccatgaggccagaactgcccatcaggaactggtcactgtcatccaccaagtcatcaggtcagcaggaccaacagcaattcttcatcaggcagaagtggtgtctgatctagtgggggctcaaaaaggtccagggggcaaaagtaagctacccagaccttcgcatcacctactagtgttgcacccagcttctccctgggtgcacacccatggccccatagatgttcccgaggatcagctgatggagaaggaaaaattctaaacttgattcatgagtaggtcagctcagtatgttagaggaagccaaaaatcgacgatgtttcacaccctcaggagtgaccctgaaagacagcaacccgaggaaatccccccaggagtaaagcttcaggctgtgcacttgctcatccactttgacaaaaaaacaactggaggtaagatttataggccaggtgcagtgactcatacctataatcccagcactttgggaggccaaggtgggagatcacttgagcccaggggtttgagaccaacctgggcaacatgacaaaaccctctctctacaaaatatgaaaaatgagccaggcgaggtggtgtatgcctgtagtcccagctactcgggaggctgaggtgggagaatcacttgagcctgggaagtggaagctgtagtgggtcatgattatgcactagacttcagcctgggtgacagagagatgctgtctcaaaaaaaaaatttacagacacttgggctggggaaaatggtttaattgtttagtcagggacctggaagaaacaagattggaagactggggacaccaaggctgatctagtaactgccagtgagtgtgtgacctgtcaaccacagacaaacactgacctcctgctatggtaccatccattcaagagctcaaccagccagtttgtggcaagttgactacaacagaccccttcagtcctggaaaaggcattgattcaccctgactaggactggcatatattttcagaatgggtttgcctttcccacctgctaagcctaaactgccatcactaaacaaaggctggcagaatgtctgattcactgacaccaggtcccacacatcatcaccttggaccaatggagccatttcagcaaaggcattgtgaagtgggcacatggttgtgagatccactggttttactatgtatcacaccatccagaagctgccagcctggtagaatgatgggaaggctcttgaagaggcacaatcttgtgggcgatacactgcaaggatgcagtatggtactgtctactgctgtgtaacaaattatcccaaactcaggactctaaaataataaacatgtgttatttaatggtttttttgaatcaggaatttgggagctgctggactgggcattctggctctgagtctgttatgaggttgcagttgagttgttggctggcgctgcagtttcatctgaaggctcgactgagtgaacatgctttcaagtttactcaagtggttgttggttttcctcagttcctcaccggccattgatcagaggcctctttcctcaccacgtgagcctctccacaggtggcgttgtcctaatagtatggcgactggctttccctagagtatgtgatccaagagctcaacatggaacccacagtcttataacctaagtctcagaaatgacatagcacaacttctgccatattctattggtcacacagaccaccctagtacagggtgagaggggacaacacaagggtgtggataccaggaggtggggaattggaggccaacttgcaggctggcttccatgggcatcatcccttaggatgtgatacacaccttaaaccctaggctattttatgatgctgggtgctcactacatagaatgcattggtctagaaatcaagtacaagtatctcccattcaacatcacttccagtgacacacatggagactttgaactttccattcccaaaactttagtctctgtgagtctagagtctctggttcccagagtgggaaggatcctttctctagggaactcaatgaggatctcgctaaacttcaagctaccactgtcattgggttgctttggacttttcatgccagtagaccagcagatgaagaaaggagttttcatgactgcaggggtaataaaccctggggacgcaggtggctggggaaaagcaggaatgtgtttgaaactcaggtcaaccatggggtgactcccatagtcccatgcccagctttgactctaaagagacaaggataataaccacagcttgataaaggcttgatgaccagggtgctcagatccttcagacatgaggtcccgatcaccccaccaagacaagccacctggacaacaggatcgctgaggatgaggacaatttggaacacatagtagaggagggagactgtgagtatctgctgcagcctcatcatcaattgcagcatcagagactcttgttggtcttgcaagtttcccgtgaattatgactggattagtccacataggctgccataacaaaataccagagactgggtggtttagacaacagaaatttattttctcactgttttggagactggaagtccaagatcaaggtgccagcaggactgattgcccctgagacctctcctctttggcttgcagatggccactgctatggtttgaatatgtccccctgccccaccaaaattcatgtgttgaaacttaatagccaatgttatagtattaacaagtgaggttcttaagaggtgattaggttatgaaggctcctctttcatgaatgggatcaagtgcccatataaaagagcctgatggagaaagcccctttttgcccttctgccttccaccacatgagcacatagtgttccttcactcaagaggacacagcactcaaggcgccatcttggaagcagagaccagccctcaccacataatgaacctgctggtaccttaatcttggacttcctggcacccagaactgtgagaaatggatttctgatcttgataaattacctagtctcaggtaatgttataatgttatagcagcacaaatggactaaaacaactgccctcttgctgcctcttcacatggccataccttgtggctctctgtgtgtcctaacctcctcttctcataaggacactagtcagattaaattaaggcccgccctaaggccaggcgcggtggctcatgcttgtaatcccagcactttgggaggccgaggcagtaggatcacttgaggtcaggggctcaagaccagcctgggcaacatggtgaaacccccatctctacaaaaaatacaaaaattaaccaggtgtgatgtcatgtgtctgtagtcctagctactcgggaggctgatgtaagagaatctcttgagtccaggaggctgaggctgcaatgagctgtgttcatgccgctgcactccagcctgggtgacaaagtgagaccctctctcaaaaaataaaataaaataagggtggccctaacggcctcagtttaacttgatcagctctttaacagcccctatgtccaaatacagtcccattctgagatactgggagttagggttcaacatatgaatttgggagatacaattcagtccataacagtgaccaagcagaatcctggagcacctgtgcctgaacagagtgaatttgatgtgtaagaggtggactgtagacaccggcattgccctacagatcccctgcactgggcgctaacccccagctgctgtcagtgagggctaacaacccacagcttcctccctctctagggaagtgccctcaactgacaggagggcacctctaagttaggctcatccccttaagggacagcccacagccaatgactgactaagagtgaagaaggctatctcccttgctgcaagatggaggaactctgttgtgggctatccatgccagagcccccagtaccagacgtccctgagaccacatgttgctctgctcctccaccaccccatcctgcttccttccctcccttataacttttcccagaagagcactcccccagtaaatcgcattccccaggatccccattccaggctccacctctcaggaacatgatccaaaacaggtatgagcaggcagttcacagaaaagaaaacctgaatgcccaatcatcataagcaaaagtgctcagacatatctgtaatctaagaaatctggccaggcacggtggctcacgcctgtaatcccaacaatttgtgaggctgaggtgggcagaccacttgaggtcaggagttcgagaacagcctggccaacatggtgaaactccttctctactaaaaatacaaaaattagccaggcatggtggtgcatgcctgtaatcccagctactcaggaggctgaggcaagagatttgcttgaacccgggaggcagagattgcagtgagctgagattgtgccactgcaactccagcctgggtgacagagagatacttcgtctcaaaaaaaaaaaaaaaagaaaagaaatccaaagcaaggcagggtggttggctcacacctgtaatcccagcactttgggaggccaagaaaggaggattgcttgagcccaagagttcaagaccagcctgggcaacatagcaagaccccatctcactaaaaattttaaaaaattagccaggcatggtggccacatgcctgtggtcccaggtattcaggaggctgaggtgagaggatcgtttgagtccaggaggtcaaggctgcagtgagctgtgattgtgccactgcactccagcctgggcaacagagcaagacctgtctcaaaaaaagaaaaagaagagaaaagaaaaagaaagaaattcaaagtatgtcaataaatttgactattaatgttacacattagccatgggcgcaggcactctcagggcttatcaatagaaatagtcaccagggatggcagtttgccagtatctaaaactaaaacatgagtgaccttaaacccagcaaccccacacccaggaactcaccctgacacgtgcccaaggctgacagagaaataggaaacccctttacagaactggcaatcagagctgcagttgaaatagcggaaggtatcgctggggcaccaaggaggaagtgatttcatgtgagcaaggtgctcattattggagacaagggggaaagtgatggtatgatacagcctgtgaaatgaaatattaaaactatatgtgccaatatgggaaaacttccaaaacatgttcatgagtgagacggggaacaaggtgcaaaacctaatatccagtttgatcctccaacaatgactgtaaaaggacaagtcctttctggaaggacaggcaagaaagggtttacagtgattaaactacagggagcagaaagggctggggtaaggagcttgtatgtcttgcttcactcattatccttctgcactggtagaattttcatcctgtccatgaatcacttttccccaaacattttattataaaaatattcatacatgcagaaaatttaaaataattgtatagtaagcacccatatacccactaactagattctataattaatattttgctatacttgccttatatatctgcctatctatccatccttccatccagccttccatctaaccatcttacttttcgacgcatttcaagtaaattaaagaagtggcaatttactttatccctaaatatttcaggatgctggccaggcatggtggctcaggcctgtaatcccagcactttgggaagccgaggcaggtggatcacctctggtcaggagttcaagaccagcctggccaacatggtgaaacctcctctctactaaaaatacaaaaattagccaggcatgatggtgcacgcctgtaatcccagctactcaggaggctgaggcaggagaattgcttgaacctgtgaggcagaggttgcagtgagctgagatcacaccattgcactttagcctacgcaacaagagtgaaaaagagagagagagagagagagagagaatatatatatatatattttttcaagatgcattccattaacaagagtttaatatttgtttattttttaacttcaagataaatttatatgcaatgaaatacacaaatctttcagtgtatctatttctaacttttatactttatatctggtttagtttggtttggtttgggttgggttttagaaatgaggtctcactctgtcaccgaggctggagcgcagtggtgcaatcttggctcactgggctcaagcgagtctcctacttcagctgctagagtagctgggactgcaagcacatactgccaggcccagttaattttgttgttgttgttggagagacgaggtctcgctatgttgcccaggcttgccttgaactcctggcctcaagtgatcctcctgcctcggcctcccaaagcactcggattacaagtgtgagccactgagccagcctttaattttttttaaagactgcaggtataggttcattgcttcactttccaccagcactcactgagctcctactgtgcgccacacagtgtggcaatgtgctggggcagcagagtggatatgagttgatgtttttgagagcttaccattcagggcagggggcaagggaggcagatgataagcacgtaaacacatacataaataagatcattgcaggctgcaatgggagctgcaaaggccataaggtgggaagaagtaagagagaaagattgcagggctggaggcagggagtgcaggaagaaaatgtaagatccagcagatccctgatggatgagaagatccagggtgcattccattgtcaacacatgctggctattccttagagaaagcctctttgtctctctgaccctcagtttccacatctttgtttcagggataacatctcttcctcatgggttgtcatggggattaaatgaaggtgttgatgtgcttcacacagggcccagcacacatgagcatgcagcgaacatcagcagccatcacagttgccactgctgccactgtccatgctgttaaatccatcgcaagctggagactcaggcatagatctgatgggtgccttcctcatggagtttacagtccagaggctgagacagttacagaacaaggtggtcacagctgcaggagaacttgctggaaagtggcactaaggagggaatgacttgactgagatatccaggaagacttcctgcaggaggtgacacctaagctcaggctaaaaaaataaataaataactggtacatcaccagatgggcaagggcaggagcacatcctaaactgaaaaaccagcccatgtaaaagcagagaaaaatgaactgacctgatgcatgtaggagaaatcactggtgtcaatgtagtaggaaaattaaatgggagaaggtgaggctggagagacaagggccggacagtggagggcttgaatacgaggctttgagctggactttctcctaagagctgtaggaagccagcagactgaaattaaaaagactcacagtgccaaacgttggtaatggagtgaagcaaccagagctcccatacactacaggtgggagtataaagtgatacagccactttggggaaagttctggcggtttcttacaaaacgaatcatatacctaccctaggagctggcaatcccacttcaagagaaatgaaaacatgtattcacaaaaagacttgtacaagaccgttcatagaaactgtattcagaatagccccaaactggaagcaacccaagtgtccatcaacaggatgaaaatgactaaacacattatggtatatccacacaatgggatactgtgtatctataaaaaggcataaactaccaagagctgcagcaatgtgaatgaatatcaaaatcattgtgctgggtgaaagaaggcagacacaaaagagtacctattgtatgttccatttatatggaatcttagacaaaactaatctatagtgggggaaaaaatgagaacgtcaccctcgctgtgggggaagagtggggattggctgggaaggggcgaacagaactttccgggtcgatggggagattctgactcttgatggggtttgggtcacacaggtgcatgcacctgtcaaaactctgcaaatggacacttaggatccgcgctttttgttgcatactgagatattttcctttgtagttcttaatgactccagagagttctctggctaacgattttcccgcctatgtcggcaatgttgacgatctcttcaacagttacatgtccactgtgcttaatgtgcttctgcttttctctgtctgagtggtcctttgacagctttgatggtcaaggcagaggcagaaggtactgcttcagtctgggcctgtctgtcccaaatgatccgtttccctgtcatccttaaacccttccttaaacccaccaattgccttggtgatatcatcaccaaccattttttaggagacagccccagggtgcccatcttggtggccagggcagatgtggcacaacttccccaccagtgcacatcaggtacaagactttgatttccttggggttgaacctgggccatgtgaaggacgtggctggtgtcacttgaacccggatgctgagtgatcaaagaaagttgcaccttgttctcctctgagcagaaagcccaactgtaaacaaatattgaactttaagctgaagtacctagaagggagggtacagatgtctacaacttactttgaaatgcatcaaataagatggacaaatggatagatatttaaagaagtgccgtaaaatgtgaatggtagaacttaggtgttggatatagtgttctctgtaaaactaacttttctctatgtttgaaatttttcattgtaaactattggagggaggaaagatggtgctggctatagtgatggaaaatgaatttgaggggcccagatgagattcaggaaagccagtgaggagactgtggcgattttcccaggcaagaaatgaggaggcctggggggaggccagggcagtggggtagagaggagggagagccagaggcatcgtttgttgggagactcaggagacgaggggcacagtgaggaatgacgggagacagatcagaagtcaggcctagcctgcaaggaaacccaggagtggcctctctcaggagcagcagatgctgaaagtgcagaaaggtgaggggggctggggaaagcagcggtcctgaatgctcctttccaacactaaggaaaacagtggatgagcatctgtgatggccccacctttcagtgggtgtcctcgctcccccactccatggggctgggctcctcgttgcctctttctcccctcctgggagacttgctgattaagtgagtaaatattagtgcagaaacccaacccctgtgcacaacttcaagggaggtgccctgtggttgccccatgcttccctcctggccaccaggaatcaggacaagcaaagaacacgacattcacagtccagggaggtcacacagtccggaaaggtacaaagggtttggagaactcacttcatttggtttgggagcctccgcaggtggacacggtaagagatcttaatctgactcacacactctcaaaaagagagcaaaggcattcttgatgcatcctagagagcttggttgagggttgcctgcaagtgttggctgcctaccacgccattggtggtggtgagaaaatgagtcaccttcctactctctctcagttgttctgaagatatcacggagaaaggctcggcacagtgctgaaatgtcttcaatgcctctccaaccactcgctaccttcccccttagaaagaaagtaggcaacatttgatagccagagttcaacaaaatgtttctacttgtttccattgtgactttggaaagggcatttcacctctgtaaacagcatcacttgccataaacagtcagtgatgatgggactatagtgatgatgggactatagtgatgatgataagggcgacgagtttaatgggtacttatcacgtgccaagtgctcttgggagtaaaagtgaacctggcacatgataagtaatcattaagcttaatcgccacccttattatggtcactatagtcccatcatcactggctatttatggcaagtgatattgtttttttcactttgggtagcatacacagttttctgttagaaatagatctaattggccaggcacagtggctcacacctgtaatcccagcactttgtgaggccgaggcaagcggatcatctgaagtcgggagttcgagaccagcctgaccaacatggagaaaccccatctctactaaaaacacaaaattagccaggcgtgttggcgcatgcctgtaatcccagctactcgggaggctgaggaaggagaatcgcctgaacctgggaggcggaggttgtggtgagccaagatcacaccattgcactccagcctgggcaacaagagcgaaactccgtattaaaaaaaaaaaaagaaggaaagaaagaaaaaagaaatagatcaaatttatttgagttttcaaaagttatttcatttgccaagatgcatgctaagtccataaaaacccaggcattggcagatatggagaagctaaaggtagttgtcaggggtaggtgaggacagtatataaatgacaggtgcttgggagattctggccgaaggtgaagagcatgggctttgcagtcagatagacccgagtttatatcctggctttttgtcacagtagctgtgtgacctcgagcaagttaccaggcctttttgtatccccatttccttctctgtgccataggggataacagtggacctgcaggtctgaggctcagctaggccggtagtgagcactcaggaatgggagggccattggctgggcacggtggcttacgcctgtaatcccagcactttgggaggccgaggcaggtggatcacttgagaccaggagttcgagaccagccttcccaacatggtgaaaccccgtctccattaaaaatataaaaattagccgggcatcatgggacacgcctgtaatctcagctactcaggaggctgaggcaggagaatcacttgaacctggaaagcagaggttgcagtgagctgagatcacgccactgcactccaagacagagcaagactctgtctcaaaaaaaaagaaaagaaaagaaaaaagaaatagtagggctatttatattatacatttcataaagctcccttcctttcatacattgttggcccccaaaactgtgttccaaagtcaaatgcgtggaagatgaatagagggagggtcacgtgtgtgtatgtgtgcgtgtgtgtgtgtgtgtgtgtgtgtgtgtggcaggggtgttgagtgttggttgggggagggcatccagggcgttcccaggaggctgaaacctctcatgagcctctgatggtgtcgtttcaggatcctacacatgttctcatttttgttccgcatcatgactgagataatcgcacattgtgactgtatatttatttgtctgtttcttgctctccctccgtctctgtctccccaggacactgtgagccccaggagggcaggggctgatctgtgggctccctgctatatccaaggcacccagctctgtgtccacacagagggtgtgtaaggtgcatttgctgactgactaactgacctgctagccgactgcatctgtttgtgccaccagtcttgaattactaaagaaaattagagggttgggagagaaatactgggggactgacccctaaaatcatacaagccctgcaacatagcaaagtcttaggctctagcctgctccagcctctctggccctgccctgggctgctagtggaacctctcccgccctcctgacctggagagactggagatggggtgggggtgggggctgcctcaagaatctatctccaaggatggccatttgagggcagatgaggttaaacctccaagcaccccaaactgaggctcccaacttgagggactcagctgcccccaggggcctggtccagtgattcccccatctcccagggacctgcccatttcccaagccccccactcaatagtcacaccgttttcaaggacaggtagacactggtacgtgagggttctcacaacagctgaactttgtaagtcaccccttcctgtcttcctttatctagttacagctagacaatatgatatgatatcaatcagagcaactgcaataccagtcacagaaatcccagtgtcaagagttccttctggggttccccgctttgctttaagtgagcgtgctgtgagtatgtcccagctcctgtcccctgcagcaccgctattgtgaagtcaaagtgagttaacaccatgctcagggcagggcctggaaagaggacctgctcatctgattgggtggtttccatgtcaaggccaggcacagcacaggccgacagctggggcccagagccccttttgccaggcacagactgcaggcacagagaggtgaggacatttgcctgaggccacacagtaggggcgggtcaccgcgtagtgtgtccaggtgcactctccacaggccgcccagctccctcctgagcttcagaaagcacccaagagattggcagagagaggagagagacagtgggtaagagagagacagggcagggacagcctgaggaggagggaaggagagacagaaagagaaggggatggcaagagcaagacagagacctctgggaaagccagacagtgaagacaagcaggctacccgaggcctggttttgaggatctgagcacactgtcccctgccttgggggaggctccatacagcccacagcgttctgggaggcactgagggcctcaggaccccagccctgcttgtgctccattcccatccccaatcccatctcacctccagcccctggttctgactcctcatgagaacatccccagctccccttccctgccacccgccccactcccttcccctccagcccaccttccctgccacccgccccactcccttcccctccagcccaccttccctgccacccgccccactcccttcccctccagcccaccttccctgccacccgccccactcccttcccctccagctccccttccctgccacccgccccactcccttcccctccagcccaccttccctgccacccaccccactcccttcccctccagcccaccttccctgccacccgccccactcccttcccctccagcccaccttccctgccacccgccccactcccttcccctccagcccaccttccctgccacccgccccactcccttcccctccagcccaccttccctgccacccgccccactcccttccccttcaagcgactcaggcaagctcccagacactctttccaaaacccaccctccttcctttgcccctgaaaggctcccactctggaatgccctcccctcctaacacatccctatcccttaagcccagatcaaatgtcacctcttccaggaagccttctctgaactattccccagggaagcattgtgatgccattgctgatagcagcaacaaaagcccagtcatgccagttccagaatcaccaggaaagaaagaaagaaatcatttttcccctccctaatcaggcaggttatccccttctgggccccactgagctgccagcgactgtcacacacgaggcaggtgccagcctccctctctctcagtgctgaccataccatctgtgtgtttgcccctgttctactgtttgacatacttgacctgtgctggccttattaagcccatcctgtctgcaccctggcatttgtattgctcgtctggccctaataacaatccctgtgtcacctctatcctggtactttgcacacttggccaaggctcacggcagtgaaagcaacacatcaccctgcctgggttcccattcctggagctctgagcctacgcacatgctgcccacgtggatgaaaatcccagcactcagccggctgcctgcatccacctctgttgggtcacccaacacaccttcatcaactggactgtgggccccacgagggcagagatctggtctttgtctccccccaagagctaggacagcttccaacttagccagggttcatttgcactgaatttaatctatttctgtcccacaaaagagggattatgttgtaagttccagtaatgatttctttatttctttcctggtggttccgggaccggcatgactgggcgtttgttgctgctatcagcaatggcatcacaataattcctcagagtcccaggttggtgggggctgtgggtcgggcattgggaaaggaatgaggtttcctccactcccttgtcctgcgcccaacctttattgactcatttgcaggccatttagtggggttgtttacatatccaatacatatatttagtgtaaacatttttttaattctgaaaaataccaagaagatggtgaaagtgacctgtgatcacaccaccaagaaacgtgtactgttgatgcatttccttccagtatttttttctagattaaaaaaaatttttttttgttaaaaaatagaagaaacagtttcccttttcacttacttctgttggttggtctacattgttttgtgatggctgcctggtggcccacggtttatttaataaatcccattgctggatgttaaggcgggtcccactttagggctattccaggtaaggctgcagtgagcatcctcacagttctctatgctcaaatcactggccagttcccttggcagaacctccactgaccctgggtcaatgggtttgatcttcctaacaacatacttgacctcagaaacagcccagtcctcattgcataagaactgagccccctccactataagcaaaggtcatcacagccagcctggccactgcatcgtggagcccaacatctttattctatagctggggagactgaggctcagagagaactgacttatccaaaaccagcccaaaggtagtggcaaactccatgtcatctagggattttctccccactccattatctttaatattttgcaagaaaatccataatccttaacaaggatgctggtgggatgtagcaaggatgaagcatctgtgtctgctcatgaccgacattgttaatcaatcaccacattctctcctgctgagcccagacccttgaaagcttcaagagccatcaccaggcagctgaaattggtacaagagcaaaatgcttctaccatgctggtggagcatctttggtggcaacaatggaggacctgagcttctttaggagtggcttgaattcttgctttccttctttctttcgagccagtgacagttggcaaggcctctgatttccatctgtccacgtcatcagaaaccctctctggttttccgcatgactgcagtcttcccaggagagcttggccctcgttctggctggagatggtagggcaggctgggtcagtgcgtggagcatgggctctcaattcagacagaaatgggtcccaatcctggccctctgctttatggttgtgggaccttaggcaagtcaattcccttctccaaggtcctacttcatctggaaaatgggaggataaaaacccctattttctcctctcttggcctcagtttggtgatctgtagaatggagatgatcttttccactctgccatcttgctgtgtctgagcatccagctttgatttaacatcagattatctccccacccctaaccgaggcttctgtggatcagcttggtgggaaaggggagaagaggtgtgtgttctctccctgcacttccctctccttctctttctctctctctctctctctctctctctctccatccagaaggaagaaaaggggcaggagaattttcctttgactgatattgttgccaggtagttcccaactctctggggagcccaaaaaatgttgagagccaagtcttgtcggcaccttcaaagaggtagtcttacctccctgtggggcttcttgacctgcaccccccacaccagggcagagcctctttgatggctaactgtcccgcaggccaccccagccactcccagcccctggttctctagcgtcctctccaggtggtgatactaggaaggacttcaagcagccctagaccgatcttcgtcttgcagggtccacacccggccctgggaaaacacacacacacatgcgctttgaccctgcccagagggaacagagagcagtaattttccacttacggaagtcactttgcccaacatgacttcaactcatcaggagacacaacccagtctactgcaagccccaactccaggggagacaaacctcaagcccctaagtggtccctgaaaaggtccctcctgctaggcctgcattgaggcccaaacacctcctgccctcctccctgggagaggaggagggaccacagctgtctcccaagaaatacctctgccatcttcttcctgtcccttcttggccctttcgttgccttaatctgggtcagggccccctgcatgagagatgcaggagctgtgcaactggtttttagccactgcttggtctgtggcccaggacctctccttggtatacagcatctgggaaatcatggtgcctaaaacaacactcaagttttcagacccagttccagtaaatgctagtaaggacaccctcagtgtgcagcaaaaagagccctaccttagagagggtggtccccttgtcccctgctcccccaccccaccccaggaggcaacactgtagctgagacttggtgaattagaagaagccagaatgagagctggaaggagagcgctcctgggataaggccagcatgtgcgcaggccctggggtgggagtgagaggagcgagggatgaagtagagagaggtgagggctgaaaggtggccagcagccaaacatgctgggaagaggacatccaggccaggtggagcagcagtcaggcagctttatgcagatgttgcgttcttttttgtgtgtgtgagacagagtcttgctctgtagcccgggcgggagtgcagtggtgcgatcttggctcactgcaacctctgcctcctgggttcaagtggttcccctgcctcagccttctgagtaactgggtctacaggcacgtgccacctaaaaaccatgcccgtctaatttttttttttttttttttttagagacagggtttcaccatgttgaccaggctgatctcaaactcctgacctcaggtaatccaccagtatttgcctcccaaaatgctggtattacaggtgtgaatttaccacttgctgaattctctgatgtttcaagcatttctcatgaccttacgagaccctcaaaatagtcccatttcacaatggaggaaacagtctcatagagaagaagcaattttcccaaggctgacagctgtcagtataggagcaggaatctgagccgtgtctgtcggcctccacaggcttcctcctgcactcctgcgcttcttcccagacagggcacaattaggttttcaggagggtgaaggaggtactccagaaagaggacacggcacaaaaaggcctgggagctgaagagaggtggagccaaggccaagagacgccagcaacctgaggaggggccacgcggtactgagggcaggtgtggagtctggggaccatgggcctgcagagatgcagccagctttgctgtcccagcacgtggcaggaagcaggagctgatgcggccccaggtcttggcattgggcccgagcaccgcacagagggtcattgtccatgggcagtgggcatggccagctgggaagccaagcaggggcatttgcctctctggagatgtgcccaagggatcggcagggtcctcccaagagctctctcaaaacacctcacctttaggtattcagggcttttggtgtgtttgcaaacatggcaggacagcaaacgctcttcaccttgttcttcttgtcaaaaagcaggaggaagagaccagccagggcctggccacgtactttgtgacctcagaacacttactgcccctgacttgtctgctgcagatggagacaggattcaacaatggccatcccagctctaaaccacaattccattcttctagacaaaaactgggtagcaaggataattccccagatgacatcaaaaggccatgttggtgtcaccaccacctccagtgctaaattgaagtctcaggggaaggacagtgtggcggttaagagggtccggtctggactgatgatcgggttcaggtcccaaagctggaatccctggtcatgtgaccttgagcaagtcactcgcctctctgagcctcaggtgccctctgtaacattaacgctgctgatgcccacctctgggtgactgtgcaggctgcgtgagccaagacctgggcccaggtggtggatgacagcgtcctgctgggctctgacatttgtcctttaggttcatggtcatccctccttattcttttggtccacaagtgctcatggagattcctaaagatgcagacaaggtagagcagattttaattgctgcggaatgaatgaatgaatgaaatgaaagcccatgctaagcactgtgtaggcatgcacttcaactcatgctcttaacaacctatgaggaggagctactattatccccatgctatagatgaggtcattggggcccagagaggtgaagtaccttgcccaagggcacacagcaaagcagtggcaaaaataggattcaaatctattctcctgggtgaattaattgatggagatgtgtatctttgatgtatttaggaataaggggtgggtaaggctactccttccttttcccaaattgattatctggattaaacaattgttgtaatccctctacaaaggctcatcctattataagcaataataatattaatggcaacggccactcacatttatggagtgcttattctgctatatgcactgtgcttctctcagcctggaccttcctttctccaaacctcaggaagctggagtcccaaggctgcctccgggcggggctgtggttcagcagaagccacaaatatttaccttggagacctcggcctggtctgaggcctctgcctaaagacaaagcctgtgctggggtgtgcaggatataaggttggacttccagacccactgcccgggagaggagaggagcgggccgaggactccagcgtgcccaggtaaaagtagggaaggggctgaaagccaaggttgccaggaaggttctgagctagagatacctgttggggtcaggtcaggagcacaggggaggctcgccctcagggaagggccctcggtgagtcaggatccgctgagggtcagggccaggtgtagagagatgcccagctccctcgcccagaggaccaaagggcagtgacgaagggatggggctggctgagtgttttcctgacctcttcctagtgacataaacccactctgcacataccagttgctctgtcccagctgtgctgcggtggtgctgggacaaaagaagcatgagacgcagactctgtccctcaaagaactcccagtgcaggacaatgtggtgcccaaggaagacccagggacatgggagtggaggacagtcaaagaagggatcctggaagaggtgatgtgttggttgcaaagccgagtagaaggcgattgggcaaaggaggagagaaagatattccacgaaggggaactagcagaagcaaaggctgggagaggaggtgccatatgacaggggcgtgtgtggtgcctggatctgggggaggagagtcttttccacaggagggaaacagggatgctaccatcctcgtgggtccctgggtttctctgatccaaagaggactgagcagtgtgtacagataatgcaggacagacagagtcaaggtatttgcaaggaaaatatggagtggggccacaggggtgcctggatgccggggttcagctctgtcttctggctttggctgcaaggtgtctccttctgactccaatattagtaataatacctgtcataattatcgtggaagctaccatctactgaacgcttggccatgccaggccacaaatagattgtctcatttaatcttcccaaaaagcctatgacataagtactataattattccccattttatagatgagtaaatggaggctcagaaagggtaagtcacttgtcaaagatcacagagcaagtggtagaggcaggcctccaactagggttcatctggctgccaagccaataatattttcccctccaccttcaggcctcctaacactaaccttttcagcttagcaggctcagatttccaattctttcggggcttccagaggctatgcaattattcagcagccatttattaagcacctggtctatgccaaccactatactggatgccagggacacagcagggagcaggcagacccagccctccctcccagagctcacagcttggtcagggaagcagaggctgaatcattattgcaagggtctcagaagagctcacactgctccagggcacaggagacacatgtcatccggatgccacatttgtctttggcaaaaagaaatccacatgctgaaccaagcgaggggctcagatctctgcagcgtctcccctccctccaagcaggacagtccacaggggcaggagcttccatggggggctggcagacagagccagggtgcaagctggagagctcaggactggactacagatgttgatgccacacccctgtggagggaggggacagagcagccaaggggccagaatacccccaagctcctctccctggcatgagccacagggccctttctctctctctctttctctctctctctctctgcccttcttttcctggctccaagaagccattcagtccctccccagcccccttagtattgcagattaagcaaagagctttttcacaactttgagtcctacctggctcctcatttccttcctgcctccaaccttcatgtcttgggccccaggacaacatttctccaagtgtggtccaggttccctgtctgcaggacaggggaagctttatagggaaagtgacaaatcttggcagggttttaaaggatgaataggagttcatcagggagatatgggaggagaaaagcattccaggaagcaaggaagagcaagagcaaaggcacggacacaggagagaacacagtatgttctgagaccttccaactgcttggaacttgctagaacaaggggagagaaagcaggaggtgaggtcagcagacggtgaaccatagagggttttaagtgtcagactgaggggtgggagacacgggaagcagaagttctttgttctgagcattgttgctggattttctgtaagaaaatagctaatacaggctgggcgcggtggctcacgcctgtaatcccagcactttgggaggccgaggtgggcagatcacgaggtcaggagatcgagaccatcctggctaacacggtgaaaccccgtctctactaaaaatacaaaaaaaaaaattagcctggcgcggtggtgggtgtctgtagtcccaactactcaggaggctgaggcaggagaatggtgtgaactcaggaggtggagcttgcagtgagccgagatggcaccactgcactccagcctgggtgacagagcgagactctgtctcaaaaaaaaaaaaaaagaaagaaaatagctaatacattccaagtgcttaccatgtgaaagacaccgtgctaaatgctttccagatattaactcacttaatccctcaactctgggaagctggggtcattatccccatttgtctgataagaaaactgaggcacaaagaggttacgttgattgcctaaggctacacagctagcccaggcagttaaacactgcactcaacagcctctcctggacaccgtgccccaggtcaccgggcatcatgggcctgcccttggcccctctgcctcaggtccctctgtgctcaccccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaagtaagttttgtccctccggagctggctgccataagacaagggggtaggtggagcagcttcccaaaggagggagagagttcctcatcacgggggatgtgcatggctgagatcccagaacgtgggtgaacatgagtgggaggttgtaaaggtctggagagtctgtgatctcaagagtccacgattccaagaaccccttcttaaattccacagttccaaagaccctgagtttccacagcctgcagaaggggcatgcagccactgcatgcagtgatgcagctgcctctcccactgccttcacctgaaatcccatcgtcagagcaccccgtcttagttagacccagtgtgctcctcctccccagagcagagacccttgactgcaagtgtggcagcctgggtcccaggcacagtgtatcactttccagctctggggcactgggccagtccctgagcctcagcttccaccttgggacacaaataagagggccttcctcactgggtggttggaattgactagagctttatgaatgctatgaccatggtttcaacctcagcacttctgatgttgtggaccaaacaactatttattatggggggtgtcctgggcactttaggatgtttaacagcatccctaacccaactgtgacaaccaaaaaggtctccagacattgacaaatatctcttaggggacaaaatcatctcagtggagaacgactactctaaagtctcatccccttagaggggactcacctgtcagctctggaggccacttgagcacttagaggaccagacctctgcattcagggggactaggggcctgggtcatggccagaggggcaggggcaggtcctgtgggaccaacaggctctgtagccagcggatggattcccaagtaaggacgggaagcagagggctctgagaggttggagggaggcagaggtggcctggatccacactgtgaagctcaagcatgtggaatttcagccagaaggagcttagagatgaacaaccatgctttaggctctcctataaggagttgtgtacaagtggttggttttgaaggtgaccccagaaacacctacaggagtgtggggaggcaaggcagggaaggaaaggcatcccatgaggggtgcatgtccaagccagttaccactgtggcgactgaagctcagtcctgcctagcaactgcatctattagggccattcaggagacagaaaccacacagtaaatgccaacaggtaagtttaatgtaaagaagtattaccaggggattggaagaatgaggaattggctaagagggaaaacagacagagctctaaaggataacctagggatggagggggtagccaaggacagagcaagttcagaggtagagaatcctccccagccctctttgtagagggtgtggttgaagcccactgtgtggtggagaagtttgctggcttgtcccaggccagagctggtccacagttggcaatctgacgctagtgggtggagaactacctgccagggggccaataaaattctctgggaagctgcccctggaggaagggggctgctgttaactcacggggaagctgtctctggggaactgcctagaagctagccagggtgcctgcagaactcactcagcaaaagccactgggcagtgacaccataggaacctggaaagagaagcacaccagagccatgaagggaatcccccccatgcccctccagagtctccactgaaagggcttaacactgtgccaaatggcaaaaaagaaatattcactgggcccagttccattaccacagagcaggcaaagtgggtggatttgcagctgagaggctataacccaggagctctgatacacaatgagggacacacatctgagccatcctgcctgaggggtgagggagctgggatattgatacaccaactctcaccaatcactggctgaagtctgctcctggggcatcagctctccagcacttctgacctgctctgcacatgagccagatgggctctagctgctcacaaaaagccagctgggacaagaacccagggctcttgacacttatgcctctgtcctggctccttcttcctctgctcagcacttgaggctttttggacaacacatccataggatatggatgccagacaattgttaacaagtgtgctttggcagcaaaacagccccaaacagagttttgagggttccctgcctgttggccctagaaatgcttgcaactggctcaggggatgagtgcaggtccaggtgctgagtgcagtggccgacactccccacagaggctggcaatgctcaggggtgtgaatggtcccagcctcgctcctgatgtgaaaacgacccatctgggctactgtcctcaaggctacatctacacagtggggactggcaggctggtcctgacctccaccacagtagagatggctacaccctcgccttacctcagggagcctcgagtgatacccctccccagcctggagctcccaccaagccttccttcttgcccctcctcctgggccctaatccctggggtctgcctccagagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggtgagtggagcaggaccacaccaggagctagccccttcccacacctttgcccgggacacgctctgcatgctcagtcaaccagtctgcaagcatcgacttgtgtcagatcacaaagagtggatcaaacaaagcccctccgtcaagaagctcccagaatagttaacaagaaccataagacagtgacacaggaaccctaatacaacaaccccagagcaaggccagggacggtggctcaagcctgtaatcccagcactttgggaggccaaggtgggtggatcacctgaggttaggagttcgagaccagcctggccaacatggcaaaaccccatctctactaaaaatataaaaattagccaggcatggtggcagaagcctgtaatcccagctactcaggaggctgaggcaggagaatcgcttgaacctgggaagtggaagttgcagtgagctgagatggtgccattgcactccagcctgggtgacaagagtgagattctgtctcaaaaaaaaaaaaacaaaaaaaaaaaaacaacccagagcaaggttgtctggggtggcacagggaagggatgaggtgatgcttctcactggaggtgacagtggagccgatgactcaatgctcaccaggagacaagaagcaaatggcatccaggtagaagaatcaggctgggcaaaggcatggagaagtgacagtcggtcagaatggctagagctcaaacctcaaggcaaggagtaagggatcagcagggtcaggtcacagagggtcttatgagtcagctcaaggagctgggagtcaccacctagaagagaaggcaccataatagcattgtgagcaggagtggaggggagggatggaggcaagaccatctggagaggagtcggtgggcagggccagggtcccgctgctgcctaggcaccccagggagatggaaaagatagagagggagtggatttgggaataatgagccggaggcatgattctgatctctcctaaaccccatccaggctgaaggtcatcacagctaacatcctccagctgcaggtgaagccctcggccaatgaccaggagctgctagtcaagatccccctggacatggtggctggattcaacacgtgagtgacccctccatcaagtacagtaggcttgacaggctcatctgctcgttccccctcccccgcccccaccatgcaggtgtctggaaaagagagttccgagcagagagaagagcaagtgcagaggccctgtggcagcagtgtacttgccttgctcaaagaatggcaaagacaggggaaagagagagggggcatggtaggagatgaggccagcaggcagccgaggccagatcatacaaggcctcttgggagaagataaggacttggcttttgctgagtaggacgggagccagggaggattctgagcagaggagggatatgctgtgctttcacatttttaaagactcctggctgctgtggggaaaaaagactttctgggggtaagagtggagacaggaaggctatcccaaagctactgcaacaattcaggaggagataatgatggcttagaccagggtttggggcagggaggtgctgagaagttgattggattctggatatgttttggaggtaggtggggacaccaggatatcccggggaactgaatatgcatgtgtattcagggggaaagagagagaagtcaacgatgactccaagagttctgcctgcaccactggcaggatggagtggtcagtaaccaagacaggcaaggccatgagaggagcaggtctggggaagagccagtccagtgttgcatgcgctaaacttgagaagcccgtgagacatcggagtagggggctgggggtaagtttggaagctgtcagcagacgaaagacgtttcaaccaaagaggagtctgaaaactgagcctgggacatgctggggtgaagttgggtgaagatgaggagaaaccagcaaaggagactgaggaaggaggtgagggctggaagacagagacggacggcagggttgctccagcccgagcttgcctggtgctcacatggtcaggtgcctccacccgctaggcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagtgagtgtcgctggccaccagccgggctcccatcctgcctggaaggaacgccaggcagtggacttcccccattttacaaatggagaacgctgaggcctagagaaagaaagggacttatcccctcctgattcctgatctggggctccttccagggaatctgtgatgccaagggaagttcaggacatcaaggtcagaagcaaccatggtgggtttcaggcatgacaccgggaggtggggcaaatctttgaagggggaggcctagaaactcctccaaacaccagggcaggtgtaggtggagccaggggcaaaaacataggctttgggtcaggccaacacattctcttcatttgctctccgggtgatgatggccaagtggccaccctgtgtctcactttcctcacccgtaaagtgcaggtaatgacaccttccaggcagtggtgagaaaactgatcagacaacagccatcaagcactcagaacagtgcacgcgcatggtggtgccaaaaaacatggcgcccccccttcccttcttagcaggaggacagggagaaatgccagctcccatcatcccaatgcccagcataaagttccaatgacaacacccagccgctgctttctgataactctttgccactgcctacacctggctcaggggctactcccagccccgtctctaacacgtcctgtgaccttgggcaggttccttcctcccttagactcagcctccccctctgtaaaatagaggaaggggtgatcatctctgacccttcctaatgtctctcgtgctctcttccctgaaaggctctccttcctggtgaacgccttagctaagcaggtcatgaacctcctagtgccatccctgcccaatctagtgaaaaaccaggtgagtggaatcagggcctctctggcctgtgggcattgcgccccctgtggggcttgggtggaactgcaagttggtgctaagtgactggagtctccttgggtgggttttgctgaaagaattatctggggctggatagcaaagagtcatggagtggggtgggccattgacccaggcagacaggcaaggtcatgggactgctaaaagtcagccaggagcccgtgaacagtgacgtgctgataaatttttagcaattgtctctggaggggttgttgaagggaggcaaacctgatttgtagcttttgcggatttccctggtggaaatactcccttcagggccaattttaggcgaccagtgtgatgtcactgaacagagttgggaaaagatatacaatagcacacgattgtatatttccactaaacagatacataaacatgatctcaggagtaatagatagtagtaaaatacagcaaactaattaggaagcaatgcgttttaaatttttattaaatttgttttaatataatttatttaattgtaagtttatatgtctaatttgtaacaatgtctgggcttagcacccagctcagaaatttgtggaaatttaacaattggttctcaaaagctagtacaagctggctctagcacggcactgtcacacatcaatctggctgtggtattcagggctgcaccacccaccaggtcctgttggattttttttctgcgtcagtaaacacaggtgactctcattttagttgcccctatttgtcacaggtatactaaaactttgtaaattgaattcatccacattaaccagtgatttccactgtaaattccaagatgtgttcgtaacaatgggccacccgatctagggtcaaaacaccttgtcaaatagctaatatttcttggaataagacttttttctttgatttttgtttttgtttgtttgttttgagacagagtcttgctctgtcgcctaggcgggagtgcagtggcgcaatctcagctcactgcaacctccgcctcccgggttcaagcaattctcatgcctcagcctcccaagtggctgggatgacagatgagcaccaccaggcatggctagtttttatatttttagtagagacaaggttttcgccatgttggccaggctggtctcaaacccctgacctcaggtgatccgcctgcctcagcctcccaaagtgctgggattataggcatgagccactgtgcctggcgacttttttctttgaaaagatgatgtaataaatgaaaaaatttggggaaaaaaaatccataatccttttactttcacccaggagcgctttgatcttttgcagattgccttcccacctccatccacatgcactagtatttttaagaggctgctcttggtgtcagcctttaaatcagatctatgtttcaaagtcattatacaatacttgtaattattaaataggtacattgggtttaataatttacgaaaacattccagcaaatccttttttaaataatgtgattttattaagagtactttaaaatgacagtagcaatatttaaaacagtattttaggccagggccagtggctcacacctgtaatctcagcactttggcaggtcgaggcgggaggatcacttgagcccaggatttgcgacttgcctggaaaacacagagaaacccatctctacagaaaaataaaaaattagaatagctgggcatgatggtgtgcccctatggtcccagctactcaggtggctgaggcagaaggatcgcttgagtctaggatgttgaggctgcagtgagtcacagttgtgccactgcactccagcctaggcatgacggcaagactctgtctcaaaaactaaataaataaataacactgctttatataaacaatgtgattcttattaagagtactttaaaacaatggagatttttatttttctccaagttggcttccatgtccttaccttcaagaaaaatacagtaaaacatttaatctccattttgtgaaatatacatcaactgtacaatatactattacgtttgtttctctaataagctggagttatgattttcaacttctgcttctgcactagtaaagcttaagagtagcatgtatagtcaaaggaagatccattattttaatagtcgaaatatctacatattaaagaggccagggaaaaataagtgaataatcaaaaactaaataaagctcaaataagatcttaaaaggttaatttcagaagcaatactgattcagcccaattcaagctacctttctccagtacttttttggaagagaatggggagagacagagagagatgagaagggagggaaccaatataatgaattaatgaattgtgtgatataatgaatataatgaacaatgaatataatgaattgtgtgatctcaaagttcaagacaatggcttcttataggtagaatgttgagactccgaccttttagcaaaggtacgtatccagggagttttttaaagggaatccaaaagtgaaaaacttcataacattggaattttcttatgtaagaaagaaaattttgtttctttgaataattttatttatctgtttcaaggtgggaatttcataaagtaggacccagctgtagattttcttcccagcctccagcaaaatcatattttatctggcatcacactttaatagttaaaaatatattttccagtagaaaagatgacaaaaacttggaattatacaatgctccttgcatagtatctgtctttaatggtgaaaagctaagtagaaagaacaatgtgtgaaagccggcatcccattatcatcagcaaatccactacattcactggatttgatatgatggtcatagaaatattttatttggcatgaagggaaaaggcatagcacgtttaagaggtgagcgtctggtaggagctcatttagaaaatgttgaggccaggcgcagtggcccacatctgtaatcccagcacttcgggaggccaaggcaggaggatcccctgagatcaggagcttgagaccaggctggccaacatgacgaaaccccgtctctactaaaaatacaaaaattagctgggcgcagtggcgcacacctgtaatcctaactacttgggaggctgaggcagaagaatcacttgaacccaagaggcggaggttgcagtgagctgagataacgccactgcactccagcctgggcgacagagagaaactctatctcaaaaaaaaaaaaattaaaaataaataaataaataaaatggggatgatggaatgacttgctttatataattgtgagtattccataagatgcatggaaaaaaatctagctaggctggtcgtggcggctcactcctataatcccagcactttgggaggccaaggcaggaggatcccctgagatcaggagcttgagaccagcctggccaacatggtgaaatcccatctctactaaaaatacaaaaattagccagacatggtggtgggcgcctgtaatcccagttactcgggaggatgaggcaggagaatcagagaggatgaggcaggagaattgcttgaacctgggaggtggaggttgcagtgagccgagattgcaccactgcactccagcctgggtgacagagtgagactcgaaagaagaaagaaagagagaagaagaaagaaagaaagagagaaagaaagaaagaaagagagaaaaaaagggagaaaaggaagcaaggaaggaaaaagagagagagggaaggaaggaaggagagagagagagaaagagagagagaagaaaggaaggaaagaaggaaggaaggaaggggaagggaaggaaggaaagaaggaaggaaggaaggggaaggggaagggaaggaaggaaagaaggaaggaaggggattgggaagggaaggaaggaaagaaggaaggaaggaaggggaagggaaagggaaggaaggaaggacggaaaaagagagagagggagggagggaagaaaggaaggaagggagggagggagggagggagggaaaatgttgaaatctttttcagtgtaaatccatgggtctcaaccctcgttgcacatcagagccatcagaacctgagaaacctttaaaaaatactaatggctaggccctaccccagattcagaagtaactggtctgggtgggtcctagtatcccagaggactctactgtgtagccaggattgagacctgctgatagaaatgaaggatggggaattgtgggataaaatgcagaggttccccgggacactttccggtgagaaacaggctcccctggcagtgcctgctgggagtctctgagctgaaagtcttccatcctctctgggctctagattggcaatgcagccaggagcagggaacggttattcataggagttaacatttctcaaaggcattgtcattcctcaagagtattaaggggtggtcaacaagacaaaaatgtcctcaataatcttggagcactgccctgaaaagtgagtcaaatgtttgaccttctccctaagcagaacagctcaggtcagggttaggttaggtcagagtttctcagccttggtggtactgacattttgggctggataattctttgtctggatgctgtcctatgcacagtaggatgtttagctgcatccctggcctctacccactagttgtcatcccctccaagttgtgacaactaaaaatgtctctagaaatttccaaatgtctccttggggacaaaatctccccctgttgaggactgctggcaattttaggaagagaagtgcccagtgagcaaagggatgtgttgggctagaaagccacaaagggcacaaagagattgcccaggagtctggttgggtctgccttgctggcctctgttccagagtctgacatgtgaaaagaactcagtagcaacttgctgtatgaataaacaaattctccatttaactcttgttttttcttttaaagtagagtcttgctctgtcacccaggctggagtgcagtagcacgattccagctcactgcaacctccacctcccaggttcaagcaatccttgtgcttcagccaaccaagtagcttggattacaggagtgcaccaccatgcctggctttttgtatctttagtagagatgaggtttcaccatgctggccaggctggtctcaaactcctggcctcaagcgatccacccaccttggcttcccaaagtgctgggattacaggcatgagccattgcgcccagcctccatttcactctcatggaaaacatagacacctgtgagcaagacaaggagtcagagagggagggctgctggcaggccaagcacaccctgggcacagggaaagggacaaaccactgcaaaaggtcccaggtggccctgcaggctgggttcaacacacgaatgaatcctcaacccatggatggaacctggctggccatgggcacagcagtaggacacaggccaggtgggctgggcacagcccggggctgctgtggggctgcattctggcccctccctgatggagccccttgcttatgctgttgcagctgtgtcccgtgatcgaggcttccttcaatggcatgtatgcagacctcctgcagctggtgaagggtaggtgctctgctctctctcccactttttcctttactacggagctggcctccagaccctgactccaccaagggaaggcctccccaagtcaggcctgagctgcaactcaggcccagaagcaggtgagacaagcatcagttgatccctgccccagacgcgcagacagaaattcgccacgactaggacttcatgagctcttactatttgtgcagttgtcaggtcagtggatgccccaagttcaaatcccagctctgcccctgacttgctccatgactttgggaaagctaatttacctcctcatcctcggtttcctcatccataaaatggggcttaaccatccctacaacataggattgttagtgaggaataaaagtctacaggaaagttctgggcacatagcaggtgtccctcttggcacagagaagcacttacaaatgcatgctaaatggatggatggatagatggatggatggatggatggacagacagaagatgctaagattacaagcatgagccatcacacgcagcccccggactagtttttatggatactttagaaaactgcagcatcaaatagttctatccatctcgttgcagtttcaaattttccctccatccaaagggtttgaggtatctgagaaattaaagcatgggttaaaaactgagatatctggtttaaaaaataaaaatcagagatgattcgaagggcaaagacggaaggaagtcatttctccctcccccagcatagcagatacgggagggcacaggctcctgcccccacatcagaactctgccatgctcaggcccccagagtggaaactggcggagaagaagaaaagtctaccaactgcactttgggatcagaagaggctcattccaagggcgaccagagaggagaagggagagcagcatgcactgagcgccacagggcatctgccatgggccacgccctcccgctgggtgttttgtataggcacatctcactgactcctcagacaactccatgaggtggcagtcatgaccccccttcactgtgatgaaagaggctccgagcaatgaagtcactgtccaagttcacagaggcagttggtgatagaggaagacttgagttctgagcgagtgtcattcggattgagccgttactaggtgccagttgtatacatgaagcaggaattactattctaccgccgtttctttccttttttcttttttttttttttaattcccaaagagttcttccaatcgtcagatatttggtcagtattcagagtaggatccagagttcacacattacattttgttgacaagtctgtagatttctctttgtaaatcacatttttttgttgttgttatagccattttcggggaccttattgactttaatatactttttttttttttttggagacggaccttttttctttttttaaagtaatttttacaggagtcatgctcatcgtctctatgtccttccgattttagtacatgtgctgccctggcgggcactataccctcattttaagacgaggaaacagattcagacgcgagaagagaccagccaaggtcactggggctcaaaccgaagtccagctggctcctccgctgccccgaggacgggcccggaggtctccctggagcggtaggcggccggtccctggccctccagcactccccatcctcggccatacaccggggcaggtgacacaccaccgccacctggcggccaagtggggaattctgacgcgaacacgagatctttggggggagcagaggagccagtttggatttcagagtagatgttaccaggcctctggcttccagcctaagcttccttgagatccaggtgctcatagggtgtccagacccagaaccacctgcatgggggacgcggctttcagtctggtaggggcggtggagtgttacatacaatagttcagttccgttccaaaccgggactttggcataaaaccgactgggttcccatgctctcatagtatggctttgaacaggtcatttccctttcctcagacttggtttcaccatctgtaaaagggggtaataataagacctacttcctaacgttatcatgcagatgaaccagctgacatgcagaggcctggcacttagtggatgctcgataaatgtcactgtcatcactgtttgcatcattattatcaacatcattattacctgctcctccctacctgcccccccatgcaacagtacagctccacctggaagcagccccccaacttccccctccaatactgccctccaccctcacagaactttcttcttgtccttgagcagtgcccatttccctcagcattgaccgtctggagtttgaccttctgtatcctgccatcaagggtgacaccattcagctctacctgggggtgagtgtcccaggaccttgagggtgaagtggggacattgctgcccttctctgaccaccaggagtcagatagcatgggcctgtgttaggagagaaaatcctggtcaccattaggacacgggctgatctagaaaaatcactgcaggctgaatatgtcccatgcaagtttgttttgttttgtttttttgagactgagtctcactgtcacccagagtgacatgggggggcccgagtggggacactgggccctcagcctttctctcaggcaagtccctgccaatccccaaacctatgacaaccttgaaacaaaagccaaggatcaagaaacacagacctaagtttctctcctagctctatgattccctggctatgtgactttgggcaagttcctttacctccctgagcctcagtttccttgtctgcaaaatgtcagtaataatggccactgaggagaggatgaaatgagaccacaccatgcctggcagaccagaagtgcccagtaactgtcagctccctgtccaatgtggagctgcacagccatgctgtggctggacgccccaaagggccagaccatcctggtagcatgaatcccagactaggtttcttttgttttgtttttttgagactgagtctcactctgtcacccaggctggagtgcagtggtgccatcacagctcactgcagccttgacctcctgggctcaagcgatcctctcacctcaacctcctgagtagctgggactgcaggcactcgccaccacgcctggctaattttctgtattttttgtaaagatggggttccgccatgttgcccaggctggtctcaaactcctgggctcaaatgatcctcccacttcggcctcccaaagtgctaagattacaagcatgagccaacacgcctggcccctggactagtttctatggatcctttggaaaactgcagcatcaaatcgtttcttccattttgttgtagtttttaattttccctccatccaaagggtttgaggtgtctgagaagttgaagcatgggaaaaaaaacgaagatatctggtacaaaaaataaaagtcagagattatccgaggggcaaagatggagtagatgttgccacacacctgagctccaggctaagcttcctggcaacaaatgcacaaaaaggaaacaggctgaatggtgtcatttccttctaggttgctattgggtaagctgcagagttaaaattcttagctgactccctgctctgtctcctcaggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtggtaaacctcagcacaaggcagagaatagggccgcccaggccacatcataggaatttcctgaacacagggtgcccctaagcaggaatcctccatcaggctcagtttaatggagatctcactccctcctctaatagaccctgcctctgacatagctctaaacctaaaatcctcccggtaacatccagccccagtcatggttctaccctctggaatctgatgcaaatgtttcctctaccaaataacagtctcgtgaaatcaaaaggcatcttagatatgcagtagtccaggggtgataaatacatctcagatagtgagtagtccagggatggcgactgtgccactgctcaccactatgacactcatggcagacatcactaatcgatcaaggctctcctttctactgagtctggatgctgacacaaccttggaatccttattaacagggcacagccgataaccaccaccagtcaactatgttgtgccacctcctcccgggtgactgacggggaaattgaggtccagagggggaaagggttggtccaacgttatgggaggatggcagaacttcagggcagctgacagacaaccaataaccaagctctcaggggactgggatggcgagaaaatagggagtggtcaccaactagcccattcatgattgcagtaaaaatgaaatcacctctctatgtcctctgagatcaggaagctgcccccagacccacaaccatcaccagcccacagtaaaagtccaggccagcaggaccccatgccccatagaagctgacctaggggctgtttttccaccaatgacagacacatggcttgggtcactgggcccacccagcttttctggggtcctgggaaaccttcctcccagcagtggggtgcaggagatgtgcctccctgtgccctccaactgaccttctctggctcctctcaccctcagcttcctgagagtgcccatcggctgaagtcaagcatcgggctgatcaatgaaaaggttggtctgtttgccatctgcagcttgaggggtgtttgctgtggtctggacacaggcctctggggaggagaatctagtgggactagtgtttcattccagcactgggacactcaaaccgcatccctgtccgcacagagatttcagtctagcaggccagtttgacctgaagcaaatcatcacatggatagtatttccattacagctgcagtaacacaggacaggttctaggggccatgagaacactctgggcccctgatacagtctgggacgtcagggaggcctccctgaagggaagggcattccagacagagggaacaggagaccaaaggctgccaggtagggagaacaacacaacattcaaggatctgcaagaaggacagggtggctggaacacgtgagggagcagggagcccaggaaggcaggcaggggccaggccacacacagagcctgtgggccatggtgggcacttgggaggccacatgtgggtctgatctccttccaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgtgagttcagttgtctgcgatattggcagcaaccagggggacccttctgtctacttttcctgttcgccctcttgctttgttaaacatttccaccactctcatcacttagcagggacaggggacagggagctctgaaccaagagccaggagctttgtgggtccaattctaaccctgtgactttcttagtcaggaatctctggacagaaactcaactcatatgcacaaaaggaattgtattagctcctataactaaaaagtctagatgctattgacttcgggaatagctggacccaggtgctcaaacaatatcctcttcattctcctctctcccacctagcagccttgttttcctctgtgctgccttcatcctcaggcaagctattccctcatggtagtgccccaggctgcattaggctcatatcctatcagcttggcaatcaccgcaggaagaacctatctttccaatagttccagcaaacatctcagggctgactctcactgaatgagcctgagtcagttgcccattcttgagccaatcagtgtgtccagaaaaatggaatatgaaaacttcctgagctgggccacctacacactagggtaagggagtgagggctctatgaatagtggctgctttcgtcgtcgtcatcgtcatcattatcattccccacagcaagcctagactgtcatctgttaaatggggagtggaggcaagtactatctcatttaacagatgaggcaggtgaggcccagagaggtcaaaccctttgccaaggtcccagagccaggaactgagattcagaccccagagcctccctgcataacccctaattccacactcggatcctcttgagaacaatggggcctgggcttctcttgttgcaggaagccagctcggaagctcagttttacaccaaaggtgaccaacttatactcaacttgaataacatcaggtaaacacacaaatcatcatgaagattctgctgatggaaatgagtcccgcctggtaaccatgggtttctttaaacaccgactttgtggctgtcaggtgaaggcggctccagggtaggcagggaggtccttccggatgctcctgctgacaaggactgcatgtgagggaatggggaggaaaatgaagtaggccttgcagcagccacggcacaggcaaaccctagccgcggccagcccactctggacacctcccaggccgtggcagtgacagtcacccggcacagaagtgcagggctccagctgcctcctgcaccctgcctgttctccctccccgccactttcctgtggccccagagtgagtgcaggggctgccagctggagcctctggggacaagtcaggcccagggctcttttgatcagcccacatagggctgggctgtttaatataaatgagttgtgcacatatcaaatcagactatctggctgccctgtgcccacaatcctacatagcaacaaactgtcgagccaggaattggggcgccctttgaaggagcttgggcctccttgtccaccacagccctgactcctgaggttgatttttctgctcactggactgctatttgttttctgtgccccctctatgccccccaccccacccctgccattagaatgcaagctccacgacgcaagggcttcatgtggttcactggagcccgcactgtgcctggcacataataggtgctcaataaatcgctgttgaatgagtggatggtgaatgagtgggacttcaggggccgctctcacaggcatcttccattgcagctctgatcggatccagctgatgaactctgggattggctggttccaagtaagtgttaacaggtggtgcctgagggcacagggggtggcctggaatggtccactctcaaaacagatattgcccaggatttgcttcaaacaaggtccccacagaagcaccatggggggctggccggtctccaccaaagtccaacttccctcgagtgtttacagagaagccaccacgtgtcagacacagctgagaacacacacacgcacacacaaatacactcacagatacacactttctttcagtgaagttttgatcctgaattagaacacaagtgcccttgactcacaatctcattctgcacacgtagacgcgcctcagtgcccctagacagccctttcctgctgggattcagaccgaaccccaatacctcagtctggcgtgttttctctggtttttatgatttgtttttcactatttttgactttttttttttttttttttgagatggagtctcgctctgtcgcccaggctggagagcagtggtgtgatcttggctcactgcaacctccatctcccgggttcaagcaattctcctgcctcagcctcctgagtagctgggactacaggcgcccaccaccacgcccggctaattttttgtacttttagtagagacagggtttcaccatgttagccaagatggtctcgatctcctgacctcatgatctgcccgccttggcctcccaaagtgctgggattacaggcatgagccaccatgcccggtgactaatattttaaaacacggagagttccacatgcaaatcaggacttctggcttccctccagaagtcagaagttcaggcaatgcagggcaaaattccctcagggcaaattcagctgcaacagagtggtggggcccctgaggatggggcatcctccaatgcaccccaatccccccatctaccaggccccaggggcggctgagttcatgccccaacccagcccatctggtccctgggagcccccacagctctgatcagcaggggacctggaattcctacatctccaccagccacctcacccatggggaggagccacacccacgaagaatgatgggggggaacttcagatgctcaaccagggtgacagtgccccttctctctctcacagcctgatgttctgaaaaacatcatcactgagatcatccactccatcctgctgccgaaccagaatggtgcatacctctgccatctgtgccccctctctccccagggcttggctttacttcccctgccctcatctccatgaatggggcccctttcattcatctcccagccatccctcagagcctacttcaaaatctgcctcctcccaagaaccttctcagcccaattcctttgctagtgccagaggctgggctcgtaaagatgaaccaagcagtgggccagacttgcagggctggaaggagacagaggcataagcagacaatgagagcaatgacagaggtgtaagagacaactggaggcgcctcagcagaccctgttccccctcttgctagtgcctggccttggtcaagctgcacaatccttctgagcctcagtttctccatctgtaaaatggggacgtagaagtaccttcttcagaggcacaaatcaggaggtgcctggcacagtcagtgcccaacactctaattcagccccaggttgaatgaggggtgggaagggtttgtaacctatacagttccacctttttaatttctttattttattagactggaaaaatctcaaagtatagaaacctctgctggggataatgggagcccctgatggttcttgagcaagagcgtaagagaatgtgaggactgcattttgtgaggggccagaagccagtgccagaggcaaagggagggtagacgaggctgggtcaatgctggggccagagaacaggcgagcagaggcagagggggctgtctgatcaggcctgccaggccggggctccccttcaggaaccctgagcctgcccctggctgcccagtctcaccccaggcccatcagtttctgaccacatttgttatttcaggcaaattaagatctggggtcccagtgtcattggtgaaggccttgggattcgaggcagctgagtcctcactgaccaaggtgagtgggtgtggccctaaacatcctgccccagggagggcacagccactgagagccctggctgggaggtggggcctgcactccaaccccagcctacaggtgaccctgggcaagtcccttcccctctcagggcctcacctcctcatctgcaagtgagaaggttggctgtgctgaggatggaaccctcctagcctggggtcagtacactttttccacccccttgtcattcattcattcattcattcattcagtaattcactaaatatttttcgagggtcttctataggcaagccatgcttctgagtgcttgaggccaccgaaatgaacaaatggaaaacactcccatctttttcaagcctaccttttagcagaagaggcagatacacaagccctaaagatgtaacatcaggctgagtggaggaaggctgagaagaaaaataaagcaggctcaggaggagagagtgatgtcagggaagggggtgctgtttcagatggggtggccagggagggcctctctgaggaggtaacatttgagccaatgcctgaggaggtgaggggtgagccctgtgggtagctgggagaagtgtcccgtcagagggacagcgtattaggccgttctcacactgctataaagaaatacctgaggctgggctcagtggcttgtgcctataatcccagcactttgggaggccaaggtgggcagatcacctgaggtcaagagttcgagaccagcctggccgacatggcaaaacccagtctctactaaaaatacaaaaattagctgggcgtgatggcgggtacctgtaatcccagctactcggaaggctgaggcagaagaattgcttgaacccaggaggcggaggttgcagtgacctgagatcacgccattgcactccagcctgggcaacaagagtgaaatccatcccccccccaaaaaaaaaaggaaagaaaataaatacctgagactgggtaattcatgaagaaaagaggtttaattggcttgtggttctgcaggctgtacaggaaacacgatgctggcatctgctcagcttctggggaggcttcaggaaacttccaatcatagcggaaggcaaaggggaagactgcacatcacatggcccaagcaggagcaaggggtgggaggtgctacacacttttaaacaaccagatctcacaagagcacactcaccatcacgagaacagcaccaagaggatggcgctaaaccattcacaagaaaccagccccatgatccaatcagcttagaccccacctccaacattgggttctacatgagatttgggcggggacacagatctaaaccatatcagatgtcaagtgcaaaggccctgaggcagggattgttggtgttccaggaaagatgaggaaggaggcccaggatctgaggcaacatccaaggcaggtaacctcataggcctgagatgcatgcatgcacacacacatatacacacacacacgcacacctttatacacctatacacatacatacacacgcacatacaaacacatacacctttatacacatacatacacacacacacctttatacacctatacacatacatacacacgcacatacaaacacatacacctttatacacatacatacacacacacacctttatacacctatacacatacatacacacgcacatacaaacacatacacctttatacacatacatacacacacacacctttatacacctatacatatacatacacacacacatacatattgcacacatacacaccacacacatacacactacacacacacacataatacacacaccacacacatacacactacacacacacatacacacacacataatacacacaccacacacatacacactacacacacaccacacacatacacacatacatacacacacatacacagagacgcacacatacacatatacacacatacacacactacacatgcacatacacatacacacacacacacacaccatgtggccagatggtctcagctcaaggccaggatcatgtccatcttgtccatgcctctgtccccggtgctcagcatggcctggcacacagtaggtgttcaataaatgcttggtgagcaaatgactctccgtggcatctgctggggagaggatctatggcagtgtcaccctcgctcccaaatactacccttaagaagaacagctcacagtcactgtgtgccaggctctggggcatctctccccctctagagtggagccaaaacttcaagaaggcaggggtttctgtctgctttgttctctgttgtgatcagtggctgcacacagtaggtgtttagtaaatgcctgctaactgagatggacaccttactgtcattagctcatgcagaggaggggcccaaagcagggggtgatcaaggcgggtgctaagtgcaaatcccacttctgccacctactgagtgcgtgactttggaaaggggcttttgccatcttcaagtctcagtgtccccatctgcaaaatggagatgacatcaggacctggtgtggcattaatgttcacacacagaccctccaccccgacccttctaagaattctgtatttgtgggttcagggtcatggtcccccggtgccagcagtcaccttatggaggacaaaaccagcataaaccacaaggcaaaaggttaaagaaacctgttttctgacttttcccctccaattccaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgatgcctgccgtctggagtctctttgtcccggcacaggagtcattttgcccctggcaggcttggggactggatggctgagccacacctgggtcatgttcaggcacatctgagccaatctgggtgatgtctgggccacatgtggatgatgtccacagtcttgaccacctccctgtgcttcaggaatcagaaagccagctcttcccacctgccttcatgtcagcctcaagaccatcttcagtgggatggcttttagggtgggggacatatgttttgtttatcttggcagtgtggtggacagaggactctctgaacaatgtggatctgggggcagatgaactaggcttggagctctggctggcctcttaatgcttctttgactctgggatgtagtttcccctctgtgggcctcagtttccttctccgtaaaatggggatagtcattgtctctgccttggagggctttggtgaggagtaaatgagagaacagttccagatacatggtagatactcagacaatgtcgtctgtgggtggtcattactgctgttgcctggcctctggagtgttcagccttatcaccaaagtgccatcctgctcagacagtgcatgactgccttgtctttctggcctccctgatgtcagggcgcttgggacagacaatagggtccctgttctccagacctcaggcctgcccagtaccttcagttacacgagggccttgcaggaagggatagggtaggcatcccaggaaaatgcgttgctcatcatgagagcacaaacaggcataagatatacagctcacagcccagaagggcagccagggacattggccaggccaagaggcacacagaggcaccaggccacagccttgcacaaggtgcttacaccattgtcagtgaccacttacccaacagctactgagtgccagggctgtgtggaagttccccacgcatcccagctcccagccaaacagctgcccagtgccagggctatgtggaagctccccacgcatcccagatcccagccacactttgggtaggattttgttccccacacatcacattccattatttttctaaatcatattcaatctgcatttgaactcccattcacaaaggaggtgacaaagtccatctccatcttgcctagggttggactcttctggctccctagggtcatacaaggatcttttgggggcttccagggagcctggaggatggagtagcccctctagtctgggtcccacctggtcctgatgaagggatccctgtcccagtccacgtgaccctgtcagagtcaagtagctcctccaccccagccaagcggggcacagggatccttctccaaaacagcccgagccgtatatcctccgcgtcccatcacccacaccctctggggcttcctgggggtcagcagatacataaccctggcttcctcaccctttgggggagggaacaactctaggacacctgctgtagacaggctcccagctcaccagcgggactgggccccagttgtccatgctgataaccagcgtgctgacacagtttttttttttggtggggggggtgtggtttggggtttggtttggttttgtattgttttgttttgttttgttttgttttttgagacaaggtcttgctctgttgcccaggctggagtgcaatgacacaatctcagtttactgcagcctcaaactcctagattcaagttatcctcctgcctcaacattccaagtagcttgaattatagatgtgcaccaccatgcccggcccaatatgctctttataggttgcctcacctccccacctcacttccacactcccctaccagtgttccctggggtcatctcccaaatcaactacctgcactccaatcctgttctcagggtctgcttctggtgaacctcaatcaagatagccatttgctccaggcaggcactattctaaggatcttccagacctttggtcacgccaccttccccagcgcctgtggcacaggctccccccacacctgcacctgacaaatgaagaaaccaaggctctgacaactctgcaccactcccaagcagcccccaactattaccccacaccacctccttcttctctctgctcctttatcgcctacccacttgggtttccacctcccccaaaaaaagagaggggttgttctcctgtgccagcctcctgatttgggccttgaaacacaaccaccctccatgaactgctgaggctcctccaggctgggaattccacgactccactgccttgctgggctgcgggaggaaaactcctcaatttcctgctgtcttagcagcagcagcaaagagaaaacaccaagagatctcattaaatcatcgtgccttgcaggaattagtactgtgtttgtcttacagatgggagatgaagtaacaaacagctggtgatgtgatggggctggggcgggaacccaggcctcacccactttgccctgagcctcccagctgaatccacagcaggttatagatccaattttctttctttctttatgtctttttttttgagacagggtctcactctgtcgcccaggctagagtacagtggtgcaatctctgctcactgcaacctccgccttcccaggctcaagcaattctcctgcttcagcctgccgagtagctgggattacaggcatgcgccatcatgcccggctgatttttgtgttattagtagagacggggtttcgccatgctggccaggctggtctcgaactcctgacctcaagtgatccacccgcctcggcctcccagagtactgggattacaggcatgagccaccgcgccgggccccagttttctttttcttcaaaataacggtaacaaccagcagcctctgctcccagcacagtgttatctacttcctgtgagttgagcattccccttttacagatcaataaactgaggctcagagagaggcagtaacagtgtcttgcccatctccgtgtcctgcctagggcttcccttttgtggaagacacccccatgaaacctcccatctctcagcagagattagtcaatgaggtaagcatatggaggccgtggggctccggtctttttcatttagagaccagatttgggaaggaaagaagacctcagtggttccactaacaccctgcgccttcctggtgactcaggtgagcagttaacccaagagcttttctctgcccttggcagaaggaagacagcccttcacaataatattgagacccagtttgcagaaatgaaggggacctatcaactcttaaatcatattctaacccaaaaaatctgagattctaaaataagaatatcccatctaatctatgctgccaagtcatattaggttgatgcagcaacttaatactgacactagccctttgcttttgaggttagccaaaacgagaacttcagagctgccattgaccttgtgcttcctgcacagctgctgtcttctagaccccacccttcaggttgggcacggtggctcatgcctgtaatcccagcactttgggaggctgaggcaggcagatcacgaggccaagagatcgagaccagcctggccaacatggagaaaccccgtctctaataaaaatacaaaaattagccagacatggtggcacgcacctgtagtcccagctactcgggaggctgaggcaggagaatcacttgaacctgggaggcggaggttgcagtgagccgagatcacgccactgaactctagcctgggcaacagagagagactccatctcaaaaaaagaaaaaaaaaaaagaacttgcccttccattgtcagcctctctgccccaggtctccagccaaagaacacagtttaacacctgctctgtccatgcctctgagttgtgaaagggaaagacattaaccccaggaggaaaccctgtgaaaaatccaaaatccacctagagaagagtcacacctgccattggggtgcccatactagacagcaattaatgaagccgtcaatgctgacacagccagctgtgcacactcgcagtggggatgccaggattcccacatcaaaggaccctggcacagcagtttggttgggagctaggtctccgagtcttggagctgcgtggcatagtgacaccaaatttctctttcactgagtggtcagacccctctctgggccctgatttcaaatcccagctttatcatggacatgctgtgtgacccagagcaaggtacttaacgtctctgagtctcagttttctcatccataaaatggaagttaaaagaaataactttttgaacacttcctatatgctaggccctgtactgagttgccttaacgaaccttcaccataccaaaaagacataaatggatctatcattcccatgttacagacacgaaaagtgaggctcagaagagaaagccacttgcccacagtcacacagctcctgattgaaggtggcagtttgagcccaggcctgtctggctgcagagaccatgccattggtgaccacgtcatagcaaaaactgatggcttggacaacctagacagaaagggcataggtcctgagactcggcagagcttgaaagtaattttaaaattaaaaaattttttaaaagactatagagaatggctaccagaaggtggaccccagagcccccctgcctggcccttgccacccacctgctctcctccctctgcctcacccccacacaatcactcccgtgggttctatgactgccacatcctgtactaggagcccccgcagggcccctcccgagagctggggtccctaccagggctccacagctccaaggacgttccaaacggaaatgacccactctcaaaatcacagggccccacccgcctcctccctaaagcctgttggtccaggactcagggcctgcccctccagcctcagttttggccagaagccccttgccacccagtgccaagaggacctctccctccactgaagagctcctctgagccgcaagcctggccaaggggctggacttcctgcccgggtacccacccgcctgggcttctgagctcaggttaaaaaagttgtctttctgggaagctggagacagaggccaaggagagattccagataaccccattcttggagatgtaaggccaaggaggtcaacggggcatttctcaaatatttcttgagcacctataaaaacgttgtgaagtggcacacagatttttagcaccaggcgaacctgggccggaatgccggctctgccactcactacctgtgtcaccttgggtaagttatctctccattctgagcctcagtttcatcatctgtatcttgggcctgatatcaatgatctgagaccattggggtgaggactcaatgatgcgatgaagcttgtgcagccctcagcatggtgcctggcacatagtatggactccagaagtcagggtcggtatggctggctcaacccaggaagtggagagggtggaaagatgagtgtgctgtgctgagggcaatgggggaaagagatctgacttgagtgaactgatagagaaaagtgtttgacacagagactgactaagtgctggttggatgaatagtggatgcatttgacatcagcttggaagagcaaatgccacaagcacaaatttcacagcccaatcaatacaaagcagtttgtgtatgcaaacaaacacaaaaccattctctttccgttatccgatttggtcactgttttgaaatcctgtgccaccaagtagcaaaaaactggatactcaaggcaatgccaggacattctaaggcactccagcgtaggcttagccacttcaggggtctcctcgccttgctcaagggcagcgtctaccctctgggtggcttcttcatgggcatggcatggagggcaatggtagctcctctgtgggccctgtttatagtgacatctgccctagagatgtctgcattttggctggtccctgccttgcagttccagaagcttcgtttcctagtggaatgctcctgcccacccagacagcccctgcctgcagattctggggtcccagctatgccctttcagacacgtggcagggctgaggttctgctggtaggaactggtggtacaaatgcagtgtttggaatatttctctgctagctggtaaagatctgtagctttaagccccccaggtgcctaccgctaccacctctctgacacctcccccagaacctctatcccatagcaaactcaagatccagaagcctccagtgttaaaaggaagtgctaggctatgaggaatgactcacacttgtaatcgcggcactttaggaggccaacacaggaggatcgcttgagtccaagagttcgagaccaaactgggcaacatggcgaaatctagcctctgctaaaaatacaaaaattagctgtgcatagtggcatgctcctgtagtctcagctacttggaggctgaggcaggaggattccttgagtctgggaagtcgaggctgcagtgagccaagattgtgccactacattccagcctgggtgacaaggcaagaccctgtctcaaaaaaaagggggaagtaatacatcctttaacctctcacaatgtcatccaaccatattaacagctgttgggcactcactgcttgctaagtgctttgcacatattatggaacatattcctcacaacgacctagaattgtccccattttacagatgagaaaactgaggcatgaagaggtcctgtgacttgctcaggtcccaccctcaggaagtggcagggcccagctttgaagccagcccacgctctggagaagggcactccaggccgagggatccacaagcacaaatgtacagtggcaggaagtgcaggctgtgttcgaggactagcggatctggagctgggggcagaggcaagggaaggaaagctggagagatggtcctaggagaggcagagctgggagatacacagtgacagggccccggtgaggacgtcaaggctcccacctctgtgtctgcaggtcctggccaagagaatgctgctgctctggatgtcactgcttgctggacgctgctgccccaggcccaggggaaggcccagcacctactctgccttcagaggacaagaatcagtgggaaacaggtaaatgttaaggggtgagcgtcagaggcatgaactcaggaaaggccaggggtgggagacggcaccacctccctgctcaatgcttctcctgtacaggcctcccccttgccacagaattcaccttacctcacccagagctgatcctgtctctcccctgctctaacacttgccatggctcctcagtgccctcaggagaacctctgagccccttatcctggcattcaaggccctgcatctccagcctcttccactgcctccttccctgaccacccccacagacttcacagctccctcctgtgctaggctgttcctctggcctgaaatgcctttctctcctgctcaacctggtgcatctgggcccatgcttgaacgcaaagttctaaccacctcctctgggaattcctctcgatttccccaggcagaagggatctctccttcctctgagttcccacagccctttggtgacgtctcctctgcggccttatccaagtgtgctgcgcctgctgtcccatctgtctgtagggctggctgcctctgtccctaactcctgactgagctgtttgtcatccatccagccccatccccgctcgccacgctgcagcctcacttatctttctgtttcctaccacgccaggctcaccagcacctcagggcctttgcacgttctgttccctctgccaccatggctgtccccgagatcagcctgcatgatggattcctccacctcactcaggcctcagctcagaggcctcctcctcagagaggcgcttccttttcaccccatcagaaacagatcttcacccagtcatgctccgactccactgtattttttcttttgcacagatcactctggaatattgccttgcttgctgatctgagtgctcggcttttgtctctctccctaccaggaagtaaactccatgagggcaggagccacactgcttctgtcccttgagcccaggagagagtaagcactcagtaagtgctggctgccaaatgactgagtgaatttggtgaaaggttgaatgaacagtacagccccacactgaagcggggcttgcatcctcggacagttcagacctgttctcagagcactacaccctggactgcatgctcagcctgcctgtgacaggggccaggagcaaaggtgttgctgtcctggaccacctgccctttgtaggcaaacgcctctccaagaagagcagtgggctggacctgtcgcaggtcggtcggggaactgctttcagggaagagcctccccctgctgtgggagctactcagggcaggtggataagtggagggctaggactgcctctggcctttcctggtaccctgagcagctgtgttctcagcacggtgtctttggaggttctctatagcctggaaagtgctaagcaagtctacttttcttgaccctatgtctctccaagctgcttgaaatcttcctaggaagaaagtagggtctcaatctgggacctcagcccggcagccctcctgctccctacactcagcctacaactgggttttctgcaaacctacataggtttttgaaaaatatttttaatgaattgccaacatataaaaatcaagaagattttaatcaaaatctgggtttcccaattgtattagattgtgaggactgccataacaaagtactattaatacaaactgagcaccctggacaacagaaacatattgtcacaggcacagcggccgacatcagtaatcccagcactttgggaggccaagatgggcagatcatttgaacctaggagttcaaaaccagcctgggcaacatgataaaaccccatctccacaaaaaatacaaaaattagccaggcatggtgacgcgtgcctgtagtcccagctaccctggaatctgaggtgtgaggatcacctgagccctggagttcaaggctgcagcaatccatgattgtgacactgcgactccagcctgggcaacagagtaagtctctgtctcaaaacaaaacctccaggtaaggcaagagggctcgcacctgtaatcccagcacttcgggaggccaaggcgggtggatcacttgagatcaggagttcgagaacagcctagtcaacatggtaaagaccagtctctaataaaaatacaaaaatcagccaggtgtggtggcacgcacctgtaattccagctgactgggaggctgaggcaggagaatcacctgaacctgggaggcagaggttgcagtaagccaagatcacaccactgcactccaacctgggcaacagactgagactccatctcaaaaacaaacaaacaaacaaaacccaccagagccggcacagtgacacacatttgtagtcccagcttctcaggaggctggagaggaggatcgcttgagcccaggaatttgtaatgtgattgcacctgtgaatagccactgcattccagcctggacaacatagcgagacaccatctcaaaaaaaaaaaaaaatccgtgctaaaggcagatatacagcagggagcctgacccagaaaagttttcctctggcatttgaatttgttgctgcctcttccagtgggcaccagatgagtcaccagcttgtacctaacgttcaaaaaatacctaaaactcggctcctctcagctcagggaggtgctggtagctgatggtgcagaagggagcagagcagatgggtcctgagcagatggcagagggcttacctgccaccttgccttccctgactctcgctggcctgcttctcttttgcagatgcttacgctcctctactgttccctcccccattttacagaggctgacacggaggcccagagaagggaagggacttgcctgggtcgtcaagccttggagaatggaactagagctcagcgttctacagctgggctgggggcaagggaaggggttgtcccaaagctgctcccacccctcctgggctctgcccctattccagcagatccggatactcacaccccacagagtcacagaggcctggccaggccacaccaacatcctccatgcctctcacaggttggtcatagaagacgccaaaagacctgagatcaccctgcaaatcctaagtgatagcctgctgcaggtcacgttgcgctgcaaactgtacctctcactccaggagtaagtacacacgggcacttccgcatcacccatttgggtgccaggcagaccaacccctcactgccatgaatcaagaggcagccatgcagggctagcaaaagtcacatgcctcatgtcaccacacgatcctttccacttgggcgtgtttcaaagccatttttactgataaggaaactgaagcacggagtgggagaagaacctgcccaggaacacacagtaagtcggtggtgcaggttggataaaaccctctgactttcatgtcaggggacgtgagcccatctgagcaaatgggcaggacagtgtattaacaggattacccgaggaaggtgtggttcaagcacgccttggagtctggcactcctgggctgggcaacttgggcaagaggtgtccattctctgggcttcggcttcctcatctataaaatgggtataattggccaggcacgatggctcaggcctgtaatcccagcactttgggaagctgaggtgggcagatcacttgaggtgaggagcttgagactagcctggccaacatggtgaagccttgtctctactaaaaacacaaaaattagctgggcatggtggtgggcgcctgtaatcccagctacttgagagggtgaggcaggagaatcgattgaacctgggagatggaggttgcagtgagccgagattgtgccattgcactccagcctgggcgatagagcaagactccgtctcaaaaaaaaaaaaaaaagatataattctggtttcctgctgcactaggctgttgtgagagttcacctgcaaaattctgaactgcagctgattggacagaccagaggttgcaaacacaacagccaacagaggcagtgatacaaaccagtgtttgcaagtaaaacagaaatattcctaaatgccctttaggaacgtgtccactcttgtttttcttgtaaaatttggctctcttcatctagcttccacctttttttctttttttttatttttttcagacagaatcttgctctgttgcccaggctggagtgcagtggcgcgatctgggctcaccacaacctctgcctcccagattcaagcaattctcatgcctcagactcccgagtagctaggatcacaggcatgcgccaccacacccaggtaattttttttatttttagtaaagacagggtttcaccatgtcggccaggctggtttcaaactcctggcctcaagtaatccacccgcctcagccttccaaagtgccgggattacaggggtgagccaccgctcctggccaaacttcccccttttaatagagatgtgagtacaaataaatatttctttgatagacacgtggacacagagaaatatttctctgcaatatggtaaacatatcattccccttgtagggatagtgcagtaaaaatggaacctgaccactggcctggtggggaccacagcaaactagagagcacatggcccatctcaaggtcaccctcagccccagatgtttgccactctgtgagaccaggggatccagtgttgtcagatcatctgggttttccatatttttaatgaatcctcctagtttttaatttgagcccttcaggcaacggcaggctatcagcttgtgacctctggcctcaactttgggctccgcactttcatctgcccaaatacactgtccctacaggatcccgtggctcaaagtcatcaagagcattcacattggagtacggctggaacagacagggaataccaccaaggtggctttcgaggagtgaggagtgccacagcccacctggacacctgagcactgaggctctgcagcagtgagtatgtgcctgctccaaagcttccactgggcaaggctgcgtgccagccctttctttctttcttttttttttttttttgagactgagtcttgctctgttgcccaggctggagtgcagtggcacaatctcggcgcactggaacctccgcctcccaggttcaagcaattctcctgctcagcctcccaagtaactgggattacaggcacccaccaccacacctggctaatttttgtgtttttagtagagacagggtttccccatgttggccaagctgctctcgaacccctgacctcgagtgatctgcccacctcggcctcccaaagtgccagtattacaggcgtgagccgccttgcccagccagatgccagccctttctgcactgatccttcactgaaactccgggctgggactgcctctccccagctagttgtctggagtggccggagcaccgggaacagggtcatctccaaggccacagatggtacccatcagcatctccttcctccatgtcaaatgtcattgctaagagctgaggttcaagcctcagcttggacacttcctaacaatggggcctggccaagttatttgacctctaggagcctcagtttcctcaccagtaaaatggaatggctcacagtacccaaccagcatggctggttgtgggggaaaaaaatgagctaacccatgtgactcacttagcacagagcctaccacataaaatggtcacgatctatcgttcttatgtttacccaacacaaaacctccaagaatccttctatgaccactgtcaggtgtgacctctccctgctcagaaattccagagacctttatcagaaagagaaataaagagacagaggcaggtgggtgccatggcttatacctgtaatcccagcactttgggaggctgaggcaggtggatcacgtgaggtcaggagttcaagaccagcctggccaacatggtgaaaccctgtctctactaaaaatacaaaaattagccaggcgtggtggcaggcgcctgtaatcccagctacttgggaggctgagcaggagaatcatttcaactcagatgcagaggttgcagtaagctgagatcacaccactgcactccagcctgggtgacagagcaagactctgtcaaagagacagaggcagagagagaaccaggaagaaataaagagaagcaggagaaaatcagggagggagaaagcaagaaggcaagcagaaacagaaagaggggaagagaagaaagaaggggcaggaggaggaaggcagggaaggagcagccactggagcccccatgccacacaggcctagaggggcttcctcaaccctgccctgactcgccctcctgactgcagtctgccagccatggtgtgtcagaccccaccagccaccctctccacttcctctaggatggacaccctcctggcaaacaaagcccagctcctatccactgctccttccccatcctgatggaatgacaggaggtggatcgggaggacgggaggcttcgagtggaccggaaggaggcactgtaaacaaaggcgcagagaaggaaatgggccaaacgagggagaagcagggaaaccaggctcctgggtccaaagcccagctctacctcttcccgtgtgcaggatcttgagtaagtcacttcccctctctgggctttagcctcctcatctgtcaaatgatgacaatgacagttcccatcttgtggcactgtcgtgaggttcaaatgagattgtacatgttgatgtgcagggctgtgtctagcacatagcgagcctgcaaatatgtttgctgtaaccagttgcccagggaggcccttcccactgaatttcttcttccttcatttctatgaagcttgtggccccctgcagcccgggccagagagcctcaaggcctgagcacctggccccccagcccttcccaacatcagcccagggaagcgtggcagacctgctcttttggctggaagtctacaatgacatctgttctgcctccacaccagcaaggagttccacgtggacccccaggactccacagtgagtgctagaagaaggggaaaggggcggggagaactattattgctccatttttcacattaggaaaccaaggcccagatggggaatatgactggtccaaggttacgtagtgggtaggatcagggctacagccagatctcctgcctccccgctgggctgtccatcacacacaggaatggcagctctgagacagtcagaagtgagcctgtcattccacatctacagaaattcttacaccagtgggcaagggcattctttgtattttactagttatgtggtgaaaaataaatttaacttagccaggcgtggtggtacacacctgtagtcccagctactggggaggctgaagcaccagaattgcttgaacctgggaggcggaggctgcagtgagccaagatcataccattgcactccagcctgggcgacagagtgagaccctgtcagctttgttgtatgtatagacattttcataataaaatgtcaggagaaaaatcattgaaacaatacaaagttaacctgtccagataaatcatggtgagaaacctcctcttacgctgggacggaccagtggcaggcggtacatccagtagttacagctcattgagccccactgagctccctccccaaccagccagctcagagcccgtctgcaggattttaaagaccaacacacactttgccccttttccaggctgcagacctcattcagctattgtcacggattgagctggagcccaggcccagggtgggtgtgttgccagctcctcctccagaagcccagccagggtctcaggggagattctgagacaggagctgggccaggtcaggccacatgggcgtgttcccttaggccagggtttcctgccgtggactccaaaaatcactgcacctgctacacaggcattgtgaggatttaatgagatgatgtaagtaaggcacttagctcagggctcagctcaggtgaccatggccctgtgcctgccattactattcactcctgaataagacccaagcctgctggggggacacctagataatggtgggcagtgactgtacacaggtccctcccactacatcagtgcaaccctccagtaaccctgcactgtcacccccttctacaggtgagcaaactgaggctcagcaaggtgagctcactcgcccaagctcacatcgctcagtaaatggtagaaccaggattggaaccccgtccctgactccaagatccttgctcaatgtcctttctccaaagtgtttcagaacagagcccctgatagacaagcagtaacaataaccacaacagctgacaagtatatggcagtactaggtgccgggttcttttctaagcactttatacaaattaactcattgaatcttcacaacaacctctgggctagttgcaattattatccctattttacaagtgtgaaaatcaaagcacagagagattaagaaacttgcctcaggccacacagcttcccagtggtggagctggaactccggttccaaaactctatactcttacctgctatgtatgttcaggagaaggaggatgttatcccacctccaaaaagcccagggagggtaagtgacctggccaaggtcacacagcaagttgctgcagtgctagaacagaaccccagacccttgactcctaagatagccttgcccccgttcttccaagctgggagctgaggaaagccatctttagtcaatgcctgcaccttttctgctgtaatttcacccaggcttccagtcagtccagagggagcatacaactgaccatcaacacccctgatcctcccacggtccgccttgacggccacacggccaccatcatccagccgggcttgctagtgctactggggctcagcatcacctcctctgtctcagtttcctgggtgagtgtattagtctattttcatgctgctgataaagacatacccaagactgggtaatgaaaaaggggtttaagggactcacagttccacgtggctgaggaggcctcacaatcatggcagaaggtgaaagtcatgtcttacatggcagcagacaagagagaatgagaaccaagcaaaaggggtttcccctgataaaaccatcagatctcgtgagacttattcactaccatgagaaaagtatgggggaaattgcccccaggattcaataatctcccaccgggtccctcccacaacaggtgggaattatgggagttacaattcatgatgagacttgggtggagacacagccaatcatatcagttagtgagacgcaaaggtctttgttccctagggggcctgggtccactgtgagaacccctccagggccagcgagctgtgcctgctgctaaagtgttaaaatactttaacacctgcacccctttgttcacctctggtgctccacaaggacctcagcaactaaaggattctgcctccaagaccctcagctcggagcccttgccaggtggtggttaagccctttgactgcctcccttgggcgtgatggcatcaaaagccatcacaggaggaagtccagaggcctggagctcatggagcgctgcggtgtttctccactcccccagagagagggttacccaggctagagagggcggggccctgggaggaaatctggggaaatacagcctcccaaaagtttcagcttctctattctgagcccccttgggattcctatttcccgttccacggactttgaagttgagaaggtgcctcaaataagcggtcaggagggtccccaccatgggtgagccacatggcatccatggggaaacagtatcctggggtcttagttgacatgattctgcggcaaaaaaacaaacaaacaaactggtcatctctggcttgtgggaatcacttctcggcctttcttggtgaagatcatgtatctggctggtggggtaacatcctatttctggcttataaggtgatcgtgtgagttacggaggcccatagacaaccccctcaacaccaaggggtcctctggcttcaaggcaacagtaattctagagccaagtgactctcattacaaaaggctgtccctccactgggctgagtccctccagctgtgtccagccctggccccactgccatccaagagcacccagcacccacctgtgcccccacccccggcaaggcccacacatgcctggtctggatcaacatgaaccagtagctggagaagacaatgacacagggtgggggtgagggccagatgagaagggaccaagcccgaacaagcattcctgggggctgggggtcaagggggtccctccggctagaacacaaattcttctcctgttctgacctaatttcaattcttcatagaaactttttttgaaggctgcattttccctaagaaatcaggaactacatgaccgggcatggtggctcatgcctgtaatcccagtactttgggaggccaaggcaggcagatcacaaggtcaggagatagagaccatcctggctagcacggtgaaaccccatctctactaaaaatacaaaaaattagccaggcatggtagtacacacctgtaatcccagctactcaggaggctgagacaggagaattgcttgaacctgggaggcggaggttgcagtgagccgagaccatgcccctgccgtccagcatgggtgacagagactctgtctcaaaaaaaaaaaaaaaagtggagtccccaggactgctgatcccctgtgagcatctgaacactggtgtcccatccttcctcaggccagaatctgctgacccagctgaaatgtccttcctgttcctctgtcatctgttgcaggaaggacattcaggggcccttctcttacagcttttgaagagggtgtttctgcccatcacaacagtgatccccactttctctgtcacacccacataccatactcagagcagcattaaacatctccaagacagctgacttctgcctggggttggctaaaaactgcccacaggtggccaggcgtggtggctcacacctgtaatcctcccactttaggaggccaacacgggaggatcacttgagctcaggagttcaagaccggcctgggcaacatggcaagaccctgtctctacaaaaatatttttttaattaaagaattgcccacaggtaaggcagaggaggcagggtagagatgctgaaatccggggagtgtcatatgagggggctgcggaagggaccatgggtgccctcctattcttcacccggacagcaagcaatgatggaaggttagaactgggacaagtgcgcagggagggcttctcgaggtgggtggaggttggcatgatggaaatcggaatggaaaaggccctcagaggtgatggcacccagagctcacatctccaacacctgcaggggcaggcgggtaacacccaggtgaagaggcccaggtggggcctttggtgaacacgaccccgcccagtgggcggctccactctgctcagtcgaatgttctcagcacagcagaaccgcagattatctttaagagacaccagaaagctgaactttctgagatttcacccccatctttagatatccgcaacaaacctaaactcttccaaacaccattgccttggtttgggctccctcagaagcagactctgagctggggaagtgaaggtggcttcgggggaggtgatgccaggaagatggagggaggaggactgagtgctacgagtgtgtgcagagcttctctgctccgtagatctcggggcttccgacacggtttgtgtaacaatcccccatccacccatgtgatgatttggtgagtgcctgtgtccccagccagacagtgagctgccccagggcagggacccctcggtttcttgttgcatctccagcaccctgtccagtacctcgcatgcaggaggcactcaagaaatacatgcaggagaaacagctcagacctcactcatccgagaagtcacctgagatccctccccaccaggcccagagagattaagtgatttattcaaggtcacacagcaagtctgcagagctgagcccagaacactggcttccccaacagagcttctccctgagctccgactcatgttgggacttagagtgacactagaggggccggcaggtaatgacaattaggccagcaagggggtatcggaccctcccctgagctctaagtgatgatgtgggcatgggttggggcaaaggctggtcagcgcaggagagggagcaggaggggcccaggccaggcccccaaggtcaaatctgggagactcagtttgccaaaaatcaattcccagccaaatggctaactcactgaaactcaaattgcaaaatgaccaattctccaagtttaccaaatttacccatttcccaaaatcttgctttaaggataatgtttcatgtattttataagcatttgtgaatatttccttctttgatatattcaatggatattttcttattaatatgaccaaatttctagtgttttaaggttaattttttagtttattccgacttgtttctaatcctttttttaaggacattttctgtttctaccaacattttagcatttttcgggggggagcatatagtgtttggggctattcccctcaattaaaaaatagcaaaattcactaacaggtttataagaatccttcaacaaagtgaacattccttaaaatgttgctgagaagaatgtgttcagtcactgaataggttcaaggatttcccttaataaggttcttagtaaatgggtggagcagccctttagagaccagctttcccagctggagctgcttgctgttcaggggctgcctgatgggggatggagatagtccaccctgagcaggggtgggggaacacaccctgtcccttccccattctgagcagtggagcagccagggaccacctctgcccaccagggcactgaggtcccctgcccgcccctctggcagagctgctcagagaacacagcctccctgtgcccaacatcaggggtccttccaccaggcccaaagggacctctcagaggtaagcctggggaaaaagagctgcctgagacgcacatgggtggtcgtggctataagtgactttgagccctagaggtgcctcgtctcatcctgcagaagaagaagctgaggaggcgcttgtgtcccggccctcagccttcttacctcgcctcctctcaaagccatcctgcatgtgactccccacttacagatgaggaaactgaggctcccaggggctgcacgagtcccgcagggacccagaccacagggctcttggagagcatcaatgcccctacacaaatgaccttcacaatgagctccatgaagttgatgctgtaattccctcccacttaacaacggagggaactgaggctcagagagtcagagaaacgtgcccagggcagcagaaccgggatccaacaggggttcatctgacttcaaagtctgtacccttagccccaaccacccacctcccgagaactccagaccccagaacagggctgttgcctctgatgcctgctgtctgtgaaccgcagagggtggaaaccagggcctgcccaagggcacccaaataccagggaggcaaaatgcagcagagaccagagggtagaggaaaccagcgaaggaaccacagaggaacccccaggagagtttgccagctctgaatctgcccctggagctgccctgcctgcccagccctccttccttcccactgtgggctgaacctgagaagaggtggacaggggtcaggggaatgggcgggtcttagagatgcccttcatttctttaactcccacctttaaaagattcccatctgtaaacagcagagcaggagggaccaaggcagagacaatcatacggaacctcctggctgcatgaccatgggcaagctgctgaccctctctgagcctatcgttcatatctggaaaatggggataaagaaaattctggccaggcatggtggctcatgcctgtaatcccagcagtttgggaggcagaggcaggtggatcacgaggtcaggagtttgagaccagcctggccaagagaccagcctggccaatatggtgaaaccccatctctactaaaaatacaaaaaatgagccgggcatggtggtgtgcacctgtagtcccagctactcgggaggctgaggcaggagaattgcttgaacccaggaggtggaggttgcagcgagctaatatcacgccactgcactccagcctgggcaacagagcgagactctgtctcaaaataataataataataataattctccctaggagctggaagtcagggctctccttacaaacatgaggaagtgttaggaccactgtcttcagccagccctgctcaggcacttaacagaactcaaccctaatcccacacagagagaccctgcgctgcacaaaaggaggcagcaggggccggcagcagtgtgcctcatcaaaccctgcttccagccccaccctgcagacccctttcctagattcagcccctggtgtccctagtagggaggggaggcccagacgcactccagtgaggaccacaggggccactacagggcctgcaaggcctgggctgctccaaaaatgatgctgcaaatcctggccaggtggacccgtctgctcagagtgcacccagcgtgggcagggcccacctgtgctctgaatatcagagaggagcagagtcaggacccagcctgagccttgaaccagccccagcagctgtctcctaactggcctgtgagaagcaaaggaaaagaaggcaaatgagctcattggcttactcgccgagttacctcccggcttccttatgctcttgtgcaggccacacatgacacaactgcagggtgcaccacttgtacagtagtttacatgaacaatgccacctggagttgggcagtgcacaacctacacaatcttacatggctgccctgatgacccactcattcattcaccatcactcagtcagtcagtaacctcactgactgctctgtgcctggcccggtgctgggcaatgctgagacaaaaagatgagttagactcagccccggaaccctccaggagctcccattctggtggaaaacaataggtgcaggagcagacagatcccagcagcatggtcgggtctggcagaggtttgggcattgtgggtggcaatgcgtgagaggctctagctggtgaggggcccacttcagggcgacccaggcaggacaaaccccgacacagaaatgttagagggcccttgacacataggctctcaggaagagtcccagagtctgatctgttccttccctcacaagctttcctgagattccccctccccctcctttctctccccttgtccaggggtccctaactctgccctcttcatccaggggaaagtgtatccttaggacacacacggcccctctaaggtgtagtgggagcagcctcaggcagagctggtattttgggcatcaaggacaaggatggtggggaacgtgctctgcttctacccacaggattacctgctgctggccattctgggcaagtagtggcttctgaccaagagccagtccaccccccgccatgagttttccagcccctgatggcctgcaaagggccacagtgttccaaaacctcagctgcaatacagagggttcttgcctgagcaagagtcagttctgagtatgctaaggggttctgtgaggaggggagactgtcttgaaatatttaaatgcgggctttttccccctgatatttcttggcttcccgtggcccctgagaaaggaattctgaattctatattcagtgtctccaggaagggagagttcctcagaaaatggtgaagaggtgtttgagtttcaaaagtcccagccctgacaggatagggtgtggaggggacacaaggaaccatgcacaccggaaagcctcgctgatggagagggaggaaggaagcaggaaagatgaggggcttgggggtctctaagaaagcgggaaccacagaagcccagagacgcttgggagaccctgagtgcggaggaaaggagctgagggaggcggcaagacccccaggctgggagctgggtccaagtgggtggtcatgagacaaccacaccccagagtccccaggcccacaaggcatggcgcacgctcaagaacagtgccatcgtggacgcgggcccaggacacacacatgccccgccccagctcccctcgcccacgtggccctggcagggcagggcagtgaacagaaaaagatcccgccccagagtcaaaacgtgcacggtaggtgttcgccggggcagagagaaggcaaagcacagagcgccccacccacaggcacctgtcgctgtccacagcaggtaggcctggccccaggaaaaggcagatgaggagaaacttcacactgattatgataaaatccctgggagcagcaggatggaggctcgtggcagcctctgtcttgggagtgagcaagcattcagctccctggtagccctggctggcctcagaaaaccagagtttcccgggggcccttcaccaccacacagcccaaaccatggaggctttcatgggtctggggcaggatcgctgtcccgcagcagaaggttggggttcagagcgagcctcgctgtgggttctttacgtggctccctgatctgtttcatttatgaaccacaagcccaaccttgaagggaaaaaagaccccagtgggcagccccagaggtcttgacctagagggcaggaccaccctgcacatgaacttgcaaagtctcccagcccttggtgtgcatatatgacacgactaagattgggtggaggctggaagacaagctgaaccctcaccccaagcccagagatttcccacccatgtgtcagctcggtgcccagcacatggtagatacttggtacaaaatgcttgaatggagaattccttgggaccttgaagaagccgggcaggccttggcctcctcagccaggatggcctgtccaggcaccggcaagcctttcccacccaccacgaaagcccctcgatcccctcccaagatttccacagatgcatcttccacggtgcatctcactttgcagtttgcaggctcatgcacccatcttcccatcagatcttcagataacactggctggtgccagacagggagtgtgattattcctatttgtaaggtggtgaggaccacagatggataggagggtgggtagatggaaggatgggtagatggatggtggatggatggatggacgaatgaatgtaaggatagataggtggatggtggatggatgaatggatgggaggatgggtagatggatgatggatggatggatggatggatggatggatggatggatgggaatgtaggaagatggatgacggatggatagatggatggataggagggtgggtagatggatggtggatggatgaatggatgggaggatggttagatggactgtggatggatgaatggatgggaggattgggtagatggatggtggatggatggataggaaggtacgaagatggatggtggatggatagatggatggatggataggagggtgggcagatggatggtggatgaacgaattcatcatcactaatctagccccactcccagctgagacacacagtcgctggaaccaagaagagaggcaggggtcaaggatttcagattccccatgttcatacaaatatttttcagaataaataactcttacctatttattagagcaaagagctcttctaagtgataccttaaaacaaacaaaacctagtttgaaatgttacatggaatcaaactgcttttttatccaaagtaaattcataattcagacatttcactaattgacatcttcctccacaagatatccaagtgcttgaggtcaacaagagcaagccaaatctcagatggatcaagaatctcgaacatattcacattatttgaaatgcatatgattaattcccacttctgggaatttcctaaagaaataatcagagatggctgggcgcggtggctcatgcctgtaatcccagcactttgggaggccaaagtgggcagatcacctgaggtcaggagttcgagaccagcctaacatggtgaaaccccatctctactaaaaatacaaaaaaaattagcctggtgtagtggtgggcgcctgtaatcccagctacttgggaggctgaggcagaagaattgcttgaacccaggaggcagaggttgcagtgagccgagatcatgccattgcactccagcctgggcaacagagcaagactctgtctcaaaagaaaaaaaaaaaagaaaaagaaaaaaaaataatcagagatgcagacaaagatggttaccatagcactggttttatggtgaaaatttgagaacaatctaaatgtccaacaatacaagatttatttttatgataaattcctaataaaaaatttgtacaggcattaaaataatgttttaaaagagcattcataagaaaatacaagaagactaggatacaaacctatttagagatgatctgaaaattaaatgtacatatataaaataaatgagctgggcacagtggctcacacctgtaatcccaacactatgggaggccaaggcaagcagattggttgagctcatgagttcgagaccagcttgggcagcatgatgaaacctcatcactacaaaaaataccaaaaaaattagccaggcatggcggttcatgcctgtagtcccagctactcgagtggctgcgatggaagggtggcttgagcctaggaggcagaggttgcagtgagctgggatggcaccactgcactccagcccaggcaatagagccaggccttgtctcaataaataaataaactcaaaatgtaggctgtgattgtcagacagcttgagtggtaggatcgcaggttacttttattttattcttaatactgtttccaaaacttttatggtgaacatggttgacttttatgattgggggaaaatgttctcattcattcaataattgtagggataggtatcgacactttgtgccacatgagcaaaacacagcaagaatggtttctgccctcacaaaacttgtgatggagacgttaaataacccagccaataaaaagacaaaggactacaaattccaatgagagccaagaaggaaaactacagggtgccaggagagagaagaatggcagcgtggccaggcacagtggctcatgcctgtaatcccagaactctgggaggttgaggaaggcaatcacttgaggccaggagttcaagaccagcctggccaacatgatgaaaccccatctctactaaaaatacaaaaattagccaggcgtggtggcacttgcctgtggtcccagctactagggaggctgaggcaggagaatcgcttgaacacaaaggcggaggctgcagtgagccaagatcgtgccactgcgctccaggctgggtgacagagtgaggctctgtttcaaaataaaaacaatggctagggtagcctactttagaagaggtgaccggggaaggcctcttgaaggagaagctgttcgagctgagacctgcagtgtgagtgagccaggtaaaatgtggaggaaagggttctgggcagtgggaacagaatgtgcaaaggtcctggggtggaaataaggtgggtctatctgagaaactaacagaaagccagtgcagacagtgaaataagcaagaaatggtaggaaatgaggttggagaggcaggcagaggtccaactgcacagggcctcaagggctaggccaaaaatatgggcaccattctgtgcggaatggtgattcactattttaagcaggagagtgatgtgatctgaatatgtcagactttttttttttcttaagagaaggggtctcactatgttgcccaggctggtctggagctcctgggctcaagcaatcctcctgcctcagtttcctaatgtcatgcacttttagaagaaaagagattgagccagagctacaaagctacagactcccagagctttgggggaaatccagtgctgttttattgtgagacatcagggatcaaccctgagatgttcaaaccaactaccctgagggagctcatatctctgcccagtgttgttctgaagagcggtggagacaggagaaaggaaggctgaaggtggagggaactccctgcctcacatcagctatcactttaggcactcagagccactgtcttctctgattcccataagccccatcaaagagaagcagacagggacttgttagcctatttgacagacagagaaactgaggctcagaggagctggccccattcattcgtgcattccttcattcatgcatttactgcacgctaggtggagacagggatgtgcaagacgagtgagacacgccccagccctcaggcatctcatggactatcggatcaagaagacaaggggcatatcctgggaaaaggctttgctccagacatgtctgcctttgaatctcagtcctgccacttctgcagagaagtaacttctctgaaccgcagtttcttcacgtctaaatggggaaagtggtgatgctgctgaggaggaggacgggggaggaagaggaggaggagcgaggaggaagataggttgttgtaagagtggaaagcatttgctgagtgctcagtagtgggattttggaggttgtgggcaactccttctgacccaagttttagtgtgatttccatgacacaccctgtctctccatcctgggcagcgttagttctcccttatgtgaaacccaagctggctgagcccacaggcaaatgcagccatagtgacactggagctattcagagccaacctgttgcccttctataaaaagatgcccactggcatcctgaacacacgaaacaatgtgtacccagtgggtgcaaagaggcagggggtgctcagaggagaagcagcagaaccagagtgcccataagccacacgtcctctgggaaggaagggaaagccctcttgggacagacacactcaattttgacttacaaagcagaaaccacaggcctaaccctgagtattgacatctgtgagcaagtggattgaaaagaaacagccaaaactgaaacatctgcaaacacgtcttaaatacagtacttcgctttgaaacctcttacacatttgtgacaaggtttgttcacatatctactttgggagcatgtgcccagaaaactttatacccccattgaaaatgaaacttcaggccaggcacgacggctcatgcctgtaatcccggcactttggaaggccgaggagggtggatcacctgaggtcaggaattcgagaccagcctgggaaatatagtgaaaccttgtctctacaaaaaatacaaaaattagccgggcttggtggcctatagtcccagctacttggggggatgaggtgggaggatcacgtgagcccaggaggcagaggttgcagtgagccaagatcatgccactgcacttcagcctgggtgacagagtgagaccctgtctcaaaaaagaagaaacttcagagtgaggttaaaatgtctctataccggctttctgtctagtaaaatcattctaaatgatccatttttgggaggagataaagaaacataaccccccaaaatccatattttactgtttcaaacaaggtgtaaatagttgtgaaaatctagattctgtagataggagaatggcataaaatcaaagacctgagcgtggctgatgcaatagtagataatgatgatgatagtagattatggagactcacatatcctaggcagggtgacatatttcatcttgtttaatcctcacagcaaccctatgataggcatgatttcatccccactttatagatgaggaaactaaggaacaaaaatattagataatatcccaaggccacacagccaggaggcagcagaaccaagattcatatcaaggcctgtctggccccaaactctgtgaccagaaactctgccttttcctaaaccattggttcttcaccgtttatacatcacaaggcccatcaagaatctcattaaagcaacgtggggatatcattgagcccaggagtttgaaaccagcctgggcaacatagtgagatcccatctctaccaaaaacataggaaaaagctagctgggcatgataacatgaacctatagtctcagttaaggtgggaggatggcttgagcccaaaaggtcaaggctgcagtgagctgtgatggcaccactacattccagcctgggcaacaaagtgagaccctgtctcaaaaaaaaaaaaaaagaatctcattaaacgtatctctgagaagtgaacattaacaccaaattttatatgcaacttcagagggtccagggacacaaactgcctgcagtagccccccgtgacctcgtgtgactggcagagatctgacactgattacgccagaggactgagccaaggaaggcaggccatggcctccgagttccaggggcctagacagacacagacaagcacataaaaagataaaagcataaacatgtatgcagacatgtgtgcgtcactaaagaatccttaagtttctgtccctgggacatcctcggctcaacctggcctattgtgatctcctcacacagaggctattaagagttggcagactgcattatcactggtcattgtgatctcagccaagacttggccagccttgaaaaggacttcccttcaaagagtctgcaggtcaaatcgcttagggctcagggacaaactggccgttgttcccagctgataagccaccctatgtcacgtaatccaccatggggaccctggattagcagaagtcaatggctgccccacctcctaaagttgaagaggagagagacaaagaagcaggaagccccgaggcccatcagaggctgcctcccggatgtgccccttccccttcatgacctctgcggttgggttcattgtttgggttcagagaatcattcgaggcaccaaactcaagggccacacccaccaatgggtggcacaaatttcatctcaaagatgattcaatttccctcaaatgtccaagaaaaataagacccaggacagttgagtttcgtctcctacttatcatcatgaataaaactctaagttctgccctctgacatttgatgcaaaggtctacgtatctaatacaaaggtctatgcactgtctgttcagcaatgtccaaagtggggcctttgacaaatgaaaccgtagttgaggttcatggcatgagaacctcagtggagctggagaggtcctgcagcctagggaaggccaggcagcagacatgctgagcctgcttgaaggcaggaccccagtccaatgcctagcctgcaggtccctgaagcgggcattcaccaccccctgaggcaaaatcagcttcctcacctggactcttgctttgtaaggctgtggttacaccaaacagcatgataggacgcacaaaacaaaatcacaaatcttcaagtgataggaacctagatgatgactgggccttctcctgctgtacagggaaagcctcaggcccaaagaataggttctagaatttggggagccattcaatgagataacaggtaagaaggagccctgtccaaagactagatttttttttttttttttgagacagggtcttgccctcttacccaggctggagtgcagtggtgtgattaaggttcactgcagcctcgacctcctgggctcaaatgatcctccaaactcagcctcccgagtagctgggaccacaggcacatgccaccacgcctagataatttttgtatttttgtggagacagggtttcgccatgctgcccaggctggtcttgtactcgtgagctcaagcaatctacctgccttggcctcccaaagtgttggggttacaggcatgagccattgctcccagctgaatttcttaaatataaatgagaacctcagcagcctagtgacaccattcaagtctcattccaggggcaaccaggggaagcaaagtgggctgagccagttatgtaactcccaagcttaaacccctccaccttccaatcaccctgaaaacaaaaatccaaagtctaccacagtgtatccctcaggatgcatctggtcacaggcaacagaaaacaggcccttattgatgatttcacctggaaggtgttcagagcagggcagctccttgcctggtaacatctgcggatcaacatcttccttcccatttctctactgtctccttcatcttcagccaagctctcacccctagagctactcaagctcatgcccattcaggttttttatactttccaaccaccctgcatccattactcactccccaggtctttgcatggttcgatccatcatcatgtcacccacgtctgggataaaatgtcactcagcacagaggtgtgggtccaaaggaatctcaccccctcttctccatcatctttgtttctctttcttcacacatgtatcattatcaagaattgtcaggctgagtgctgtggctcacatctgtaatcccagcactttgggagtccaaggcaggtggattccttgagtccaggaatttgagaccagcctgggcaacatggcgaaaccctgtctccactaaaaatagaaaaattagctgggcgtggtaccacgcgcctttagtcccagctacttgggaggtgagaggattgcttgaacccaggaggcaaaagttgcagtgagccaagatcataccactgcactccagcctgggagacagagcgagactctgtctcaaaaaaaaaaaaaaaaatagaattgtcctgttatcagtgtcccccactaaggggtgaactgcatgagggaggacacagtatggcatgtcccctgcctgatccctaccacccaccacagtacctggcagggagaaagtgcaggggctctttgctgaaagaatgcatgtgttgcacacatgctggaaccctgacaacttcccacttcatttccagaaaggaaaagtcggtactggaaggtcattttatgtccagtaggacaatccaagcccaaatcctagaccagctccagacttctgggtgtcttggggcatgtgacccctgctctggaactctgtcctcacctacaaaatgagggtgcagaatggactagactagtggttctccaatctgggccgcctgcagagaggccttctaaaacaaattcctgcacctccacccttacttattaaagcaggatccagaagttggggaagagaggaaccaagaattaaaacctgtaacatacgcaccaaggtgataatgatgtctattgggaccttcaggttcttctgaactcagaggtactggaataaagggcaggcccaggcccatggctgccacatggactctccagagaaccttccagatgctctgcccaagcccagctcgtgcagctcccggaaccagcttcctttccctccgagcctgatccatgctcattcactcatccctgggatgagctaggagtgtcagtctctcccagctgaccatcagcagccttagggctggaaccctgtctgtgatatgcaatgttctactgctgtccagaaacactgcctggcacaatatgtgtctgtgggaatgaaggaatgaacaagagcacgcaggcccattactgtggggctttttggagcctgcaatgaattaagatgctcagagaggccgggcacggtggctcacccctgtaatcccagcactttgggaggcagaggcgggcggatttcttgaggccaggagctcaagacctgcctggctgacatggcaaaaccccatctcttctaaaaatacaaaaattagccaggcatggtcgtgcacacctgtagtcccaactgctcaggaggctgaggcaggagaatcactggaacccaggagatggaagctgcagtgagctgagatagcaccactgcactccagcctgggtgacagaatgagacactgtctcaaaaaaaaaaaaaaaaaaaaagtcactcagaggatctccagacaaggagaggcccacctccaccctgtgcagtcaggcccagagcctggaccatgaaacagaggttgggacacatttgccatagggaacagggactgccccatacagtcagtactctatgaatgcacaagaatgtcatgtatcttgggggctgattgaatccaatagacaggggccatctactctacttacttcaggcacgtttgaactgaattaactacctagacgcattcataaggttttttcctttccgtcaactctttttttttttttttgagacagagtcttgctctgtcacccaggctggagtgcagtggtgcaatctcggctcactgcaagctccgcctcctgggttcaagtgattctcctgcctccacctcctgagtagctgggattataggcatgtgtcaccatgcctggctaattttttgtatttttggtagagatggggtttcaccatgttagccaggatggtctcaatctcctgacctcatgatctgcccaccttggcctcccaaagtgctaggattacaggcatgagccaccgcatctgaccctttctgtcaacttctatactaaattatttatctgcttcttctaatcttcccagcaaccttctcccaggagaggtgaatgccccaaactcacctcagggccgcccactcactacagagcctgtgaacacttttctgtctacctgggatgtttctctgcaggatgatcatagatcacctcagtgacacccgctcatccttcagacagcagctctcacatcacctcctaagggaagccctcccagatttctcctgttccctcacagaactgggctcctttccctcagaacataccctttcttcactagtccctcaataagtagtggcgtacactgaattacttcattcacatctgtcccacgcataaaactggaagagccccaccaccagagacagggttgggtctttcccacctgccagagcctggcacatttgtaaccagagaagtgcatgatggtaatggaagccaaggaccacacaaccggcaagcggcctacccaggatctgagcccagaactttctgactccaggccaggcgtggtggctcacgcctgtaatcccagcactttgggaggtggatcacctgaggtcaggagattgagaccagcctggccaacatggcgaaaccccatctctactaaaaatacaaaaattagccgggcgtggtggcgcaaacctataatcccagctacttgggaagctgagacacaagaatcacttgaaccccagaggcagaggttgcagtgaaccaagatttcgccgctgaactccagcctgagaagcaagagtgaaactccatctcaaaaaaacaaaaaaaactttctgactccagtgcccagagtcagtggctcagcagctcatggactcagtgctgagtgccgtccatgcccagagcacagcacgggcaccagagagggctcccctagggctgctacctgccagcctctcaggtccctctgctctgtcactctctagtgccccaatggctcctaacggcttaaaatggagaattaaaatcaggagatgtcaatgggctggttcatgttcttgactttgccccacaaaagaatctgagagctagtccaaagtaaaagtaaacaaaagggtttattacaaagcaggctgggcccggtggcttacgcctgtaatctcagcactttgggaggccaaggtgggtaggtcacctgaggtcaggagttcgagaccagcctggccaacatggcaaaaccctgtttctactaaaaatacaaagattagccggtgtggtggtgcacacctgtaattccagctgctaaggaggctgaggcagaagaatcgcttgaacctgggaggcggaggttgcagtgagccaagatcacaccattgcactccagcctggtgacagaataaatttccgtctcaaaaaaaaaaaaagagtttattacaaagcaaaacaaccctctgacagctcatcaaaagtgagacagctccgtgtgatgggagggatcttcctttatgggagatttgcatgattattcatcaaggggcaagaaagaggggctgctacgaaacacgttgggggtgctttatgaggcctgcatattcagtggctgtacgcgctattacatacatcgcatgtctcattaaaatcttaaatctctacccatgggtatagctaaactaaagtttttttttagcatcaaaaagagcctaggtcagtttgaggtcattagttccaggtttccgcacctgtgcaggcctggggattttttttccctcagttcttcctcctctttgctacaggatgtctttaaccacaagcccccgatgcggttcatggaataccaagtggcttgttcttgccataaatttgataagtgtttttttaaagagaggctctactatctaacctacctcagagagacagacacctggcctgcccgcccccttcacaagaagctccaagcactccgaacatctttcaggaagacactggcaatgttgcagcaatgagaaggggatgatttggaaggcagcctgaatcacgctgcccttatcagcatgcttggattgtgtcccttcttgtctgacttttcagacagacattgggctataaaattgggatgcagctctgtcatcaacagtctggcggcaggagcagaaggaaaggcagcttccgaaaacttggacccatccaccccaggcaaggtaagaacttgctgcgtcgaacgggtgaaagagaaggtccagctctcaggtagcaacaagcaacgcacagtccatctaaggacccataacgagggtttatgcattttttgatcgctttagcaatgtccctcccctgctgaaatgcactctgcctagcacagggaaggtggttgacaattgcctgttatgcattggttttcagagaatggatttagtcctgggattctcaaaaggtttcactcaagtcaaagtctgacaatattgccatcaactcagtcacaggcatagattttttttttctgcgaaagtatgcttagatgtcatgtgagatactgaggttgaatttcccgcagatgagagtaaaattttaaaaactaatgaagctgtgttgagatttttttcataaggcctaattaattcaaactgaagaattctcactggcttcattcagattgtacccttcctcacattcctgccatagttgctcttcttttttagggatagagtctcgatctgttgcccaggctggagtgcagtggtgtgaacttgtctcactgcagcctcaacttcctgggctcaaccgatcctcccacctcagcctcccaagtagctgagattacaggtgtgaaccaccacgcccagctaatttttttttttttttttttttgtagagacggggtctcacccttttacccaggccgggatagacacttttttagggtgttggcaaatggcaaatggcttgcttttgttaatgcctatacatggcaagggcaaagattcacaacccagcctggcgcagtggttcacacctgtaatcccagcactttgggaggccgaggcaagtggatcacctgaggtcaagagtcagagaccagcctgaccaacatagtgaaacctcttctctactaaaaatacaaaaattagctgggtgtggtggtgtgcacctgtaatcccagctactcaggaggctgaggcacgagagtcacttgagcctgggaagtagaggctgcagtaagccaagattgccccactgcactccagcctgggtgacagagcaagaccttgtgggggggggggggggggggaaaggcccccaacccaattttacaaaacaagctcaccttgcctcaccaaggtaaaatgccaggggacacaaacctccacctcaccctaaacattagagggaaaaacttgggaatcacacttttggaggaaagtgagggtcagtggtggggatcaatctctgaaagtcacccagcacagctcacactcaaacaggggtgtcctgactgggtgtggaaccagctctctgcctcctgagtctcagaatcctcagtgtgagcagacatatgcacacaccccagtgacaagagatagacctgagagtgcagctgcaggattcagaactctccagttccccagttagtgactcagatggctccagggatgtgacagaggaaggtggcatgagaatatgtgacctgaaggtaacaccagtgagcagggcttggcctgtacttaaacgcaatgaccagcctggagagtaggtctatgcacagttgaaaagaagtagggaggtcaaggcgggtggctcacgaggccaggagttcgagaccagcctggccaacatggcaaaaccctgtctctactaaaaatacaaaaattagctaggcgtggtggcaggcacctgtaatcccagctactcaggaggctgaggcagaagaatcgcttgaacccgggaggcggaggttgcagtgagccaagatcatgccattgcactccagcctgggtgacaggagcaagactccgtctcgaaaaagaaaagaaaagaaaataagtaggaaaaagccctttcttcaagacactgactgctacatactgcaacattttcccatgactgcagcatacagactagaatatctacgatgggaatggcaccctcccgcaagggccaggaccctggtatgtggacgtcctacacaaacgtacattgtggcctgatggtccctggggaatgtggtgtctgaagaagccctcttttgcaggtatcagccaccacgatgctgactctctgggccctggctgtcatgttggcggtcgaggaagcacttggccagctggagctcgcagataggccttccctaatacccactttgcctgtccgttttccacctggattgctccctggaagtctgtcagtctcaaaagtccctctaaccggaaaatacccagcgaggaccaaaggaggcaggtgtccacccgtcaccaagtacttcatatctgacagcaaactcgaagactgtaagtaagggctacacacccttggtcctttcagcccctcacgcaggcttctcattcctaagctcagcggggggttctgtcttctgaacatgtgggtcccgaacatgagggggtgttggactcaccttagaagcttgtgatagaacagttgcccaggcccccctagccattctggtccggcactactgcagtgggcctgagagtctggcttcctcatctgctccaagatggcactgaggctgcttgtccagggtccacacgtaggttaggggtggtctacacaaccctggaggagggaactctcccacccggcagactgattacctcccacctcacctggagactgtgcggagagactgcccatcccctccctgctgggccccagggctcacccagactcccacaggtgctgaaacctcaatccgctttaacaggagccaggaaatgggaaatctgggccccgccatcatccccttgaccagacttgttctctccaaactccttttgttcactcactccctgagtctcacctcctgcattagacaatgaggaattctttcctccaagaaccccgcagagggtgagggcagagcaactcaggaatttaaggctgggcaaagaagtgactcccactgaggagccagaaggagcagggatttattagcaaatgaaggccagcaggaaggctctcagtgctctgacgccagcctcgcagtcatggcccacctcagccatccaggatgagaggacagggccacacagggagacctggcacatgctgcatgaccaaagggccagccccacaactacaatgcggactgctttgactcgggaagaacatgtgctttgctcttccagcagccttccttggtacaaaatacttcaaatatatagaaaaaagaccagacatggtttaaaaaaaaaaaaaaaagacagctttgtacccatcacacagtgatttggaggtaatggtggttaattttggttgctttgttttgtttttgtttgtgtttgtgttgagacagggtcttgctctgttgcctaggctgcagtccagtggcacgaggccccttcactccatgcccaaatccctttagatgtactcaacagcaggctgatctcatagtagttactaataaatggtagctcttaataagggcacaggcaaatttctctgacaccaggctgtccttggagtaggcagtagcaagcactgttttttccaggaggcaccatatacagttcctatggacccctcaattcaaatgtgccagctgcctggcaggaaagcttcttcttgctgaaccaactgggaaggccacagcaagaatgtgtctcttgacccttttcagatatgaatgccaccttgcccctgcagattgagaagattctgaagtgtgagaaggttaacttggctggtttgcttgggaccgtattatccacagtgagcgacttggacctgctgtctctattagacctcacttcaccccttgatatacttggaggtgccagcctcagtggtatcctaggtgagggaagtggcggcaagtcctcgaaacttccattgctctcagaactcactggtgctgtcagtggtctgctaccccaggggacggagggtctggtgagcctactacccactggttcagacaagaaccctgtaaaaggactcctcggtggcactggtctctccactctccagcggcctctgaaggatgtgaccgacaaagtccaagacctcaaagagtctgctcagggcgtgctgaacagcaccctgccctcaggcatcagcgatgcactcccagacctgctgaaaaatgctgacctggaacagctcttgctggggtaagtgcttccttgaccctatgtatgacttctccaccagaaacctgctgatttggatgctcatgttcaacttccaacagtcccacggattgggatgggtatattgcttgagattgatatatttcaccagaaatattctcgctctatgctgtgcctatatcctttcagggggaaacaggatcaagatttttgagcttataggcctgggcacattagacagctgaggggtcaagggactggatggtggcttggtaggctgttaattatctgcttcaaaggcatttctcctgctgtccaggctgattcgttgaaacaggactgactcttgatgctttcgctttgcagattacaggttgaaaaagtaactgtggagagcatgaagtcaaccacgacaggcgatgggatccatgtccaagccacgactacggccttcataggtggaaaagggtgagtctgtgcacacagcagtccactgggtccccctgccccagggttgtaacatccagtgagcaaagaccaggtagagacaacagagaggacagcagcatgggtgaggatggggcaaagcgggcactgcacacagctgcccctctccccaagtacaggtgggcaaggcaagagaatggtccagggagcctcatcctccaataatgtgaacaaaaatgttgacgggctgggtgtggtggctcacgcctgtaatcccagcacttggggaggcctaggcgggcggattacgaggtcaggagatcgagcccatcctggataacacagtgaaaccccgtctctactaaaaatacaaaaaaatagctgggcgtggtggcgggcgcctgtagtcccagctactcgggaggctgaggcaggagaatggcgtgaacctgggaggcggaggttgcagtgagccgagatcacgccactgcactccagtctcggtgacagagcgagactccatctcaaaaaaaaaaaaaaaaagaaaatgacaggacccactcaccccacccaccccactaagccactagggaaggcaaaactaggtcatgaaaagtgctgaaagaggcaaggttttagactcagttagtttcacttacaggaatctgtccaaaaaacctaagtacagatacatttaaacacaaagacataggggtattcatgatgggaatttaaaaaacaaaaaacctgaaacaaaaagcaaataattaaaccaagtacaagattagaaatgctgacaacatttataatggtatacagaaatgcttgtgaagttgttttttttttgttttgtttttgagacaaggtctcactctgtcaccggggctggagtgcagaggcacaatcacagctcactgcagcctggatctcctaggttcaggtgatcctcccacctcagcctctcaagtagttgggaccacaggtgtgtgccaaggtgctcagctaacttctttttttttttttaattttttgtggagaccaggtcttgctatgttgctcaggctgctctcaaactcctgggctcaagcaatcctcctgcctgggcctcccaaagtgctgggattacaggtgtgagccaccacgcccagctattgttagttttattttattttattttgagatggagtctcattctgtcgcccaggctggagtgcagtggcgtgatcttggctcactgcaacctctgcctcctggattcaaatgatttttctgcctcagcctcccgagtagctgggactacaggtgcacaccaccacacctggctaatttctctgttgttgtagtaaagatggggtttctccatgttcatcaggctggtctcaaactcctgacctcaaatgatctgcatgcctcggcctcccaaagtgctgggattacacgtgtgcaccaccatgcccagctattgttggtttttaaactaacaatagcaaagtttactttgctgaaacttctaactttcctgctctgtggagtttgcatttcataagcagggggaaatgcatattaaccaatgaaggtcagaatatccatgaaaggaaattacagacaagatgggctttggaatgtgggaaggaatgagggcctgccaggctgacagcgcatgtacaggaaggtaaggaatgtgactgttggccaggcgaggtggctcacacctagaatcccagcactttgggaggccaaggtgagtgggtcgcttgaatccaggagttggaaaccagcctgagcaacatgacaaaatcctgtccctacaaaaaatccaaaaatcagccaggcatggtggcatgtgcctgtagtcctagctgctagggaggctgaggtggaaggatcacttggataggaggaggcagaggttgcagtgagccgagattgcaccgctgcactccagcctggcaacagagtgagactctgtctcaaaaaaaaaaaaaagtgacacagatacacacacacacacacacacacacaccttactggtagaaacacttaaacaagggccattcacctgaaaaataatgaatgtggcttctcctggaaagtcagagatctgggtgccctgagcctaactgcatggggtccacgggcagccggagctcagcagcagctcctccttcaccaggtgcctgccctcagggcactgcaaaccccaccatgcccacggtcccgcaccacagtggagttggggaggtcaacagccacgtgtcctcaggctcctcccacagcaataccttcaggaccacctcaccctccacctccccagtcagacctccaaaggcattgaaatgggtgtcggtctcatgtgattaccgagatgttttttctgctttttcactctaggctaaagcccactttaacaaaaataccgtcactgtgcctggaagttctctctcttcagacactaaaaatgtcagcgtttccctaattctgtcctacgcgatgctgaaggtcatcatcactcacactgccaagcagagctctgtgcaggtaagggtcgtccacagggcccggcgtggctcagcactttcctcaagctcagccggtcagcctctgacagcaagaaggtgggggtgaaagtggattctgaatgttctttcaggttaatacacgactgccatgggatgcaccttttcccttcattgtcatgtaaatgggtcctggtttatgttggtggaaagcagagaacagggacttggggagaaaaatgtggtctgaagccgggtgaggtggctcatgccagtaatccccacactttgggaggccgaggcaggcaaattgcttgagtccaggagttcaagaccagcgtggacaacatgttgtcaccttatctcagcaaaaaattagccaggcgtagtggtgcatgcctgtaagtcccagctacttgggaggctgaggcaggaggatcaccagagccagggaggttgaggctgcagtgagctgtgattgcatcactatattgcagcctgggtgacagagtgagactttgtctcagaaaaaaaaaagtgggggaggaggggttctaagtgccatctgtgtgctaggggcaaaaccaggtgtctttacataaccaacatcatttcatcctcaaaacagcactaggatgtagggtttcttatccccgttttacagatgacgagagtgagggaaggaagcaccaacagtcacagaatgagcaaaaaacataaggcagttgttcatttgctaccggccctagaagtggcagagggaatagtagcaatagtaacaatcataattgacttttctctatgtgccaggctctctttgaaacaaaatataattttttttaagagtgtgtcccaaagtgatcaaatgatcaagtgcagaactctcttcccacaaaggcatacagagagacaggcttcagattggacaaggtgtaatagaaaagtaagattttacatgttgcatgcccccaccatccttcaaagaaaggaaacattatcaaggtgaatgtttagaaataggccttgtctgtcatggtcacaccagctgcaccagcacccaggtgaccaacttacaccagacgataaatatttgtatgtatgatctgaatgatgcgagagtgtttcatactgcaacatcctgcagcccttactcaacacactctaaatgactacttctttccaacagagaaataacctggatgcaagaatcaccaaactaacctactcccaccggccagacataaaatctaagccagctactgggttaacatcaccaaggacggtgggagctttgtcaccgggcaaacggtgagtgctgagaaatgaatcagagcagagttgagaggaagaattgcaaggagcagtgtttagtgggtttagttactccctaaactctgaggctcagagtgtctgggtgtccctaggatgagggagtccagccaggctggtgggctcagcccccaaagggagaatggagtgagcaggttggcttaggaggataaggccaggcagacaaccctctgacctgggaccctgttggccatcgcgcactgtgacatgtttgctgagtagccaggccaaggtgttattgttaactcatgttcattttgtattaattcaggaattaatcatctcattcgtgagcaagatttcgaaagacaaactgatcacagacatcaaacttctgaggtactgtctgtaactacataatctgcctgtctatataagagatatctaaggtctgataaaaatcgcataaccggctgggtgcagtggctcacgcctgtaatcccagcactttgggaggccgaggtgggtggatcacaaggtcaggagttcgagaccatcctggccaacttggtgaaaccctgtctctactaaaaatacaaaaattagctgggtatgatggcaggtgcctataatcccaggaggctgaggcaggagaattacttgaacccgggaggcagagtttgcagtgagctgagatcatgccactgcactccagctctgggcaacagagcaagactctgtctctaaggaaaaaaaaaaaaaactacataagcaaaataatcacaaggttcttgggaagtatctgcaaaattacagagaaatcaggatggagttttgaactcacatgctgttgttcatcttacattgactctttctgctcagtagtttccaatttataagtgactttaaggagcaactgacatcctacttagctctacaatggagttgtattttcacctgaatctaatatttctctgtactttgtttcctgacagctctgaacacaatacaacaccccccaagtttcttatgttttcaatatatttattgatggtatgtgagaaaagattgtagtgccaggtgctcagtgccatacacactctggaaagaaaaggtcaggaatggccaggcatggtggctcacacctgtaattccaagactttgggaggacggggtggttggatcacctgaggtcaggaattcaaaactggcctggccaacatagtgaaaccccatctctataaaaatacaaaattagccaggcgtggtggcgcatgcctataatcccagctactcaggaggctgacgcaggagaatcgcttgaacccaggaggcggaggttgcggtgagccgagatcgatcgcaccattgcactccagcctgggcaacaaaagcaaaactccatctcaaaaaaaaaaagaaaagaaaaaatgtacacatcgattgtatgtaaattacacatacctcaataaagctgttaatagtgtgtatggtatacaatcatttgtataaaataatcacaaatataaatcattttatacacagagattatctctgaaaagatacattagaaaatgattaatgtgctggattttgtaaaagggaactaggggattagtaggcgggaaggtgattgattacagatacctactgtattgtttggattatttaccatatgtatgttttaccttttgtttgtttgttgtttttgagacagggtctcactctgtcacccagactggagtgcagtggtgcactctcagctcactgcagcctccacctcctgggttcaagccattctcctgcctcagcctcccgaatagctgggattacagagatgtgccaccacgcctggctaatttgtgcatttttagcagagacggggtttcgccatgttggtgaggctggtctcaaactccagacctcaagtcatccacccgccttgacctcccaaagtgctgggattacaggcgtgagccaccacacccggcctgttttacctttttataaaaattgaaataatttcaaaacctgctttaagtgccttctgaagaaaggactagggtaaggaaccatcacagataaatgttctcaatagaagacggaccctaagagtagaaaccaatccttgagcgctgaaccagcacctgaggaagaggttcctgttgtgcaggtaaatgaagaaggtctaaaggacatcatggccagacacacaataaaagccccagtatatcctaatatacacaatctgtttgagaagtaaaatcttttgatgatctctcccatttgataagaccttataatgttccatggactgtgctaaactctctagaagcatgattgtgtcactgaattccacgtgagatatgcatgtgattatcttcatgtttcacatcaaaaaaccaagccaggctgggcacaatggctcatgcctgtaatcccagcattttgggaggccgaggcaggcggatcacttgaagtcaggaaggagtttgagaccagcctggccaacacagtgaaactctttctctactaaaaataaaataaaaaattagctgggcgtggtggcaggcgcctgtaatcccagctacttgggaggctgaggcaggagagaatcgcttgaacccaggaggcagaggttgcagtgagccaagatcgtgccactgcactccagcctgggtgacagagcgaggctccacctcaaaaaaaaaaaaaaaaaaaaaaaaaaaacacacaagacagagaagaggagaagagtaaattaactactcaatttcagacaactctcaagcaataaagtggggatgtgaaccaaagtcctctgactccaaaaattccatgctaccatctcttggatatttttttcatgatacccacagaatgaaataaccttggtggtgaagggggctgagaaccactactcgaaacctactaataggtccaagggaaaagagacataatttttttaaagcctaaaaagtaatgacatctttttttttttttttttttgagactgagtttcgctcgtcgcccaggttggagtgcaatggcgcgatctcgactcactgcaacctccaccttttgggttcaagctattctcctgcctcagcctcccaaattgctgggattacaggcacccaccacgatgcccagctaattttttttgttatttttagtacagacagtgttttgccatgttggcaagactggtcttgaactcctgacctcaggtgatccacctgcctcggcctcccaaagtgctgggattacaggcgtgagccactgtgccccacctggtaatgacattttctaaaactccaagtgctgtcagacctcacaggctgaaaaagaggtccactggtggcaaaggccagggaggctttggagggcaaggaggcttccaaggaggcagaggaggaagaagagaccacagctacaggaaagaagatgaagtttgaaaagcttcttctatccttgtcttttcctcttccatttgaaaggactcgggtttttactctgtgcctgatccatcacagagccttctgaggacattccaagattgtctacagtcctgtggtccacttggaaattcagacagataatatttcaaggggatagttggttttgactgaatactcatgaaaacttttaaagaaatgagtgatagagctaacccatatctgtaagttttgatggtttttcttgttttttatttttttgagaaagggtcttgctctgtcacccaggctagggtgtggcggtgtaatcgcggctcactgcagcctctatctcctgggctcaagtgatcctcctgcctcagcctctcaagtagctgggactacaaggcctgcaccaccacacccagctaatttttttttttttcctgtaaagtcaggaaacctgccacattgctcaggttggtctccaactcctgggctcaagcaatccacgtgcctcagcctcccaaagtggtgggattactggtatgagccaccatccccagcttatgttttgaattaatagttgttttttttttttttttttttttttttgagacggagtcttgctctgtcccccaggctggagggcagtggcatgacctcagctcactgcagcctccacctcccaggttcagtgattctcctgcctcaccctcctgagtagctaggactacaggtgcctgccaccatgcccggctaacttttggatttttctttagcagagtcagggtttcaccatgttgaccaggctggtcttgatctcctgagctcaagtgatccacccgcctcaggctcccaaagtgctgggattataggtgtgagccaccgcgcccagacaatattgtttcatctcatgtaagaaaacatttttttccaacaaataatttttttatgttgggggttgtaaaggaaagcagagtgttttatcaacttttttgcttgagtggctttagaacaatttaaaagtcaactttggtgccagataaaaagaggtccatgagggaaatcctcaggtaaaacatgcaaaataaagtgcagcgataggcagctaagtcagtggcatccaatgcaaatgtcagaaaggtcgagagcagttttcccaagcaaatggttctccccaccttcctctccttcagtctctgcctcctagggcccaggggagaaaacctgagagggagcagtgtccacaggagaaactgggtggggaaacacttaacacagactgcagggaaaactccagaaacactaaccaaggtaaaaacgaagtcaaagtgagagacaaagggttaaccttagtttaggtaaatttaatgactgtaaaagctgttcacatagcagctttaaagagacacgttttccactgacataaagttgcttcgccccttgcagcttatctccaccttcatgacctgtttcctcagtggcaggcaatgtctccccttcctgttggggaggattgcccaagtcagctctgaggccatcctctcaggtcagcaatatgcagaagagtccctcagagtggtcctgcagagaacatgtcccctaagtgtctgagaactggctgaggtgatctgaaagaaaaccaggcagaagaaggcaaaataactaggactgtagcactgggacttcatgtggagcctctagaggagaagcccccaaaaggaatctgatggaggcgaccggctggcagagaccacatggctcctgtgtgcccccgatcctggcaggaagcgaggtctcatggaatggcaatggatataatttaagaagtcaaagcaggtcagtcccagccacttctcccttttctcttggaagatggctcctcctcagctctaaccataaaattcaggtgaaactgcccatcacaggccctgccctcctaactccaaggctgatccagtcaaatccttccttaggatatttacagccaacatttggtgagaaatgttctctctcctccaattgagagctaaaagaatgtgaccccaaagttatctgtggtcacatgtcttatcataagagcaagtcagtccattagtaaatccttactaagtacatattttgtacccggaattgccctaggtgctagaagataaacaaagataaacaaacagaaacaaaacaggcattttccctgcccttaaaggaacttctgtggatgctctagggcatcagtctgtgtcctgccagcttctggttctgaggcgaagcagatatgagaacaagacagggaaggtggcagtagcagaactgggcagtgtgagaagagaaggcagaagaaaggaagaaatggaaggagacaataagagaagcatatcgccagtgaaagggagaaagaaagagagaaagaaagggagagaaaatcccacagccatatagctgatctgtgagtccagggaagagacccaagaaactcgagcacatgtaagttaaagaggcctgagccgtcagagatcacaaagaaaatgttgatctccaacagggaacactctctactcactcgaaatcactccacctcctggcctctctgcagcgagaaactacatgccactgcatactccaaactcaccaaattcccacaaagaacgcttccagggcaggagaataggtaagaagaataagaaggcattagtaaggagcagtctaaaatccaatccaaagtgcccttccattgtactggttgagaggggatttttattttactaaaatgtgtctctaggaaaaaactttattaccacaaatatccaaaccaacactcatttcacagtgcaagccaaaagcccaaaaggactcctcaccttcaccagcacatagtccccaggctgggctctgaccctgagcccagggttattgacatcctccatctctgcatcagggaagatcaccttaaggtttccatcattcctgccacacaggtcagtggcagagcgtttactgagctgcagaaagaagagagaagagttcgtggatttgtcacagttgtaagttcttggagggtagaaactgtgccttctctgtctcggatccccaagagtctgacccacagagcattccttaaccaaggaatcactgaagactcagtgtttgctgctgcttcaccagcaagggcagtgtatggcccacaacagaaacactgtaaagttttgctaactatattataatgaatcaattaatcaataagtctgtgcagaactgccttctgcaggaatggacctccaacaggcctaaagccagagacttatgagcgatgcatttggaaaaccaactttcacttcacccagtctcatactagtcacttatgaatgaatgttctgggattgtttggcctgcattacttgccctcactgaatagacagactgaaaggcagaatctccaacacaacacacagaagacagagccaggaagatactaacatcactatgatgggattaacttctagagtctacggaaacccttctcttccagccatggtaaagagacagaaacaagtttacccttcagccttataaataataaccagcaaattgggtaaaatatatgaaacaactgttttcggatactggacaagagatcatacaagactgtgagctgtgagagaaggaaaacaaagtgagccccccaatcacccctgctttctgccagaaggtacatgccagacgggagcctgtgaagcaggaggggagagctcaagcacagcacagtggtcctcccctgcactgaagagagagggatcaatgttcagggagactgaaatagttagaaactgtgaagcaaattctagagagaagggagcaaagcggaaaaagaatttcagaaatatgcagggggtccttatgagtcttcactgaacactaacacttgcatgtgtagcataaaactccatgaagtcaggcaaagagagtaacctgggaactgtccactgaacagttcccagaactcacatgtggcctggaatccactaccaaatagaagagtttatggatttgtcacagtcataagttcttggagggtggaaattgtgctcatcggttccttgggatatattcactagcaattcctgacagaaggccacatcttagtagtgaaactaaactatccagagaataaaaaagtttttctggccaggcgcagtggctcacgcctgttaattccagcactttgggaggctgaggcgagtgaattacctgaggtcaggagtttgagaccaacctggacaacatggcgaaaccccgtctctactgaaaacacaaaaattagccgggtgtggtggcgcacatctgtagtcccagtgactcgggagactgaggcaggagaatcgcttaaacctgggaggcagaggttgcagtgagccgagatcacgccactgcactccagtgtgggcaacagagtgagcctcagtctcaaaaaaaaaaaaaaaaaaaaggaaggaagggagagagggagggaacaatctctgtgacctctgggacaatatcaagtggtgggacatatgtgtaattcaagtacggaagtggtggaggtgggtggaagaggaagcggagcaaaaaaatctgaagagtaacaggtgaaatttttccagatttgatgaaaactataaccccagaaactaaaaagcctcaaaaaaatcccaaagaaaacacaaaggggtaaacacaaagaaaaccacccccagccacatcaaattcctaaaaacagtgataaagcaaaatcttaaaagcagccaaagaaaatggcatagagtaaagaagaatgaccacaaacctgtcagaatcacgtatgtcagaagtcaacagaatgatatctccaaaatgtcaacctaaaagtcaacactcggtgaaaatatatttttaaaaggaaggtgaaataaagatcttttcagacaaacagaagctgagcagcatcactgccaaaagacctgcattacaagcaatgttaaaggaagcctttcaagcacaaacaaaacgatgcccagtggaaacgtgaacgtacacaagggatgaagaatgccagaaatagtaaatcagtgggtaaatacagactttctctcattttttaaagttcctttaaaagataattgtttaaagcaaaaataacaatgatttagggatacaaaagtaaaactctgtaaaaatagtacaaaaggaggaggaagggacagaagtatatcattacaagaatcttacattatatacactgagtgagtggtacccagtttggggttaaaataatgggccaaagagaatccaaagggcacataatctgccattagaaaatcaagctctgacaacatgctatattcttaagtaatcaaagacacagaaaggagttcagtctttaaatgaataccactttagggaaacaaccttcagctgagatttagaggctctactattccctacaaaatacttactagttacaaaaggaaaaagagtaactttacagtcaagaaggctggcagacagtatcttccatgttttcaaagttagcatcatcagtaatgagacaaatcaaaattgtatgccacctcacaggatatgattagaatacaacatcatctctctggtattcctgccaaagaatgcataacctgaatcttatcatgaaaatacatcaaattatggacattctacaaaataactggcctgtaatctttaagtgtcaaggtcatggaagtcaaagaaataatgacgaaccatcctagactaaaggagactagagagacatgacagttaaatgcaacatatgatactaaaccaaatccttttcctataaaggacagttcgaagacaactggaggaaacttacatggggtctcaggattagatggtagtaatctaacaaggttaatttcctgattttcatagttgtactacagttatctaggagaatgtccctgtttgtacaagatacacattacagtatttgggggtttggggacatcagggcagcaacttactctgaaatgattcaaggggaaaaaaagttctttataatacacttggaacttctctatgggtttgcagttgttttacagtaattttttttttaaaaaaagagagttcaggccactgcagtggctcatgcctgtaatcccagaactttgggaggctgaggtaggaggattgcatgaggcaaggagtctgagaccaacctgggcaacagagcaaaaccccatctctacaaaaaatttgaaacattagccaggcgtggttgtacacattatagtaccagctactccggaggctgaagcaggagggtcgcgtgagcccaaggagttcaaggttacagtgagctatcattacaccaccacactccagccagggagacagaacgagagactttgtctcaaaaaatataaaaaataaataataaaatcaattaaattgagatttcaggttccatgatttgaaaaaaaccaagtgtaaaagaacattcatgagacaaacagggaaattagaacactgagcaaatatttggtaatattaagaaaattagaagtgctttggaaatctaaaaagaatattaagacatttttgtcaattattgtcaggtatgataatagcattttgtttataatttttttaaagtccttatcttctagacatatatactgaaatatttactgaagaaatagcttttttttttttttttttgagatggagtctcgctgtgtgacccaggctggagtgcagtggcgcaatcttggctcactgcaacctctgcctcccaggttcaagcaattctctgcctcagcctcccaaagtcactgggattacaggtgcctgccaccacacttggctaatttttgtatttttagtagagacggggtttcaccatcttggccaggctggtcctgaactcctgacctcatgatccacctgcctcagcctcccaaagtgatgggattacagacgtgagccaccgcgcctggcccgaagaagtatcttatacttgctttaaaatcacccaccaggagcagtggaaatgaaacaagattagtcaagtattgacaactattttttggctttttttttgtttgagacggagtttcacttttgttgcccaggctagagtacaatggcgcgatctcggctcaccataacctccgcctcccaggttcaagccattctcttgcctcagcctcccgagtaactgggattacaggcatgtgccaccaagcccagctaattttgtatttttagtagagacggggtttctccatgttggtcaggctggtctccaactcccgacctcaggtgatccacccgcctcggccttccaaagtggtgggattccaggcatgagccaccgtgaccagcctctttttttttttttttgatacagactctagctgtgtattttttttgatacagactccaggctggagtaaggtggcacaatctcatcttactgcaccctcgacctcctggattcaagcaatcttctcacatcagcttcccaagtagctgtgactacaggtgtgcaccaccacacctgactaatttttattttttatttaatttgtagagattaggtttcaccatgttgcctaagctggttttgaactcctgggctcacgcaatcctccagccttggccttccaaagtgctaggatcacaggcttgagccaccatgcccagcagtattgacatttgttgaggctggttaataggtatgccagcattcattatactattctctatatgttttttgttgttgtttatttgggtttttttgaaacagagtctcactctgttgcccaggctggagtgcaatggcccgatctcagctcactgcaacctccgcctcccaggttcaagcaattctcccacctcagcctcctgagtagctgggactacaggtgtgcaccaccatacccaactaatttttgtatttttagtagagacggtgattcaccatgttggccagactggtctcgaactcctgacctcaagtgatctacccgcctcggccccccaaagtgctgggattacaggcacaagccactgcgcccagcctctatgtttaaaattctctataatgtaaaaaaaaaaaaaaaaaaaaaaaaaaagggcagggtgattacagactctggagagagagctgtatctaattctgactctgccacacactagctgtgtaaccttagggaagttatgctctgtctctgagctcagtaccctcatgcacaaaagggagctagtaacagcacctttctccaaggacagtggtggcactctgtgctgatggccataaagtgcgcagttcctggcagacggtaaatgctgagggatgtgagccattatcatcttttctgccactctggacatagcaacttggtgttttaaactggccatgtctggaggaaagaaagtctcctctaagagaaagcaatgactccaactgctagccttgaaaaacccatttattctctagccccaagtaagtaatggctatgttggatgaataagaaagagctttgtggtcgagagctgtggctcacacctgtaatcccagctctttgggaggccaaggtgggtggaacacctgaggtcaggagtttgagaccagcctggacaacatggtgaaatcctgtctctactaaaaatacaaaaattagctgggtgtggtagtgggtgcctgcaatcccagctactctggaggctgaggcaggagaattgcttgagcctgggagacagaggttgcagtaagccaagatcatgccactgcactccagcctaagtgaaagagtgagactccatctcaaaaaaaaaaaaaaaaaaaaaggccgggcacggtggctcatgcccgtaatcctagcactttgggaggctgaggtgggtggataactttgagaccagcctggccaacatgatgaaaccccgtctctactaaaaaaaatacaaaaattagccaggcatggtgacacacacctgtaatcccagctactcgggaggcagaggcaagagaatcgcttgaacctgggaagcagaggttgcagtgggccgagactgtgccactgcactccagcctggtcaaaagagcgagactccgtctcaaaaaaagaaaagaaatacttaggtgtaaatctaacaaaacatggacaaaatctgtatactgaaaactacaaaaactttgatttaaaacatcagcctgtagtcccacctacttgggaggctgaggcaggagaatcacttgagcccagcagtttgagtccagcctaggcaacataatgaggaaaaaaatcaaagatctaatgttctgaaacataaaaaacaacataacacacacacatatggcctcaccccttccactagcaccaactgggtacagcccacagaggtctgattggcttttgttgcttcttctcggaagatagtgatgagttcctccaaacgccttaattttacctcttccgggacatcatccttcagcctatgatatgcccgtgtcttctattaaaaaaaaaaaaaagagagaagatggaggtcaccaaggacttgtagaatctattcttaatgcacagagggcgaccatgttcattctacctacaagtaacagacacatgtacagaaacccaagccagaggcaagaggtttctctggctctgggagcattccaagataaaaaggtagtggagtcatatttttgcaagggttaaattctaaatttagcacatgaaaatcatagactcaaaattactcttgatatttatcctaacgttacacttgtacatataccaaatgactcacatatactaggttactcagcagtactatttatgaagacataagatgcaatgcagcctaaatatttcaataggcaagtagtcacagaaattatggtttatctatacaatggaatattgtgcggctgttaaacagaatgatagttctatatgtactaatgtggattgttctccaaaatctactgttacttgaaataagcaaagtgcagatcaacacatgtaactttagtgtagacagaatacatacaggcatgcttataaacacacgaaatatgcccagaaagttacaaaagaaattgctaagtggttgccttcagggaaggaactaaaaaaactaggcaacctgggaagaaggaagaaccactcatgtacagcacttaaccttttgaattttattcaagcatgtattacctagtccaaaagaaaaaagggaatttatccttaaaacacctttaaatcatccaaaaccacagtgtgtattatatctttatgacatgagctcatgctcagtacagctggagaaccactgagctagacaaaaatatggaataaaaggaatatctatataccaaagtttggacattcaaaccaatctaccttgaagagaagtatccacggaggaaaacggagaatcctaaaaatattgcagagtttactccattctgtcttactactaacaacaataacttacctctgttgtgcatttactatgcatgaaacacaattataactgctttaaacatattatcttacttaatccccagaacaaccctatgaggttggtaccaatgttggaaaccaagacatttgcccaatgtcacgtagttattaagcagcagaggcacaatttgagtgcttgctctcatccactaggttcttgattaagttcctataaccttaacccttaggaattaggtcccaaagtgaacattcatattcactgaccataagatgcttctgccacaagctgaaaacccatttcccatccctaggatttttttttcttttttgagacagggtctcattctgttgccaaaccggagtgcagtggcacaatcttggatcaccacagtttcaacctcccaggctcaagtgatcctccgacttcagcctcccaaatagctgggatcacaggcatgtgccaccactctcggctaatttttttttttttttttttttttttttttggtagagaagggtctccctatgttacccaggttggtctcaaactcctgggcttaagtggtcctcccacctctaccaatcctagtattaaaaagaatttctcaggccgggcacagtggctcatgcctgtaatcccagcactttgggaggccaaggtggtggatcacctgaggtcaggagtttgagacccacctgaccaacatggagaaaccccatctctactaaaaatacaaaattagccaggcgtggtggcacatgcctataatcccagctactcgggaggctgaggcaggagaaaaacttgaacccggaaggtggaggttgtggtgagctgagatcgtgccattgcacttcagcctgggcaacaagagcgagactccgtctcaaaaaataaaaaaaaagaatttctcttgggaggctgaggtgggtggatcacaaggtcgagagatcaagaccatcctggccaacatggtaaaaccctgtctctactaaaaaatacaaaaattagccaggtgtggtggcacgcaccagtaatcccagctactcgggaggctgaggcaggaggattgcttgaacctggaaggtggaggttgctgtgagccaagatcatgccactgccctccagcctggtgacagagcgagactctgtctcaaaaaaaaaaagaatttctctggcatatttgtgatgtccatggaaaagaagcaaaatagaaggggccaggcacagtggctcacacctgtaatcccagcactttgggaggccgaggcgggcagatcacgaggtcaggagattgagaccatcctggctaatgcggtgaaaccccgtctctactaaaaatacaaaaaattagccgggcatggtggcgggtgcctgtagtcccagctactcgggaggctgaggcaggagaatggcatgaacccgggaggcagagcttgcagtgagtcgagattgcgcaactgcactccagcctgggcaacagagcgagactgagactccgcctcaaaaaaaaaaagaagcaaaacagaaactaacagctcctctgaagcttcatctctccaaaacactaaaagatacatgaatatgatacatacattggcacagttacgctgcccacagaacactacgcagtggctttaaaatgaattagttgaggtgtcatgactcacgcctgtcatctcagcactttgagagagcgtggtgaaaggactgcctgagccaggagtttgagaccaacctggacagcatagaaagatactgcctcttaaaaaaacaaaaaaattagtttggttgatggcagctcagtaacaatgacaataaagtcatgggttcagtcgtttgtcagccagcttttctgagccccctggccacagggggccttcaacctcctgcccaaacacaagcacattgccacaaaggtgactgagggaatgaggagtgaaccgtgcaaatccatgcctacaatcaagaaaatgacagccaaccaggactatccttctcttcaggaaaagtgcactaatctctccttctttcctaatctccttctgctttgcctgggaatctgctttgtttcctgggaagcctccaagtgagttcacttgcctaggaaaacagaagttaggaatcactgaggatggctgggaagatgaccaggggccccggtaaaataaatcacatctgcagaccaaaaaggagttctgcatgttaagaaacaattttaggtttctcgtaaagaaaaggttttctccttccatattcaaattgcaaacaatctaaacataattttaaaatattttaatgaggaatactggcacagtaatcatgtatcatcaaattgctgaaccgtttcagagtagacagagtgtactagaaaaatgaacggaagtgaatcgtaagagcctgtggtttctcaaggactgccttgccgccactctcttttctgccctgttctctacagtcaccacccccaaactggtcaggaatgatgtcagtcctccccaaccccagggctcacctgtctcatgctgtaggcaaagaggaagcccatgttgtactgaacttcccggagcaaagagactgtctggacgtgatcttcctccgtctcaccacaaaagccagcaatgaaatcgctgctgaggctcacacctgtgatacacagcaaaggatgacaggtgactgcctgctgtttaccttcaagggaggccttcagcatatgtggattacaagggagggatagcaactgtaaggtcctccctaggactattcataagtaaaacaaaatagtacagagtaaggcgggataggcctgttcacccacagcattccatgacagagatcagcttcttggcctacatttcccctaagcactagaaaaggtatttccacttccaatgctgcatttagggacacagtagggagtccacattttcatatcagtcctcttaccagtgaaaaccttgtggtgcttcatacaaaaatatatttctgaatttggtttgatacaatggtcatctaagacagtagcagccgttgcatgcggtagctcacccctgtaatcccagcactttgagaggccaaggtgggcggatcacttgaggtcaggagttcgagaccagcctggccaataggcaaaatcccatctctacaaaaaatacaaaaattgaccaggcagggtggtattcaagtgtagtcccagctactcaggaggctgaggtgggaggatcacctgagcccagggaggtcaaggctgcagtgaactgtgttcatgccactgcattccagcctgggcgacagaatgataacctatcccccaccaaaaaaattattccagtgacccagtgaggtgagtactattaactccattttacagatgagaaagctgcatcccacagaaatgaagtctcttatctgctatcacacagcctgtaacagtggagcttgacccatagccacatacctagcctctgcattaccctgccctatcaaaacgaaagtatttgtccataaaagttaaaataattaggccaggtgcagtggctcatgcctgtaatcccaccactttggcaggctgaggcgggcagatcacttgaggtcaggagttcgggaccagcctggacaacatggtgaaaccctatctctaccaaaaaatacaaaaattagctgggcatggtggcctgtagtcctggctacttgggaggctgaggcacaagaatcgcttgaacctggcaggcagaagctgcagtgagccgagattgcgccactgcactctatcctgggcaatagagcaagattctgtctcaaaaaaaaagttgtaataattagaaatttgaggaaaaatgtatacaccctcaaccaaatctaaactaaatgactacagagtattttattaggaggaaggggacagtgaaggggaatatggaataagataatacgaaaggaattatctctaaaatttacagtaataagttgccataaagctagttagaaaaagtacacattttactgctgatctgtacaatcatctttatacctacatttcctcatttcatcaagacttctctgaagcatatctgaaaataaacaacactgtaactgctttcttttcccacctaacctggaagttccccaaaggcataatctaagtgttattctctccatattatgcttaaagtattctaactcaaaagtgattttaaaatgtatctgtaaaatcggcctcaaaaagaaagtcaaatgtggtataaaatatagaaaatgaagatgaataaataagaatagtaagttcttatttctaaaaaaaaaaaaaaaagatatcaattgttctcaaatcagaactaatttagacataactttgtcaccttacaagataagataaggtctttcctctatgtccagatacaaagaccatagaaaaggaatctctatagccttgaggccacaaggtgatccacacctaagtacttccagcaggactaagacaacaaaaaatcagaaagacataaaagaaagaatacgaggagagagaaagagaaagaagaagagcacaaaagttatgaaactgtgtcacaaggaaatgccaaaggtgttgactgtatctaaccacaaggctggtcactggtagagtaacatgctcagcagaatgagtttcttaaatgtacctggaatagattctctaatatggtgaactaactccacataagcttctcttgaatatctgcaataaagaacaaaaggaaaaggcctacataaatccaacctttttaaatgaatgctataaaaagataacactatgaatttccacatgtaatcacttctcatccacatggcagggcacacgagtaaattaaagtatccaaaagagcccttttgatctaagctgtatcttctaatctaatctagagcctatgaatttttatttaaggacataaactttttttttttttttttgagacagagtctcgctctgtctctcaggctggagtgcaatggcacaatctcggttcactgcaactcaaattcctgggctcaagtgatccttccacctcagcctcttgagtagctgggaccacagatgtgcgccaccacacccagctagtgtgtgtgtgtgtctgtgtgtctgtatgtgtgtgtgtatgtgtgtagagactgggtttcgccatgttgcccgtgtgtgtgtgtgtgtgtgtgtgtgtctgtgtgtgtagggactgggtttcaccatgttgcccaggtgtgtgcatgtgtgtgtgtgtgtgtgtgtagggactgggtttcaccatgttgcccaggtgtgtgtttgtgtgtgtagagactgggtttcgccatgttgcccaggtgtgtgtgtgtgtaaagactgggtttccccatgttgcacaagctggtctattctcaaactactgagctcaggcaatctgcccaccacagtctcccaaagtgcttggattacaggcagaagccacagtgcctggccagcataaactattctaaatagctttttttatttaactaataaatctagacagattaaacattttagaggacctctaaaatactatgccctgtggaaaacaagacaaagcactaattccatacagcttgccttgggacagattctcccttcagtctcatctgtgtaatacttattattctcaaagaaagtgaacacatagagcgacatttaaattccaagatgtaacaaaaccttaatgttaacattaaaaaattaaaatctcagagtgtgccacaccataggtgcttaattaaaaaaaaacatactaaacagtgaaaatggatgacccagtccttagcctatgttatggagttagcgaagcaagctccagtgccctgtggcttagtcatacaataaatacttactgtcacacagtggctgctcagtaaatatttatgctttttaaactaaacagtgaaaatgggtgaccagtccttagcctttgcttatgaagtgagcagaagcaaactccagtgcccagtggcttagtcatacaataaatatttactgagcagctactttgtgccacacactatgctaggttcttggcaacaaggacactgtttggtcattaaggaaacatggaaaagtgagggatgccccctctccaagcaagcctgaccccctccgcatggcctccaacacacggctgcttccactctgggctggcaggtggatctgtttacagatgttatctctctcatgaatcagctgcagaacctgatgaaacagaacacattataggtaatcacaatctcaccaaagaaccttacagaaagcaataccgctcttactatgtatcctccaaggtcaattttcacataattaagaggctaattaaaccagacacacaaaatcacctattccctaacttttgttcaagccccattctatttgtctcagacacttcacctgatggcatctctgctttcaaagagtagagagaagaaagtaagcagaggtcagattaaagccatgggagctgaatacaggtagtgctgacactagggtcagcaggcaaagcaggaaaaaaatggcacttctttcagctagcttacaaagcagtcactttctattttttttttttttgagacagagtatcactccattgcccaggctggagtacagtggtgccatctccactcactgcaacctctgtctcctgggttcaagcgattctcctgcctcagcctccccagtagcagggattacaggcacaaaccaccacacctggctaacttttgtatttttagtagagatgatgttgcccaggctggactagaaatactgacctcaagtgatccgcctgcctcagcctcccaaagtgctgggattacaggcgtgagccaccacgcccagcccaaactagtcatttttaaagataccatcaggtcaggtgtcatggctcacctctgtaatcccagcactttgggaggccaaggcaggaggattgcttgaggccaagacttcaagaccagcctggacaacatagtgagaccttgggtctattttttttaatttttaaaagaagaaaaaagaaaaaaaaagataccatcaaaaaactgatactaggggaaaatatttgaaaacatattgacaaaggatttgaaccaagaatacataaagaggctgggcgcagtggctcatgcttgtaatcccagcactttgggaggctgaggtgggcaaatcatttgaggtcagcagttcgagaccagcttggccaacatggtaaaaccccgtctctactaaaaatacaaaaattagctggacatggtggtgtgcacctgtaatcccagctactcaggaggttgaggcaggagaatcacttgaacccgggaggcagaggttgcagtgaggccagatcacaccactgcgctctagcctgggtgacagagcgagactccatctcaaaaaaaaaaaaaaaagaaaaagaaaagaaaagaaaacataaagagaacacattccagtctctctcctccattgcaagaaaggctcctttgcagtggtcaaaaaaataaaggatatgtaaagaacttttacaactcaataagaagacaatccagaggaaaaaagatgaaagtcggggccaaaagaaagacttttcactgaaacaaaaaacctccaaaaaaaggtttcagatgtgggctacctactccatgccaggcactgtgctaagtacctttgacacaatataggcatacctcagagatatcacaggtttggttccagatcaccacaatgaagagaatattgcaataaagtgagtgacacaaattttttggtttcccagtgcaaataaaagttatatttactctatactgcagtctattaagtgaaagcaatgtacataccttaatttcattatatttatattttttaaatatatcgagatagggtttcactctatcaccctcgctagagtgcaatgaaactgtagctcaccccaaccttgaactgctaggccaagcgatcctcctgttccagcgtcccaagtaactacgactacaggcatgtgccaccatgcccagctaatttttttatttaaaaattatagggccgggcacagtggctcacgcctgtaatcccagcactttaggaggccaagatgggtggatcatgaagtcaagagttcgagaccagcctggccaacatctctactaagtctctgctaagaatacaaaaattagccaggcatggtggtgcatgcctgtagtcccagctacttgggaggcaaggcaggagaactgcttgaacctgggaggcagaggttgcagtgagctgagatcgcaccaccgcactccagcctgggtgacagagcaagactcagtctcgaaaaaaaataaaaataaaaataaaaaataaaaactataaagttgttatgctgcctgggctggtgtccaacttgtaggctcaagtgattctcctgcctcaacctcccaaagtgttgggattacagggatgagccaccactgaatattttaagctcactgttgagacctactgcttaggaaaaaagattcctttctaaatatgactgctcattgacaacgcacctggtcatcccagagctctgaaagagatgtacaaggagattattagtgtcgtttttatgcctgctaacacaatatccattttgcagcccatggatcaaggagtaatttcaactttcaagccctattattttaatttttagtttatataagatcaattcttattatttaagaaatatatttcataaagctatagctgtcgtagatagtgacttttgtgatggatctgggcagagtaaactgaaaacattccggaaagaattcatcattctagataccattaagaacattaatgattcatgggaagaggtcgaaatgtcaacattaataggagtttggaagatactgatttcaacattcatggatgattttgaggggctcacgacttcagtggaggaagtaacatcctctttagcatcattcttaagggccctaggattttcagaatggcaaatcaacactggcttcaacttaaagtcaccagctgccttggcccctaacaagagagtctggctgggcacagtagctcccgcctgtgatcccagcactttgagaggcctaggtgggagaactgcttgaggtcaggtgttcaagaccagcctgggcaatacggcaagaccccacctctaatttttttaaaaggaaacaagagacagagtcagcctgtcctttgaagctttgaagaatggcactgatttctcttctctagctatgaaagtcccagatgacatcttcttccaacagaagactgttcatttacactgcaaatctgttgtttagtagaaccaccttcagcattgatcttagctagatcttctggataacttgcacagcttctacatcagcactatggcttccccttgcactttgatgttagagagatggcttctttcctcaaaccttgtaagtcaacctctgctagcttcaaacttttcttcttcagcttcctcacctctcttgggcttcagagaactgaagaggggccttgctctggattaggctttggcttaaggaagtgctgcggcttctttgatcttctctccagatcactaaagctttctccatatcagcaaaaaggctgggttttgttgttagtggtttttttgggttttcttgtttttctttttgagatggagtctcactctattgcccaggctggaatgcagtggcacaatctcagctcactgcaacctctgcctcccgggttcaagcaattctcctgcctcagcctcccaagcagctaggattacaggtctgcacaaccaaacccagctaatttttctatttttagtagagacagagttttgccatgttggccaggctgatctagaactcctgacctcaggtgatccacccaccttggcctcccaaaatgctgggattaaaggtgtgagtcactgcgcccagcctgtgagccatcacacccggccaaagaggttgtgttgttttcttatcattcatgtgttcagtggagtagtacttttaatttccttcatgaacttttcctttgcatttacaacttggctggttgacataagaggcctagctttcagcctagctcggctttcaacatgatttcctcagtaagcttaaacatttctggcttttgatttcaagtgagagccctgcgacccttcccttcacttgagcactttagaggccattgtagggtgattaaatggcccaatttcaatattgttgtgtctcagagaatagggaggcctgaggaaagggagagagatgggggaatggccgtctgtggaacagtcagaacacacacatcatttaccaatttaggtcactttcttatgtgggtgtggctcatggtgttccgaaacaattttaagaataacattaaatagcactgatcacagatcaccataacagatgtaataataatgaagtttgaaatattgtgaaaattaccaaaatatgacacagagacatgaagtaagcacatgctgttggaaaaatggtgctgacagacttattcagagttgccacaaaccttccatttgttaaaaataactccataatatctgcagagtgcaataaaacaaggtatgcctttgtatctatttcacaacaacccaaagcaggaggtaattgttaaccccttattaaccccattttacagataaagatgaaaagttgaaaacatcacatgctcgctggtaaaacagtggaaaagctgagatttgaacccgggtctgaggcgaaagtctgggctgtttcccagagcaccacatcacctccttcctgtccaccccacaccaccattaccgccccaccaccattattaccactcagctgcccactttgtaacaaatcctctctgtacagccctcacggtcccgcaggtggtcttaacctcccgctgaatatcagtcctacctccactcccaccttggcagacttttttttcgagacagggtctcgctatctcacccaggatggagtgcagtggtgcgatctcggctcactgcagcctcgacttcctgggctcatgtgattctcccacctcagtctcccaagtagctggaactacagtcgtatgccacctcagtctcccaagtagccagaactacagtcgtatcccaccccacccagctaattttttgtatttgcagtagagacggggtttcgccatgttgcccaggctggtttccaactcctgagctcaagtaatccacctgcctcagcgtctccaagtgttgagattattggtgtaagccccgtgcccagccactggtggacttcaaatcttcaaaggaccagcagatctggagggtgatgcagcaataccccacaggatccctaagcaggactccaggtctctgctgcatccctactgggtccagcctttggcatgctcaagaatactaatatcagtttgtcacagctaacctgacgctcacctcatcaggaaaatccttggggtggggagaggtaaaacggatcctcatttcaggatctactctggagacctgatccagaagatgagcaaaacgaagtcctccttgcttggttttatagttggtggtaaagccacgactgagattggtaggcactgcactgttgaactggacctccgaattgtcccgaaaactattaacattctgaccaagaagtgtcacttctttcagcccctaaacatgggaaaatatattggaattttaaaacttttgggtagcttcataaaaaaacactaattaaaaattagctgaaattaacatatcttttgttttaaacaaaagaaaaatcgaacctaccaagagtcacctataagtgtgttgtgtctataaccgaataatttcaagcttagacatcttacctaaagagctaaacctaataaagccttatataaaaattaatcttcaaaacattatttagaatcaaaactggaaacaaactcaataatccacaataatggttaatttatgatagatctgtcatttgaatgttatacaccatgactatataaagtattctcaccagaaatatttaacctgaactaatcaagcttttacacctaacttccagttactagaattcacagagatatattaaatgacaacatgaggaaaaaatcagacaaaggagactcatgtctgatctcttcaaaaagttaatgcatcatttaaagaaaacaacaacaacaaaaaataaaagagctgttttagatttttttcttcttcttcttgagacagggtctccctctgttgcccaggctggagtgcagcagcacgatcatagctcactgtagcctcaacctcccaggcttaagcagtcctcctgcctcagcctcccaagtagctgggactacctttttttacttttgtagagatgggatttcaccatgttgcacagactggttttaaactcctaaactcaagcaatcctcccacctcagcctcccaaagtgtctggcttaaataactattgattttcatacatatgataatgatatcatggttatgaagagaaaaattgttactcatagaagatacatactgaagtatctaggggcaagtgtcctgaggtctacaaattacttcaaatggttcagaaaaaatacatttatgggtgcatggagataggtgtatgacaaaatgttaacaatcacgtttttctattatactagtctttctatttgtctgtttgaaaatttatattataggccaggtgcagtggctccctcctgaaatcccagtactttgggaggccaaggtgggcggatcacacggtcaggagttcagaccagcctggctaacatggtgaaatcccttctctactaaaaatacaaaaaattagctgggcgtggtggcaggcacctaatcccagctactaaggagggtgaggcaggagaatcgcttgaacccaggaggcagaggctgcagtgagccgagaccatgccactgcactccagcctgggcaacagagcgagactccatctcaaaaaatagaaatgttatattataaagtttcacaaataatggttgctaaaaaagacttgttttgtaactttgacataatttacagacaaactgcaatattaaaagaattcccatatactctttgcccaaattcatcaaatgttaacactgcaccccatttgtttatcattcacattcagacactcatatacactctctctcaacacacatatgactacattttttttaagccttctgagaaaaagtcacagatatcatactcttttacttccaaatattttagtatatatttcttaaaaacaagggcattctcctatataatttcaggacaattatcaaaatcagaaatattgatacaacactattatctactttccataaatcaaatgttaccaatagtccaaataatgttttgttgttgttgttgttgttattgttgttttttgagacagagtctcactctgttgcccaggctggagtgcactagcgtgatcttggctcactgcaatctccgcctcccaggttcaagcgattctcctgcctcagcctcctgagtagctgggactacaggcgtgtgtcaccacgccaggctaactttttgtattttttagtagagacgggttttgccaagttgcccaggctagtctcaaactccggagctcagacaatctgcacaccatggtctcccaaaatgctaggattacaggtgtgagccaccacgcccagcccaaataatgttctttataacatttttttccctgatcagaatcccaatcgaggaccgtgcgatgcatttagttgtcataactccagtctccataaaggctatttatttgtgtaagttgtgacatactgttaatctaaaaagcaggatatactaaatgcaatgtggatcctagattggatcctggaaacgaagtaagacattagtggagaaactggcaaaatccaaataaagtctgaagagagttaatagtaacataccaatattaatctcttagtttttgctttgtttgttttgtaatagagacagcagctcccagtgttgcccaggctggtcttgaactcctacgctcaaggcaccctcctgccttggcctcccaaagtgctgggattacagcaccaaaaaatgtaccaaagaaagatggcaatgctcgaggaaactctctttgcaactttcctgtaaatgtaaagtcattccaaaacaaaaagtttattaaaaagtaggatataaaactaagtaaaatacacacacatatataaaaagacatacaaaccaaatgcagaatgacttaaggaacaattggggaactccgaataaggatgaactggaatgagacagtatttagcaatttttgttaatcttactggaagaactaatggtattaaaaatattcttggccagacacggtggctcatgcctgtaatcctagcactttaggaggccaaggcgggtagatcacctgaggtcaggagttcgagaccagcctgcccaacatggtgaaaccccgtctctactaaaaatacaaaaatgagctaagtatggtggcgcatgcctgtagtcccatttactcaggaggctgaagcaggagaatcacatgaacccaggaggtggaggttgcagtgagctgagatcgtgccattgcactccagcatgggcaaaaagagcaaaattccgtctctaaataaataaataaaataaaataaaaatattctttagcagcacatggtggtacgtgcctataatcccagctactcaggaggctgaggcaggaggatcacttgagtcccgggggcagaggttgcagtgagccaagatcataacactgcactccagcctgggcaacagaacaagactctgtctcaaaataaataaataaataagtaaataaataaataggccaggcacagtggctcacacctgtaatcctagccctttgggaggctgagccgggtgaatcacctgaggtcaggagtttgagactaagcctggccaacatggtgaaaccccatctctactaaaaatacaaaattagctgggtgtagtggtgcacacctgtaattccagctacttgggaggctgaggcaggagaatcacttgaacctgggaggcggaggttgcggtgagccaagattgtgccattgcactccagcctgggcaaaaagagcgaaactccatctcaaaaataaataaataaataaataataaaaagatttttaaatgtttaaaaaagaaaatatccttattttttagagatgcatactgaaggatgaaacaacatgctctactttgaaatacgttttcaataagaaaaaaataaatgaggccaggcgtagtgggctcacacctgtaatcccagcactttgggaggccgaggcgggtggatcacttgagatcaggagtttgagaccagcctaacatggtgaaaccccgtctctattaaaaatacaaaaattaagccaggcacagtggctcttacctgtaatcccaacactttgggaggccgaggtgggaggaacacctgaggtcgggagatcgagaccagcctgaacaacatggagaaaccccgtctctacttaaaaaatacaaaattagccaggcgtggtggcgcatgcctataatcccagctactcgggaggctgaggcaggagaatcgtttgaacccgggaggcggaggttgtggtgagccgagatcacaccattgcactccagcctgggtaataagagcaaaactctgtctcaaaaaaaaaaaaaaaaaaaaatcagccaggtgtggtgccaggcacctgtaatcccagctactcaggaggataaggcaggagaatcgcttgaatctgggaggtggaggctgcagtgagccgagatcataccactacactccagccaaaaaaaaataaaaaataaaagtaaatgaaacaaatatggcaaaatgcaacaattgttaaatttaggtgattgttagctggggcagaggggtcattatactattccctcttttcagtatatttaagtatttttcatataaaaagattaaaaagactttttataaaagttgcttatttagaagacttccaatagataaccattgtttgaatgaataaacggacattctgttaaaggtacaatattctatactctttgcaactgtagtctaaaaaatctaaatgaaagaaaaaaaatctttaaaaattactaaacaagcaaaattattaagtgactaacagatactttaaaatacaagtaaaatcttaattttccacaagtctatggccttgaattcactaagattcactttaatgttattaagttccttcttttataggcaaatggcctagaaaggttggggagttttgtcaccatctcagtctatttaaacagaatgtctctatcctgaaggagtgagttttggtactgagggagagctggaaggggagaggaaggagacaactttagaccaggaagcacttggagaggtggggtatggaaaatgcctcacagagcaggggagcagctaggggccaaatcaaggaactgattatctgggggtagggcaagagaagacagcactgccagaatgtgaggatgatagcaaactggtgacttagaactagagcagggaggccaggcacagtggctcatgactgtaatcccagcactttgggaggccaagacagtaggattacttgatcccaggagttctagaccagcctgggcagcatagtgagacctcatctctacaaataattaaaaaattcactgggcgtggtggcacctacctgtagtcccagctacttgggaggctgaagtgggagaattgcttgagtccaggcaggtgatgctgcagtgagctctgaccacaccactgtactccagcttgggtgacagagtgaaagcccgtctcaaaaataaaaaataaaaaaagaactggggcaggggctaccctggccctctcccatgattcctgagccaaacaagtaaggaagcagggagacaccactgttaggaaaagccaccatattcccacctattgtcctcttctgcaggggtagcagattcaggcccggggctaaggaaaagacctcctcaaaagctgaggaccagctcccagtgggagaaagaagagcagatctcccctgtggcttctgatccaccttactcccctcatctattctgtccctcaactagtgagctggctcagtgataaaatgaacaataaatctgggagtttttcctggaagagacaaattcataatttctcaaaaacttagctatgtgccaggtaatttaaaaacttttcctccaatccttctaataaccctgcaagcaaggtattattttattctcttttcacagatgaggaaactgcattacgacgacagttaaattgacatgcctaggaaccaagccagaattcacactccatcacctgactgtaatctcatgccctctccatccaccatgctgcctccatagtggagctctgtaatttgtgggcaataaaccaatgatgtacacaaaagtagttctttctggccaggcatggtcctaaactttaataagtcagagacagcataggctcaaaactacaaaggttatcctcatcctcccccaaacatgttcacagcaagaaagcctggagaactcttcacctgctcagaaagcttcttcacttcctctagaatggaggcaataggccgactcctctccctgccccgggtgaaaggaacaatgcagtagctacacatgttgtcacagcctcgcatgattgacctggagaagaaagtaccagaacttagtaacagtagcagggtgtgctggtatgacccaaggagcaggactcagcttcaatagcattattctttggctctgaatcctcttgccacaatgctcacactggaccaatctgagatctaagcactaaagtagaccttttttatctttaaaaattggtatctaatcacaaaatataaaccaaactataaccagtgggacaatgactagcctgaggaagcacagcggtgaggagctagaatatacacttaccacacttggactttctactgtttttttgttttgttttgtttgagacggagtctcactctgtcaccaggctggagtgcagttgcaatctcggctcactgcaacctccacctcccaggttcaagtgattctcctgcctcagcctcctgagtagctgggactacaggcgcctgccaccacgcccggctaatttttgtatttttagtagagatgggatttctccatgttggccacgatggtctcgatcttttgacttcatgatccacccacctcagcctcccaaagtgctgggattacaggcgtgagccactgcacctggcccctctactgtttttaaattcttttttccagacagcctgaatatgtttgtacctactgtttttatgagtatattatctgaactttttacatccagaccagaaaaaaataaatattataaagtgtgtgtatatgtgtgtatatagggcaaggagaccctggatttaaaacacagaattctacatttctcacgccttcctgatccaactgttaggtatcgaagttaaatcgctctctttaattcacatcctgtatgtgaaagcctcaatctatctgaaggaaataattacggctatgtatcaaagacgttcactgaagaattatgtaataaatgttagctattattcttactaagcattccaacaagagaatattatatagccattaaaataaacagaggttgacaaacttttctgtaaaaaaaaaaaaaaaaccctatagtaaatatttgagacttagcaggctatagtctctgtcccaagtatttaaccttgctttagtggcaaaagcagccagaggcaatatgtgaataaatgggcatgcttgtattccaataaaaccttatttacaaaaagaggtagtaagctatttggcaacctctgttacagaaaatttaatgccatggccaggcgcagtggctcacccttataatcccaggattttggaaggctgaggtgggaggatcacccaagctcaggagtttgagaccagcctgggcaatatagtgagaccctatctctgtaaaaattcaaaaaaaaattagccaggtgtgggggtgcacacctgtagtcccagctactcaggggactaaagcaagagcccaggaggtcaaggctgcagtgagccctgatcatgacactgcactccagcctggatgacaagagtgagaccctgtctcaaaaaaaaaaaaaaaagtgtgaaaggaggaagaggcttattccctatctcttaggcagtgactcacacaaaggcagacgtggcactggcgcttgtctggactggcatgacatcagcataggtctcgtccagagagagcagcacgttggcagcttgctggcccgactcagcaacagccagcagccggggaaggtcccggtaggcatcaggaccagccaaaatatctaccattttctctctgttgagaatctcctccttcaacctctcagccatgcagcctggaagggaaaaagaaacaagcacctttccccaaatccacctggtgtttaatggcttcttcttattccactttatctgtagctgggattagagaccagggcacagaaaacttctctaagaattgagtatcatccttcaaatttaaccaacactcccatcgcactggagcctgtatcttcctatataagaaaaccacagaaaagggttccagagcaattcaattaaatgcccagaaaaaaattaaaccaccagccaggtgcggtggctcatggctgtaatccccacactttggggggccgaggcaggcggatcacctgaggttgagagttcaagcccagcctgaccaacatagagaaaccctgtctctactaaaaatacaaaagtacccaggcatggtggcacatgcctgtaatcccagcaacttgggaggctgagggacaggagaatcgcttgaacccaggaggcagaggttgcggtgggccaagatcgcaccattgtactccagcctgggcaacaagggtgaaactccgtctcaaaaaaaaaaaaaaaattaaaccaccacccacaaacctttcaagacatgaaccatgtcttctttcaactgaaaattacttagtgctgaaataaaaagtattctgtgtctggaacttacttacccacaactacacttgaaccctttccctctcttctagcctataatacttgctaaaacctgtaagaaatgagtaagccatttatgctgttatcttccatatccttaaaaaaattatgttattaaagttataatatcttaaagtccactttattacaaataccctttgaaaacacttaacagctattcttgtttgtatgcccatgttcatagcactattatccacaatagccaaaaggtgcaagcaacccaagtgtctattaatgaatgaagagatatttgcatctacgcaaagccagttaaataaataatttttcagctccctctccctctccctctccctctccccctctccctctccccctctccctctccctctccctctccccctctccctctctccttctccctctccccacagtctccgtctccctctctttccactgtctccctctccctctctttccacggtctccctctgatgcccagccaaagctggactgtgctgccgccatctctgctcactgcaacctccctgcctgattctcctgcctcaacctgccgagtgcctgcgattgcaggcgcgcgccgccacgcctgactggttttcgtatttttttggtggagactgggtttcgctgtgttggccgggctggtctccagctcctaaccgggagtgatctgccagcctcggcctcctgaggtgccgggattgcagatggagtctcgttcactcagtgctcaatgttgccaggctggagtgcagtggcgtgacctccgctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcccggctgcccagtctgggaactgaggagcgcctcttcccggccgccatcccgtctaggaagtgagcagcgtctctgcccggccacccatcgtctgagatgtggggagtgcctctgccccgctgccccctctgggatgtgaggagcgcctctgcccggccgcgaccccgtctgggaggtgaggagcgtctctgcccggccgccccgtctgagaagtgaggagcccctccgcgcggcagccgccccgtctgagaagtgaggagcccctccgcgcggcagccgccccgtctgagaagtgaggagcccctccgcccggcagctgccccgactgggaagtgaggagcgtctccgcccagcagccgccccgtccgggagggaggtgggggtcagcccccgcccggccagccgacccgtcagggagggaggtgggggggtcagcccccgcccggccagccgccccgtccgggagggagtagggggcagcccccgcccggccagccgccccgtccaggaggtggggggcgcctctgcccggccaccccttctgggaagtgaggagcccttctgcccggccgccaccccgtctgggaggtgtacacaacagctcattgagaacagaccatgatgacgatggcggttttgttgaatagaaaagggggaaatgtggggaaaagatagagaaatcagattgttgctgtgtctgtgtagaaagaagtagacataggagactccattttgttctgtactaagaaaaattcttctgccttgggaaaaaaaaataatttttcaatgaacaaacaaaatgtactacatatacacaatggaattttttttttttttttacaacggagtattactcagccttataaaggaaggaaattctggccaggtgctatgggtcacacctgtaatctcagcactttgggaggccaaggagggtggatcacttgagcccaggagttcaggatcagccctggcaacatagtgagacccacatctctacaaaaaataaaaaaattagtcctcgtggaacgtgcctgcagtcccagctactcaggaggctgaggcaggaggattgcttgagcctgggaggttgaggctgcagtgagccatgatcacgccactgcactccagcctgggcgacaaactgagaccctgtcaccaaaaaaaaaaaaagaaggaaattctgacacaggctacaacaggtaacctcatgaaccctgaggacattatgataagccaaataagacagtcacaaaaaagacaaaattgtatggttccacttacatgaggtatctagagtagtcagattcataaacagaaagtagaatggtgattgccaggggctgagggaaggaggaatggggagcgtgtgttcaatggatatgtagtctcagtttgggaagagaaaaaagtcctgcagatggatggtggtgatgggtgcaaaacaatgtgaatatacttagtgccacagaaatatactattaaaaaggattaaaatggtaatttcatatatattttactacagttttttaaattattcttgggatttctgaaattcttattagatatacaccctgaggcttctacagtgaaggaactgaaatggaacagaacatttcagctgacccttccatcctcctgcgtcaattactacatggatctgataactaaatatgctccatctgtgtgtggacccatcgttaggagagattaatttaactattccacaatggagatagtctgtttttccataatgttaaatacattaactaaattctgagacagaaaagggtagagaaatgtctccagtcatatagatcagaactgcccaacataactttctaataagatgataggcctggtgcagtggctcacacctataatcccagcaatctgggagattgaggcaagaggatcacacttcagcccagaagttctagaccagcctgggcaatatagcaagaccctgtttctacaaaaggtcaaaaaattagctaagtgtggtggtacacacctgtagacctagctacccaggaggctgaggtgagaggatcatttgagcccaggagttggaggctgcagtgagccatgatcatgccactccagtctgggcaacagtgtgagactctgtttttaaaaaaaaaaaaaaaaaaaaaaaggatgacagagtgtgctggatggaaaaataattgcgctgtacaaactggtagcccctagtcatgtggtcatgtgtggctactgagaagttgaaatgtggctaatggaactaaagaagtgaattttaaattttatttaattataggtaaatttaaatagccacatgtggctagtggttaccatattggtgaggcagacctaaatcttcacttgagcttgcttcaggagtcagaatgaaaggtacccacattagaaatttgtgctgtcaggccaggcacggtggctcatgcctataatcccaacactttgggaggctgaggcaggcggatcacccgaggtcaggagttcgagaccagcctgaccaacatggggaaacccgtctctactaaaaatacaaaattagccaggcatggtggtgcaagcctgtaatcccagctactcgggaggctgaggcaggagaatcacttgcacccaggaggcagaagttgcggtgagccaagatctcgccattgcactccagcctggacaacaagagtgaaactccatctcaaagaaaaaaaaaaaagaaattcaagctgtcccttcagactccaactctacccataactctgtgctaccatgagccgcattagactctaggcaggatataccactttctgagcacctattacttcaaggaactacggaaagccctttcatgaactttatctcatttaatcctgtcacctctggcagtaagtacaagaattgcatgggatatataagatttcttcagacactgggaatccagcctctaaaggaaacactagcaaataaagccacataaagtccaagtttcaaagctgacaaaatgtgcaaattaccagatacctagaattccaatcctcagaggaacccgggagcggggccgccttgtcttcaaggctttaagctgatgtaaacggttccagatggtctgctcagccttctccctagagagatcaaaggaggcaagactgaaccaaaaataaaccacagaggtatctaagagagtaggtcagtgggaagaaaataaaaaccaccttcaaccctttaaatcaagcttttccaacctgcagcccacgggccacatgcagccaggatggctttgaatgcagcccaacacaaattcataaacttttgtaaaacattaggagatttttttgggggggattttttttttttttttttttttagctcatcagctattattagtgttagtgtatcttatgtgtggcccaagacaattcttcttcttcttccaatgtggcccagggaagtcaaaagattggacagccctgccttaaatgtgtatctgccattcagacttacggaaggtaggtagggggccacctgaagaagcaacacttgctataatttacctttcctaaaatgacatccttcctacacatcttcaaatcctgaaaagcctttaagccaaactcaaaaacaatctacttcacaaggccttccagttctcctctgttggacagtttgtcctccctttaactgcccttcaactttttttttttatgattccagatcctaatgcccttctactttaactagatttttccctatacttagcaatttctccttttttttttttgagatggagtctcgctttgtcaccaggctggagtgcaacagcgcgatctcggctcactgcaacctccaactccctggttcaagcaattatcctgcctcagcctcctgagtagctgggattacaggcgtgcaccaccacgcctggctaatttttgtatttttagtagagatggggtttcactatgttggccagactggtcttgaactcctgacctcatgatatgcccactctggcctcccaaagcgctgggattacaggtgtgagcaaccgtgcctggccagcaatttatcttttatttttctttgtagatacagggctttactttgtgcccaggctggtcttgaatagttcactgtagccttgaactcctggactcaagtgatcctcccacctcggactccaagagtgctgggattataggtgtgacctactacacccagcctcattgtttgattttttttgaactagcattttttgccagatgttggagctatttgttcatctatcttagttcccatatcagactaggctccttaaagccaggccatggaagaagggttcatttcggaatcacccaaagcacatagttcagtgtcaagcagcagaggcctacagaacaaaaatgtcagatgaattaattgacagtatagccggatagggaaacattaacactagcatgtcttgaacacagaaacaaagtgagaaaggaggtacgttcacctctgatgggagtcacccatctctactcaaaactccccaagcctatgactacatcctaccccgggcagctatattataaacatatgccattagttacaaaacaaagctcaggaagagctgagtggctcggcacattcttggtgtcctcatctataacagcaccaaccacacagggttgttgtgatcattaaatttgttaatgcattatgttactcactcagaacctgacaccacggtacatgcccagccaatgtcagccagttgtataaagactatctccactgtgggaaaactgcaagtcctactgccatggggccactggctcatctccatagacagccaggccaggcactgttagctctggcattattacataaaatacattcactcctaggaaaagaacaaattcgcacctgatagagcatgtgacaaggagaatcacatctgcctgaatggaaagaaaggaaaacaaggaaaattacataatatcttggatattagccttgtacaattcctgccctacagctctttattatttttttttcctttttttttttttgagacagagtctcactctgtttcccaggctggagtgcagtggggcaatctcagctcactgcaacctccacctcccgagcggttcaagcaattctcctgcctcagcctgggattacaggtgcccaccaccacgcccagttaatttttgtatttttagtagagatggggttttaccatgttagccaagctggtctcgaactcctgacctcaagtgattcacctgccttggtctcccaaaatgctaggattacaggcatgagccactacacccggcctattatttttctttaactatttttttcctttttttttttttttaatagagaaaggagtctcgctcacttgcccaggctgaagagcaatagcataaccatagctcactgcagcctcaaactcctgtcttcaagcaatcctcctgccttggcctcccaaagtcctgggattacaggcatggtgacccacacctggacattttaaccatttttaagggtacagtcctgtggcattaagaacatctgcaatttcataactacgcattttccataactttttcatcttctgcaactaaaaccctgtactcgttaaacagtaactctccaacttccctctccacagccaattcttaacttagctccttgtctgaaggcgcacatcaccataaaagtttcaaaaacagctggaacaaaagtacaactcagtcccatggtgaacacttcacccaagggaactctctctcaccagggggcaccctgctcctgaaactacacctaagaactggcacaaatgcagaatcttgcccaggtccaggaaacaaaggaaataggaaatgcatgtacctcttggaggttactggtccgcaggtagccactcttctgtaagatggaccaggctatctctgtgtcattcacattcatctggcagccataggtctcgaggtagactgcagtgagaggttggggggaatccatggtagacagacaacaaggggtctcgtgtctcaaaaggtctccttcccaaatgctctagaaatatctgaggcatctggttatccactaagtcccctattgcttcaatcttaagataacataaattgccagatgtacccccaagttaatgatagaccttcagaacaaaagaaataccatattaggctgggcacagtggttcatgcctataatcccagtactttgggagactgagacaggaggattacttaagcccaggagtttgagaccagccagggcaacatagggagaccctgtctctacaaaaaatttaaaaattaggcaagtgatacatgcctgtggtcccagctactcaggaggctgaggtagaactgctcgagcccaggagactgaggctgccgtgagccatgatcacaccactgcactcagcctgggcaatagagtgagaacctgtctcaaacaaacaaaaaaatataccacattatatatccacaccaattacaagccatgttatcttttaaatggggaaaacatgtacctgagaatcaaggaaatatagttataaaaacaattagaaaaggaaggactaggccgagggtggtggctcacgcctgtaatcccagcactttgggaggccaaggcgggcagatcacttgaggtcaggagttcgagaccagcctagccaaaatggtgaaacccaggtctccactaaaaatacaaaaatcagccaggtgtggtggcgtgcacctgtaatcccagctactcaggaggctgaggcaggagaatcacttgaagccaggaggcagaggttgcagtgagctgagatcgcaccattgtgctccagcctgggcgacagagcgagactcaaaaaaaaacaaaaaagaaaagaaaaggaagggctaactgatagtgttcatcagcctgaagggaaaataagtttaaatccacatgttacactcctcctcaaaataaagaggttttccagcctctggaagtagcagcagtggccagagggtacataaagtcacaaaattaaaatgaggcatcttcttacagtaacttcatcttaaatgaaagcaaggctatattatgaagtaaaactaattttgtacacagttgtaagaatatgaatttcacattctggcagcttcaaactatattccaagatcaacccccgtccccaccagcaggtcttatttccagactccaataaattccaactaaaagttaagagctgaatgataatcagcttttgatcaaatgattctcccacctcagcctcctgagtagctaggactacaggtgcacactatcatacctggctaattttttattttttgtagagacagtgtttcaccatgttacccagactgttcttgaactcctgggctcaagcaatccacccatcttggcctcccaaagtgctgggattacaggcatgagccaccgtgaccagtcgagtttcttgatattaatattacttggtggagtctaatgattcccacagccttcccacactgttaaccttccaagccagttctgtaataaaagaatcatgccaggaatgacagagaggagcaaggcaggaagcccaaagggataagcgaagtaaaaccaaccttttctctgccttccaagaagttcatccatcatgagatagggaggtgggtcttccacttctgaagacagcttctcctgaggagctgaggcactttttaaaaaatgttgaaaagtcggtccagcagccagcctggagctgaaatccttccgagctccatcctcctgcctctctggactgggacacatggtactagagagactgctgtgtgccctgcacatcctcagcgacagccaagacacagaggccaatggtccccaccccagagacctctgcacttggaggacacactgtaaagggtgcatggcactaaacagcccacagtctgcaaaagaatgacagacatcaccagcatttattgaacactatggacaggacactgctgtgagcacttcaagtgtatacatctatttacccctcacaaaagcccatgaagaaggtactcctaataatatgacctctgttttacagttgaaaaaaactgaggcaacttgcccaagaccacacaaaggagtgccagagatgagatgcaaatccaggcagtcttttcaaaacaaggggtggtagagatgagatggaaagccctgacaaaatgacaaaatagcaccttgtgccaagaccagttcccaaggctttaagtgtattaactcattaaatctttacagcaatcctaggaagcagatactattattgttcctattccgaaagacataggttgaggaactcacctaagctcctacagccagtaagcagtcaaacaaggactcagataaaaatctgtatggatgcaaagcccgtgccactacccatcttgctacactgcctcttaataaagtgaaaaccactcactgtctgagggcatcttcctttgagttccttcagaaggaaagcaactaatgtgagggcattgtatgcccgatcagtgactccttctacccttcaagagtcttggctggatgcagccgctcatgcctgtaatcccaggactttgggaggccgaggcaggaggatcacttgaggtcaggagttcaagaccagcctgaccaacatggcaaaaccccatttctactaaaaatacaaaagttagccagatgtggtagcaagtgcctatagtcccaactactcaggaggctgagacaggagaatcactggaacccaggaagcagaagttgctatgaaccgagatcgcaccactgcactacagtttggacaacagagcgaaactccatctcaaaacaaaaaaaaaagagtttcaaactactaccttcaaactttccacccagaccctctcacacttggcttagcaaataacacaacctttatagagaacaatttgccactttccatcaaaattacaagtgtgcaaaccatctgacaaagcatttccactcataattatcctgcagataaatctatacacatacaaaatgacctatgtataaagacattcagtctaggcacagtggctcatgcctgtaatcccagcactttgggacgctgaggctggtggatcacttcaggccaggagttcgagaccagcctggccaacacagtgaaacctcatctctactaaaaatacaaaaaattagctggatgtggtggcacacacctgtattctaagatacccgggagactgaggcatgagaatctcttgagctcaggaggagaaggttgcagtgagccaagatcacgccactgcactctagcctgggcaacagagtgagactgtctcaaaaaataaaaataaaagatattcaatgcaacagtgtttctaatagcaaaggaaagggaaagatctaaatgttatcaataaaggactagttaagtaagttctggtgcatccatacaatgaaacaagatacaactgttagaaaccaaggctggtggccgggtgcagtggctcatgcctataatcccagcattttgggaagctgagacagaaacatcacttgagccaggaattcgagaccagcctgggcaacatagtgagacctcatctctataaaaataacaaaaaatagccgagcacagtgatgcacacctgtagtcccagctactcaggaggttgagatgaaaggattgcttgagcccaggagatcaatgctgcagtaagccataatcgcaccactgcactccagcctgggtgacagagtaagaccctatctcaaaaaaataaaaataaaaataaatgaggctgaacctatacatgacaaaggcaaggaagcaatatgctccatgctacctacattatactactgttgaatctgtggggaaagagggtgggaatattgaggtacctatttgcaggtacatacaatatctctagaatgcataagaaacaatagttgcctcccaggaagacttaggtgactaaggtataggagatgaagccatactatttactttttttttttttaattttctgactaaggaagaattctaggatcaccatatatttttactggaccccacatctatggcctactacactccagccatgccacacttctttgtattaatcttcactagcttataggattttacacatgctgttctctggctggtatttatcttctctctagtggcctatggtactttcagctttcttcctctgggaagcctgctctggccatcacccccgaagtctaggtggggtcctcctctgggttcccaaagctctattctatctctccatcacaagactcatcacactttgctgttaattattactgacacttctgccagccctagtaaactggcaggttcctgcaagcagggaacaagtatcattcatttctacaccttcaccatctcccattgtggtagctgcctcacggcaggtgctaaacatcagtggttcccaacctttttggtactaggaattggtttcatggaagacaatttttccacagacatggaagcaggggtgtgttgaaactgttccacctcaggcatttagattcttacaaggagcatgcaatcttgagccagtgcggtggctgacatctataatcccagcactttgggaggccgaggcaggcggattgtttgagctcaggagttcgagaccagcctgggcaacatggcaagaccatgtttatttgttgtctctacaacaaattaaaaaataaaaaattagccagccattgtggtatgtgcctgtaatcccagcaacttgggaagctgaggtaggaggatcacttgagccagggaggcagagattgcagtgagctgagattgcgccaccacactccagcctgggcaacagagagagagagaacttgtctcaaaaaaaaggaaatggaatgcacaaactagatgccttgcatatacgcagttcacaatagggtttgtgttcctgagaaactaattccgtggccaatctgacgggaggcagagctcaggcagtaatgccagctttgctgctcacctcctgctgtgcaacccggttcctcacaggccacagacaggtaccattctaccacctagggttaggggaaccctgctatacacgtgtaaagagcagatgtggcccattacctttccaatgagatgacctgccacatctgctactagcacttaggagcaatgccaacccagtttcaagagtcagagaagaacagccttaaagtgtgaactttaaaatcgcccctttctactccataattgctgtgtgacctttggcaagacaaatttctgtctctgagccgccaattccacatgtgtaaaataaggataaaagcagcacctaccaccccataagtgttattaagaataagatattaaaaacccaacttgagatacagtaagcgttcactaactgcacatttacagcccacaccccctttcacagagagtattagagcatcctggttaagagtatgaactccactaaaaatacaaaacttagccgggtgtggtggtatgcgcctgtaatcctagctacccaggaggctgaggcaggagaatcgctggaactcgcggggcaggggctacagtgagccgagatcgcgtcactgcactccagcctgggcgacagagcaagactcccgtctcaagaaaaaaaaagtatggaccctggagtcagaatctgaccccactgctgccaagccagctaaaccttaggcacctgtcttaaactctgggagcctctagatggggataatagcacctatctccataagcctaccgtaggatcaaatgcaataatacaagcaaaatgctttgcataacgcaatgtagaagcctctctggaggctcgaaattaattctgacagtcggcaatgaggctggaacaacagcgtacaacatcccaaacattttattggctggttacaatgcgttaggcatggtgcaaagcattttccgcgaattattacctataaccctcatagcaaccctgtgaggcaggctgtactgtcaaccccacttcacgggtggcgaagcgaagccttgaaagaagtggaggtgacctgtccaaggtcacacggggttaggcggcggggttagggtacgaacccctacagcctgacgccaggccccacgccataaccaccgtgccatcctccctcttgaacaccgtgcgcttcccgggatccgcggcccctcctgccccaggcgccagtcaaaagcgggtgcgcagcccaccccggcggccgcgctgctcacctcccgcagcagcaacagtgcccggggtcccgcagcgtaagttctgccggcaagtcggatcccctcacaggtccgccgctgcgttcatacacaagcgacttccgttccgccgctacttcaggccgggtcatgctaacggaagtgcttcctttttacagtccgggtggacccaaagctccgtggcggtgctgaactttagggcagccactagccacggacttaagcggcaattgagctcctcaaagtgggtgagtgcaaatcaaatgtgcgctaaatgtcagatacactggatgtggaagaagaaatgtcaaatagtgtcaaatagttcatatatataatgtttatattgattatgtgctgcaataattgttgggatatattggattaaataagtacatttgttgaattagttttttttatttgtagctatggtggtagaaatatttgaattaagttcacctgttgtttctttttactttttcaatgtggctagcagggggaaaaataatatggtgtgatcatggctcactgcagcttccgcctcccatgctaaagcaatcctcccacctcacactcccaagtggctgggactacaggcaggcgccaccacgcccagctaaaatttttttaatttttttgtagagaccggtctccccatgttgcccaggctggtctcaaactcctacctaggcgcaagccatcctcccaccttggcctcccaaagtgctgggattgtaggcatgagccaccgtgtccggtccttactgggaaattttaagtcacctaagaggttcacgctctatttctattggagggtgctgccctgtaggttaatgacttcctgattcacatctccagctggaccctccctgcagtaccagagccatagctcagctgcctacttgacaccccttcttgagtgtctgatgaccatctctaacttatacagaactcttcatttccacacatgcaccttcaccaaaaacctgtacctgtcattctggcccatctcagtaaatggcccaaccatccttccaggtgcactaggaggaactgaatggtcattttcttcacctccctggatccccacattctatctgtcagtaagccctgtcaactctaactccaaaatgtcaaatctgtctactcggtagctacaactacccaggccaccattgtctcatcagaaacaatcacagtagcctgctaatggtcaccttgtctcctgagaacagtttcccacacatagcctaagggaatttgtgtttgttttattaaatcaaattatatcacccctctcctgaaaactctccgtggcaggccgggcgtggtggctcacatctgtaatcccagcactttgggaggccaagatgggcagattgcttgagcccaggagttctagactagcctgagcaacatgataaaaccccatctctacaaaaaacacaaaaattaccccggcatggtggtgggtacctgtggtcccagctactcagaaggctgaggcagggaggattgcttgagccagggaagttgaggcggcagtgaaccatgacctcaacactgcactccagcctgggtaccagaatgagaccatgtcttgaaaaagaaaaaaacaaaaacagccgggcacggtggcttatgcctgtaatcccagcactttgggaggctgaggtgggtggatcatgaggtcaggaattcgagaccagcctggccaatatggtaaaaccccgtctctactaaaaataaaaaataaaaaatagctgggcatggtgccgcgtgcctgtagtcccagctactcgggaggctgaggcaggacaattgcttgaacccaggaagcggagattgcagtgagccaagatcgagccactgcactccagcctgggcgacagagcaagactccatctcaaaaaaaaaaaaaaaaagaaaagaaaagaaaaaaacaaaaacaaaaagcttaagagctttccattgcccgtgcaataaaatccagatttcctactgtatcctaggggcctgcatgatgtggcccctgctttttttttttgagacgacgtctcactcactctgtcgcccaggctggagtgcagtagtgcaatctcggctcactgcaacatccgcctcccaggttaaagcgactctcctgcctcagcctcccgagtagctgggattacaggcgtgcaccaccacgtcaaactaatttttgtatttttagtagagcagggtttcaccatgttggccagattggtctcaaactcctggcctcaagtgatccgcccacctcgacctcctaaagtgctaggattagaggcgagcaccaccacgcccggctgatttttgtttttactagagatgggttttcgccatgttggccaggctggtctcaaactcctggcctcaagtgatcctcccacctcagcctgccaaagtgctggaattacaagcatgagccaccatgtctggccccctgcttacttttacttctccaacccatgtacttcttaccacttacttctcctactgtgttctttctagttgactatacttcaactacataattttatcttgctccttcaataacccaagcaaatgtttatttcagaccctctgtccttttttttttttcttttcttttttgagacggagtcttgctctgttacccaggctggagtgcaatggcgtgatgttggctcactacaacctccacctctcgggttcaagcaattatcctgccacagcctcccaagtagctaggattacaggcacgcaacaccatgcccacagagcttctcttcttactattatctttctggaatgctcttctccaaaattgtttcgtggctggccccttctcatcctttaggtctcagcataaatatcagctcttcagagagaccctctctgaccacttcatataaactactctatcacttctcttattattttcttcaccatatttgtcactattcaaaatgttggcattacttattttcttatcattgcctattccctggactatcagctagggagggacacgtcgtgtcttgttcatggctttatccccatgatctacacagggtctgactcatagaagggcttaatgaaaatttgttgaatgaataaatgactgctttctgtcttagtttgggctccccagaagcagacctgagacaagtatttttttttttttagaccaagtctcactctgttacacaggctggagtgtagtggcccaatcttggctcactgcaacctccaccacccgggttcaagcgattctcctgcctcagcctcctgagtaactgggattacaggcaagcgccaccacacccggctaatttttgtatttttagtagaaacagggtttcaccatattggccagactggtctctaactccccacctgcggtgatccacccaccttggcctcccaaagtgctgggattacaggcatgagctactgtgcccggctactgagacaagtatttgagtgcaggtagttgatttgcaaagtaatctcaggaaacactggtagggtagtaggggagtgaaacagggaggggagacagccaataaacattgttaacaagcaactttcttgcaggcatctaggtcttaatcctgctggagaacactgggaaataatgcagaacactgtgctggttaattatttgtgtcaacttgactgggccacaggttgcccagatatctagttaaacgttatttctgggtgtttcttgaggaagagattagctttggtggactgagtagagtagactaccctccacaatctggatggacatcatctaaccccttggggacccaaataggacaggaagacagagcaaggttgaattctctgtctgcctgactgcttaagctgagacattggtcttctcctgcccttggactgggacttaaacaccattggcactcctgattctcagtcttttagattcaaactggaatttacaccaccacctttcctcggtgtgcagcttgcagatggcaaattgtaggacttctcagcctctataatcacttgatccaattccttatgataaatctcattctagatgtagaaatatacatatagtggccaggcacagtggctcatatctgtaatcccagcactttgggaggccaaggtgggaagatcactggaggtcaggagttcgagaccagcctggccaacatggtgaaaccacatctctaataaaaatgcaaaaattatggccaggcgcagtggctcacacctgtaatcccagcactttaggaagccgaggcaggcggatcacctgaggtcaggagttcaagaccagcctggccaacatggtgaaacccccgtctctactaaaaatacaaaaaaattagccgggcatggtggcgagcgcctgtaatcccagctgctcaggaggctgaggcaagagaattgcttgaggccaagacaggaggattgcttgagttcaggagtgtgagaccagcctgagtaacatggcaagaccccatctctacaacaaattaaaaaataaaaaattagccagccatggtggcacagtcctatagtcttagcaacttgggaggctgaggtaggaggatcacttgagcctgggaggccgagactgcagtaagctgggatcccgcaactgcactccagcctgggcaacaaagcgagaccccacctccaaaacaaaaaatagggcggagggtggtgttccaagtgaaggcaccagactgctgatggccagaaggaaaaggagtgagtctttggtggtttgggatgttgctgaaaatttagtggataagctgagaaaatttcattttcacaaagaaacaatgctaccattgtaagtaagctaaaagtgattgcctcaaagttaagttacctggtctctcttttttttttttttgagacagagtcacgctctggggcccaggccggagtgcagtagcgcaatctctgctcgctgcaaactccacctccagggttcaaatgattctcctgtctcagcctcccgagtagctgagattacaagtgcacaccaccatatctggctaatttgttgttgttgttgtttgttttgtttgtttttttgagaccgagtctcactctgttacccaggctggagtgcagtggccgcgatctcagctcaccgcaaccttcacctcccaggttcaagcaattctcctgcctcagcctcctgagtagctgggattacaggcaggtgccaccatgcccggctaatttttgtatttttagtagcaacagggtttcaccatgttggccaggctggtcttgaactcctgacctcaggtgatccgcccacctcagcctcccagagtgctgggattacaggcatgagccatcacaccaggcacatcatctttgttttatcttgtcgctacattaaagaaactgaacctttcaaaagtttaaaaaaaaaaaagttctgggcttggcacggtgtcctagcactttgggaagctgatgcaggaggatcacttgaggtcaggagtttaaaaccagcctggccaacatggtgaaaccctatctctactaaaaatacaaaacattagtggggcatggtggtgggcgcctgtaatcccagctactcaggaggctgaggcaggagaatcgcttgaaccgggaggtggatgttgcagtgagatgagaccctgcctgggtgacagagcaagactccgtctcaaaaaaaaaaaagttctccatcattgccattgtcattgtgattttaggtagggagtcataaccactgcccactcacatccagccagcacatcgcagtttccgaagtaccaaacacattccactccacctcccttctgcaggaaagggtcctgaagctctctaagatggctttgacatgggtccacaaattctttgacattcctttcttcaagaggtggagcctaattcccctccctttgagtgtggactgaacttagtgactcatttctaatgaatagaacaaagcagaagcaacagtgtaaggcttccaagaccgggtcataagaggcactgtttgtggcttcctccttgccctctcttctgtctcactgtggggaaagccaactgccatatcatgagaaaactcaagcagcagctctagggttagccctacatggtgaggaactgagacctcctacccacagccatgtgcatgagcagtattggaatggatcctccagccccagtcaagccttcagatgactgcagccctagccgacaacttgactgcaacctcatgagcgaccctgagacaagaacagcccagcttagcccctctcaaatttctgacccacagaacctaagagataatgaatatttgtcattttaagctgcaaattttggataatttgtcacacaacaatagataaccaatacactgtctttggcccatgtagtaaaggtctgttcttctccagggaaaggtgccctagtccttggtctggtccatcttgggactgcaggggccaccccaggacccaaaggccaaggcacagaccacatacactgggccgggctgcctgtgtgctcacaggctgtttatttatccaagagtaaggaggagagagacaggatgaagagaaaaaccagactccccacggtggcagggctgaggggaaaaacaaacagaaaatctcctcttctttctcttgctgctgaccccagggtactccagcttcagatgggacctctgggggtggcttaggggcctcgaggaggcccggcagctcagctgttggctggggtcaggatccgcacaggggcaggtcccagactcggaatggcttctgtgtacacaaaatatctctctgcaaaaggcactggtggaggggggcagcaggaaggccaccccatcacaggcagagtccactctgtcctgcgtctgggtcctgggccccaagaccaatccagtctccctcagggttggggtttcggaggcccttgttcctctcctctcccttccctcagcccaggggtgagcaggcagtcggtggaggcccagctcaggccatgtcatggacacccctcttcagggctagtgcatccggcgacttctaggccaacagcccgaggcgggtgactttggccgacaggaaggagtggatgatgaagactatggttttgggacacgagtgcaggtccagctgctggagggtggatggagagaagagtcagggccctggccagcctggcctccgagagtgcacaccccctcctccccagggtgcagaggcagcccctcactcacgatctcgccttcagcacctccaaaatccaggaaaaggagactggcaccgtcatctgaagacatctgcagcttctcgaagggctgtcgcaggagcacagctcgggctgcacctggctcagccgcccacagtgtgaagcccttgtcgatgtgcacagacaggctgcagggacgcccattccacgtgcaggctgcagggagggcacataggtacaggcacagctggcacctcagagactacaccccaacctccaacccccaccgcagcttacaaagtggggcctgaatgcctccagggatgggaggctcactgtttgtcgtggcaccagtacacccaccctgcagagagtcatcacccccaccctcagaggacctacacccacttccagtcccacttccagcagcacaagtagaaagggggagcttaaaatgtgccatggacaggaggctcactgctgataaaggcatcatcagatctaccaagcaccgcccttggagacctgcagagttacccggctaaatttaaatttcagataaacaatgactaatttgggcatacttctgtgaaaaaagtattcattgttaacctgaaattcaaatgaggctgggtgtcctgtatttatttcctctggcaaccctaccccaagtgccatctctcacatcctcaccagcagattgacaaaactggggcaagaaaaccccagggagaagagtctctgcctgctagggcacctgcacatccaaaacagagggcccaaacccaacttccttttttttttggagaaacagtctcactctgttacccaggctggagtgcagtgggcgcaatctcggctcaccacaacctccatctcccgggttcaagtgattctcgtgcctcagcttcctgcgtagctgggactacaggcacctagtaccatgcccggctaatttttgtattattattttttttttttgagacagtcttgctctgtcgcccaggctggagtgcagtggcacaatctgggcccactacaacctccacctcccagattcaaacaattctgcctcagcctcccgagtagctaggactacaggcgcccaccaccatgcccggctaatttttgtatttttagtagagacagggtttcaccattttggccaggctggtctcaaactgctgacctcaagtgatccacccgcctcagcctcccaaagtgctgcgattacaggcgtgagccaccgcacctggccaatttttgtattattagtagagacagggttttgccatgtttgccagactggtctcaaacttctgacctcaggtgatccacccaccttgacctccaaaccccattttctatcccctcctgaagtgccctaaagaaggaagcttgaatgcccctggggataagaggcttattaccagagggacactcccagatcctcccagcacacctgtagacacctcctgcacaccctcggcggcccggtgacagccatccacaagctggcgggtccaggcagccagctcctgcggtgactccacgctgaacaggtgagtgtccacaccgtgacgcgtgcccgtgcgcagggcaaaagagagctctgcatcgtagggcactgagcccttggaggggcctgagtgcaccagtctgggggttgggggcagagggctgagcatgaggcctcaggccggaggcaaatagttctgggcaaaggggccagtgacctgggaagaaaccctgtaaatcctttaccacctaacaggacaggacttgccagggggcactgattgactcagcaggagacatctcctgccaccctccccgtcactcccttggctctggctatactggtgtcatcacacacacctagcacatgcctgcctcagcacctttgcatatgctcttccctctgcctatacatgcttccctgattatctgcacggctcactccctcacttccttcagatgttagtttaaatgtcacctcctctgagaagccttccctgacctcccagtccaaaatagcacccttgtcactcactagccttactttttaatcatggtaccagaaattatactttttattatttgttttcgttggtttttgactgtctttttcactagaatgtcaactaggttagaaattttgatcttgtgttcaccactgtattcccagtaactaaaaccatgcctgcccacagtaggtgctcagtaaacttttgttgcctaacttgaatcacttgattaggcagacagtccaggacctagttatccctagtagccagcaggctcctgacacacgggccagagccagcctgaggtaaggagacatgggggacaaggacttcagacccctgcagcttgactctcacttgctgtgtggccttggtaagccaactgcccctctctggggcagaaagttctgccccatatccctctttgttcctccctccacccactctttctcctatagctcagttccccccgccacagactgctgctgacacccgccttcgactttccagccctgagctgcagaccctcgagtccccaggcttcctatccaagctccctctccatcccacacacactctggacttaactcagcatcttgctccagcctcctccctttccacccccacccccagtcccacgctcacccagacacaagctccaaacctcctgttcattccggacccctccttcacccgccccatctggcaagcacggagccctgttaattttacacccatgtggtttccaatgccaatgctgcctttcttccccatctgctcctgccacccacctccacctcccccagccaccatcatctctcctgcatgactgcagcacctccccacttccatcctgcactctccgctgcattctccacgtggcagccacagggattctcttaaagcaaccagagcacctcgctccccagcttaaacccttcaacactaccaaactcttaagctaaagctaacattccttaatcaggcaatagaagctcttcaagatcaggccctgccaactcccttctctccatttcctgcatgaattctggttatcacaaactcatagctccatgaacatgctatagcccttcatgcctctgtacttttgaccatgatgttctctctgcatgggatgctctttcaccctttcttaaacagaaaacttctactcatccatcaaagtccagctcaaatgtcacctcctccctgaagccttcctctactaccccaacagagttaagtggctcctacaaaccctgcactgtaatggctgttcctgggtctgtctccccagccagacaaggttctctctggaggcagaaactgttggggtcagctctgtgccctctgaaccatgcagcacaaggcataagtgtcagcgaatgagtggctaatggggaccttatatccttttgttccaagcacccattttacagatgaggaaactgaggcccagacagggcagagacttgcttcaggtcacctggggaatagctgagggtggacagggctggagttcccagcttctggggccctgctggagcatctcctggcaagttctgggggagacatactgcccctgcctgtgggtacctggtggcgatgagtggggcagtacgggctggccggctcagggcctcgcgggtctcggggagagacaagtagaggagcagttccttttcagttagcagggccagggtgggggctgtgcccccactgggcagctgcagagaacaaaacagcagtgaggatgggtgggggaagagagggcagagggccagggcagggtgaggtggccaggggcactgggaacagggccagctccaaaggagcggaagagagagagggataggtcccaggcccagcaggtacctgctcagttagccagccaatctgcttgatgtcctggctcccagctgtgctggtggctgccaacagtgcctgcagctcatccttgacccgcggcgtcagagtattgacctgggcttggatggcagtcgcccacgacctcgcactagcctcatccttggccctcaggaagagggtgtcttgaccatctgccgagcagatctccagatacctgcaggcacaaatgggtggagacaaggacctgaccattaggctgcagctgcccaaccctggcccaagaaaccccacccaccaccaaaccaggagaaaccagggggatgtccgtgagagaatcaggagcaaccctcactgctgggctccagccacagttgctggggcttcatggggcataggaacaagcgagtgtgacatatacacacgtgttcatatattttgtggggtttttgttgttgtttttgaaacagagcctcgctctgtcacccaggctgcactgcaatggcccaacctctgcctcccaggttcaagtgattctcctgcctcagcctcccaagtagctgggattacaggcacacgccaccacacccatataatttttgtatttttaatagagatggggtttcaccatgttggccaggatggtctcgatctcctgaccccgtgatccgcctgcctcagcctcccaaagtgctgggattacaggcatgagccaccatgcctggccttatttttttatttttagtagagatggggtttcaccaagttggccaggctggtctcgaactcctgacctcaaatgatcaccccgccttcgccctccaaagtgctgggattacaggcatgagccaccgtgcccagcctacacgtatgcagatacacacaaatatacacacacactgaaacatgcatgatggtgtaatagggcctaaattattgctgtgtggctattcctaatcttgcccctttctcctggtttctaaggaacatcctcttctgggccagctcccaggttctccttgttgcacagaaccaaactaattcactaataagagcaggggaaaaaaaaaaaaaaaactaagctggacatggtggctcacgcctgtaatcccagaacttcgggagactgagccaggacgatggcttgagcccaggagttcgagaccagcctggacaacaaagtgagacactcatctctaaaaaagaaaaaaaaattttttttttaattagccaggcatggtgacacgtgcctatagtcccagctacttagaggctgaggcaggagaaccacttgagcccaggagtttgaggctgcagtaagctataagggtgccagtgcactccagcctagatgacagcacaagacctcatcttaaaaaaacagaaaaacagacagggtgtgatggctcacgcctgtaatcccagcactttgggaagccaaagcgggtggatcacctgaggtagggagttcaagaccagcctgatcaacatggagaaaccccatctctactaaaaatacaaaattagctgggtgtggtggcacatgcctgtaatcccagctactagggaggctgaggcaggagaatcgcttgaacccagaaagtggaggttgtagtgagctgagatcgtgccattgcactccagcctgggcaacaaaagcgaaactccgtctcaaaaaccaaaaaaaaaaaaaaaaaaaaaaaaaaacagaaaaacaaaacaacaacaaaactaaagaggcttgaggccaggcatggtggctcacacctgtaatcccagcactttgggaagctgagccgggcagatcacttgaggccaggagttcaaaaccaacctagccaacagggcaaaaccccatctcctctaaaaacacaaaaaattagccagacgtcatggcgggcacctgtggtcccagctacttgggaggctgaggcaccagaatcacttgaacctgggaagcagaggttgcagtgagctgagatcacaccactgcactccagcctgggtgacagagcgagatcccccatctcaaaaagaaataataaattattgttttctaaaccactaaattttagggttggtttgtgatacagcaacagatagccaaaatactagcagaaaagactctttggcttttgtcttatttctgcctggaatatgaacacaattcttgggatgcagccaccatcctgcctccacgaagaagaaaaccgcccataattaaaatggtagagcaggaagctagaagcctagttccttgatggcatccttgagcatctacagcagcctgaatagctgacccctggacttctttttaaacatgtgggaaaattaaccccttttatttaagtcattgcttgttggagtttctgtacttgcagcccagtgcaatcctaacactgagtaaaagtttgaagcagttttcattatattttggttgccaggctgtatccctatgactgggatactgcactgacagtgggccatatggaaccccagttatattgaggttacctatgtaggtactcaggcatgtacatgttaaaacacacatgcacacacatatgtgcatacacatacaaataacatataaacaaacacacatgtacaaatctatactcatacatgcaaatgctctcatatatacatacaagcacttgcatttacatgtcatctacacgtgcgcacacttagaaacatatacacacgtttcaggtaatgtctgggatcaggctgggaatctaaggttctatgagtctctagaaggactaatactacttcaccttcacactcacagaaggcccttccgggccgggcatggtggctcacccctgtaatcccagcactttgggagcccaaggtgggtggatcttgaggtcaggagtttgagatcagcctggccaatgtggtgaaaccctgtctctagtaaaaatacagccgggcgcggtggctcatgcctgtaatcctagcactttgggaggccgaggcaggcagaatgcctgagctcaagagttcaagaccagcctgggcaacatggtgaacccccgtctctgctaaaatacaaaaaaaaaaaaaattagtcaggcatggcggcgtgcacctgtagtcccagctactcaggaggctgaggcaggagaattgcctgaacctaggaggcggaggttgcagtgagctgagattgtaccactgcactccatccagcctggcaacagagaagactctgtcccaaaaaaaaaaaaaatacaaaaattagtctattaaaaatacaggcgatggctcatgcctgtaatcctagcacttcaggaggccaaggtgggcggatcacctgaggtcaggagttccaaaccagcctgaccaacatggtgaaaccccatctctaataaaaatacaaaattagctgggcatgttggcaggtgcctgtaatcccagctactcagaagtctgaggcaggagaatcgcttgaacccgggagaaggggaccgcagtgagccaagattacaccactgcactccagcctgggcaacagagcgatactccgtctcaaaaacaaaaacaaaggctcttttttagagcatcggcaagtgacctgtgaatcaccagtttttgcctcatgggggcaggcaagaggtgtggcatcgagtgagaccaagagatttggatgctggacgttaaccagccctcccagccaatgttgggcatttgcttggcattgaacctaggctgtcactaggacccacagcccaagcttgtaatgcatatagcagttaagcatcacctccaacaatgcatatcccacttgaccaaatatgctccatttagccaccaccatcactcaggtatcttgcaccttccaaagcagaaaggactaccaggattgaggcaagtgccaccctttctggttgtgtgatctcaagtaggttacttcccctctctgtcctcatctataaaatggaggtgagccgggaacgatggctcatgcctgtaatcccagcactttgggaggccgaggcaggcagatcacctgaggtcagcagtgcgaaaccagcgtggccaacatggtggaaccccatctctacaaaaaatacaaaagttaggcagggcacagttgcttacacctataatcccagcactttgggaggctgaggcgggggaatcacctgaggtcaggagttcgtgaccagcctgaccaacatggagaatcccgtctctactaaaaatacaaataattagccaggcatggtggcaggcgcccgtaatcccagctacttgggaggctgagggaggagaattgcttgaacctggaaggcagaggtttcagtgagccaagatcatgccattgcactccaacctgggcaacagagtgagactctgtcaaaaaaaaaaaaaaaaaaaaaaaagttagccaggtgtggtggtgggcgcctgtagtcccagctacttaggaggctaaggcaggagaatcacttgaacccaggaggcagaaattgcagtgagccaagatctttgcaccactgcactccagcctgggcgacagagcaaaactctggctcaaaaataataataaaataaaataaaatggaggtgaaataataggactttgcccattgggcctctgtgagagctaaataatattgcacagggaaagcactcaacacagtgctgggtacacagtaaacactcagtaaatgttaggtggtttcagtattatcaatgaactgttaaaggctgctcagatgtgaaggatgtaaccttccatggccctgataaaaaggttaccagacatctcagagctccagcagagtgggaagagacgagaggatcagtgagtccaacaacctcatctcacaatggagaatctaaaggtcagtgaggaaaagggcctagttcaaagaggaccaggactggaacgcagggttcttcctcagaccaagttcatccccagatgtgagctgcccagaggaagaagtgagaagcaaagcacaccatcatctccatggcttcactcaggcttccagtcaatctattttttaagcacctactatgtcctggcattgtgctggtcattcgtacaacacagaggtgtctttccattggtcccaccacctgacgccagggcatctgtccatctgagttgctcccaaccccagccttacctgggctccgggtcattgggggtgcacctcttcgagacatatgccatcttcaaggacatgtgtttggcctcgctgaagttccggggtgtggggccaggggaggaaggctgccgctgaaggggtgaggcaggaggtgagtcccagccgaccgaggtcccaccagtagagttcttgaaatacggtgagacgtccttcatatacttgactgattgggagagacatcagcagtcaccactgtgacatgggctcccagcacatatcacaattgtcactaatttattaagagtttaatttacgtgtcactattagacccttagtaagcaagagtccagtagtgatattaacaaattcttctaagttaaagtctctgacagggcagtggagcagaaaatactgtatcccttctctctatccctatatagagatagggcccgcctatatcccttctctcattttccccatggttaatagacatacagccacctggaagaaagactctatttcccagcctcctttgcagtgaggtgtggccatgtgacttttttttttttttttttgagacagtttctctctgtcacccagactagagtgccatggtgtgatcacagctcgctacagcctcaatctcccagatcaatcaatcctcccacctcagctccccaagtagctgggtctacaggtacgcactaccacacccagctattaattttttgtagagatggggtcacgccatgttgctggtcttgaactcctagacagtgtatacaagaaggtggttacaagactttcccaggctgggcatgttggctcatgcctgtaatcctagcactttgggaggccaaggcgggcagatcatttgaggtcaaaagtttgaaaccagcctgaccaacatggtgaaaccccgtctctactgaaaatacaaaagctagccgggcgtggtggctcgcacctgtaatcccagctactggggaggctgaggcaggagaatcacttgaacccgggaggaggaggttgcagtgagccaagattgtgccactgtactccagcctgggtgacataacaagactctgtctcaaaaaaaaaaaaaaaaaaaaaaaaaaaaaagactcccaggctgggcatggtggctcatgcctgtaattccagcactttgggaggccaaggcagtgtggatcacttgatgtcaggagttcaagaccaccctggccaacaaggtgaaaccctgtctctactaataatacaaaggttagctgggcagggtggtgcatgcctgtaatcccagctactcgagaggctgaggcatgagaatcacttgaacatgggaagcaaaggttgcaatgagccaagattgcgcactccagcctggacgatgaagtgcgactgcctcaaaaaaaaaaaaatgatgactttcccaagaccttgtctctcttctcccaacaaggatataccctctgtgggtgcctgatgcctgctagcccgtgggcagcctctcttcctctgctctcaaccacacctgctcccagggccatctggcttgctagctatctgacgtctgcagtcaaagcccagccaacgtgccctgtgagtggacagcccaggaaggagttaggaagtaattcttggcccacctccctggaagaaccagataagaagctatttctgtcgcaggagatgcctctgaggctcagataggattcaaagcaaatggaggcaaataagagggagttacaaaccctattggggttgggatagaagcaatgttgaaagaaaccagggtcaggtttttttgggagaagcaagcctgggtctgacttttggggactaggactcaaatgacttatcatcactgtagcaacgacttaccccaggactgactattggattatgtctcaaagggcagcagaagtgggacatatcacagcctacttgacagccaaaaaccatctcccctctttttcctttgctaagagaaccctgagccctagaggctcagcttctccccagcttagagggagaatcttgattggtcaaatcaaatcatgatcattccatcctttttgcttgtgattggtttagaaaggggcaaatgatacagttctggccaatgagatgtgaggaaaaaaacactgccttccttttctcctcctttagcctttcaaagttgctgggagggagcttgttcctagtgcaacgacagccactttttttttctttcttttttttgtgacagagtctcactctgtcgcccaggctggagtgcaatggtgcagtattggctcactgcaacctctgcctcccgggttcaagcgaatctcctgcctcagcctcccaagtagctgggattacaggtgcgtaccaccacacccagctaatttttgtatttttagtagagatggggtttcgccatgttggccaggctgatcttgaattcctgacctcaggtgctccgccggcctcagcctccaaaagtgctgggattacaggcatgaaccactgtgcccagcctactttttgaccacaaagtttgggatccacacattgaggatggtgaagcagaaagatggagagacctgagttttcgatgataccatgagcccctaaattaatcttccctggagccatgctgtctcaagatgttcgggaggataacacattttctttgatgtttaaacctcattgaattggattcctgttacttgcagtcaaaagcatcctgacaaatacagcccccaatggtgcaactgctacatctccttgctacaagtggccacgtcctgctcaaagccctgctctgcctcccctgcaccctttgcctaacttcaatgccctctaggacatgggccctgcccacaggtcctgtcttcctccctggcttcacttcttgccatatccctaatctcaccctctggtccaatcacactaactactcagaggctgtatgagcttccaaacttccacactattgaaaatgcagttcccggccttgtgcggtggctcatgtctgtaatcccagcactttggtaggccacagtgggtggatcgcttgagctcaggagtttgagacgagcctggccaacatggtgaaaccctgtctttactaaaaatacagaaaaaaattagctgggcgtggtcgtgggcacctgtaatcccagctacttgggaggctgaggcaggagaattgcttgaacccgggaggcggaggttccagtgagccaagattgcgccactgcactccagcctgagggacagagcaagaccccgtctcaaaaaaaaaaaagaaaaagaaagtaaaatttaaaaaaaaattagccaggtgtggtgacacatgcctgtgattccagctaatcaagaggctgaggcaggaggatcgcttgaacccagcaagcagaggctgcagcaagccatgattacgccattgcactccagtctggtaacagagtgataccctgtctcaaaaaaaaaaaaaagagaaagaaagaaaatgcaattccctctggagtcagatgctcttggatttgaattccagctccagcactgtctaactgtgtaaccatggacaaggtcatttacctctctgggcctcaatctgctagtcagtaaaagatgaatagggctgggcacagtggctcacgcctgtaatcccagcactttgggaggctgaggcgggaggatcacctgaggctgggagttcaagaccacctggccaacatggcgaaaccctgtctctactaaaaatacaaaaattagccaggccatggtagtgcacacctgtaatcccagctactcaggaggctgaggcaggagaattgcttgaacacaggaggcaaaggctgcagtgagccaagattgtgccattgcactccagcctgggcaacaagagtgaaactccgtctcaaaaaaataataataaaaataaaaaataataaaataataaaaataaaagattaataactacagccagacatggtggctcacgcctgtaatcccagcactttgggagcccgaggcaggcagactgcttgagcccaggagttcaagaccaggttgggcaacatagcaaaaccttgtctctaccaaaaacacaaaacattagccaggcatggtagtgtgcgcctgtagtcccagctactcgggaggctgaggtgggaggattgcttgagcccaggaggcagaggttgcagtaagccaagattatgccactgcactccagcctgggcgacagagcaagaccctgtctccaaaaaaaaaaaaaaaaaaaaaaaagtctgcctcagagagatgtcaggattaaataaaatgttgtaaggcatgtggtgagtattaaggactcaagaagcaggtgtttctcacttatcagcctttcttgcccatacttcctaggtctccgattctgtgtgttagggttgtctcctccacaaaactgggaactcctaaaagaaattgccgggcacagtgcctcacgcctgtaatcccagcacttgggaggccgaggcgggtggatcacgaggtcaggagatcgagaccatcttggccaacgtggtgaaacctcgtctctactaaaattacaaaaattagccgggcatggtggcgtgcacctatagtcccagctactcaggaggctgaggcaggagaatcgcttgaacccaggaggtggaagttgcagtgagctgagatcgtgccattgcactccagcctgggcgacagagcaagactctgtctcaaaaaaaaaaaaagaaaagaaaaagaaagaaactgggcttgctcttcaaacccagagttggctgggcagtagctcacgcctgtagtcccagcacttggggaggctgaggcaggcagatcgcttgagcctaggagtttgagagcagcctgggcaacatggcaaaaccctgtctctaccaaaaatacaaaaaactagctgggcatggtggtgtgcatctgtagtcctaggtacttgggagggtgagatgggaggctaaggtgggaggcttgcttgagcccagaaggttgaggctatagtcagcctggataacagagcaagacccatttcaaacaaaccaaccaacccagaatcagtgttctgtgaatggaaaaatgaatgccagggcaggacaggctcatttagcaggagggaagaggtgccatagcccaggagacaggcccagctcagaggtcacctcagaagaggtgatcagatgctcagtctggatccatcacacccatcacctccgcagtcccctacgcctcactcccctgtgattgtctgtgtagggtctgtgtccccaactaggctgagagcactttgagggcagggacctggtctgactcttctctgtgtccccagaatccagcagagatctcatacgctacatgctcagcaaatgaacatttgtcaactttgaagccagagaaactgccagatcccctgctcgcccagccatcccagatctgggtccccctcctttcccacaggaacatgctataaatggacagcataccagctgatgccagaatcagggcttgcatttcacaaaccaagtggcctgtcccagagtgggggtggggtcctgggggccccggagtgtggccataaatagcccaactctgaggcctcctcccctctctgatttctgcctgagtcacccgacaaggcagggtggggctgccaaagcctatggcctagagagctgagggcacgaccacagccctgtggccagcattctcgagactccaaagataggcccggccagtgcccccaccctccccagccaagcccctggcctgggagcctgataagcagtgacacatgggcccttcctcctcagggaagctgaggcacctataaacagaggccccaatttccagggagctccagctctgccaaggagggaagccaggatctggctctggccccaaagagccaggaatagattccactggaaacacatggaagagaaacagggcaggatcactcatcaggcccagtataagtggactgggggtcacatatgcgttgctgagagaagggaacacatctgtttgggcaacaggatctccagtacttatcccagtgcttaataaatgtctgtgactgaatgtcctggctgaagggaagcctgtcctctaagctcaagctgttccttgtctgttcagtgggtggtcatttacttaccgctgcttgaaattagatgatagagccatttgtttactagcccatggcctttctcccctaaccagaatgtcagttcccggagagcaggggctgccctgttttccagttcactagggtatcctcaccatcaagaatagtacctgacggccgggcgcggtggctcacacctgtattcccaacactttgggaggccgaggcgagtggatcacctgaggtcgggagttggagaccagcctgaccaacatggtgaaaccctgtctctactaaaaatacaaaattagctggatgtggttgcgcatgcctgtaatcccaactacttgggaggctgaggcaggagagtggcttgaacgtgggaggcagaggttgcagtgagccaagattgtaccattgcactccagcctgggcaacaagagtgaaacgccatctcaaaaaaaaaaaaagaaagaaagaaaaaaaaagaaaatagtacttgacatataccaagtaagcagtaaaagaaatctgggccaggcacagtggctcacacctgtaatcccaggactttggaagccttaggtgggaggattgcttgagcccaggagtttgaaaccagcctgggtgacatagggagaccctgtcttgaaaaaattaaaaaaaaaaaaattttgagacagggactcactctcacccaggctggagtgcggtggtatgatcacagctcactgcagtcttgacctcctaggcttaagcgatcctcccacctcagccttccgagtagctgggatcagaggctcatgttattatgcctggctaatttttttattttttgtagagatggggttttgtcttgttgcccaggttagtctcaaattcctgggctcaagcaacccacccatctcaacctccaatgtgctgggattacaggtttgagccaccgtgcctggcctacaaaaaatttttaaaaactaggccgggcacagtggctcgtgcctgtaatcccagcactttggggggccgacgcgggcagatcacaaggtcaagagattaagaccatcctgactaacacggtgaaaccccgtctctactaaaactacaacaaattagccagaagtggtggcacacgcctgtagtcccagccactcgggaggctgaggcaggagaatcgcttgaacccaggaagcagaggttgcagtgagccgagatcacgccactgcactccaccctaggtgacagagcgagactccatctcaaaaaaaaaaaattagccgggcatggtagagcacacctgtagccccagctactcaggaggctgagatgggaggatcacttgagccagggaggtcaaggctgctatgatcatgcaactacactccggcctgggtgacagaacaagaccctgtatctataaataagtacgtaagtaaataaaagaaaaaaatgtgttagatgaataaacactgaaagccctggggcttctcagtgtggagcaaaaacattgaaagtgggtctggggccgggcatggtggctcacacctataattccagcactgtgggaggccgaggcagggggaatcttttgagcccaggagttcaagaccagcttgggcaacatagcgaaaccccatctctactaaatatacaaaaaattagccaggtgtggtagtgtgcagctatagtcctacctactagggaggctgagatgggagaattacttgagcctggaaggcagaggttgcagtgagccatgattgtgccacagcactccagcctgggccacacagtgagaacctgtctaaaacaaaaaggaaagaaagaaagtgggccctggagtgaggcaggcttgtaataacgtccttgctctgtgaccttgaacaagtgacttgacctctgcgagcctctgtttccttattttaaaaatggaagggccgggcacactggctcccgcctgtaatcccagtgcttcgcgaggtcgaggcgggcagatcaactgaggtcagaagttcgagaccagcctggccaacatggtgaaaccctatctccactaaaaatacaaaaaaaaattagccaggcatggtggtacatgcctataatcccagctacttgggaggctgagacaggagaatcgcttgaatcagggagacagaggttgcagtgagccaagatcgtaccatggcactccagcctgcgtgacagagcaagactccgtctcaatcaatcaatcaataaaacattaaaaaaaaataaaagtaaaaatagaagtaaaatatatctactttaaagggtattaaaagattcagctgggccaggcgcagtgactcacgcctgtaatcccagcagtttgggaggctgaggtgggcagatcacctgagggcaggagttcaagaccagcctggccaacatggtgaaaccctgtctctactaaaaatacaaaaaaattagccaggtgtggtggcacacgcctgtaatcccagctacttgggaggctgaggcaggagaatcgcttgaactcaggaggcagaggttgcagtgagccaggatcgccccactgcactccagccagggtgacagagcgagactccttctccaaaaaaaaaaaaaaaagattcagctgcaggttgggcacagtggctcatgcctgtaatcccagcactttgggtggccgaggcgggcggatcacttgaggtcaggagttcgagaccagcctggccaacatgatgaaacctcgtctctcctaaaaatacaaaaattagtcaggcatggtggcagacacctgtaatcccaactacttgggaggctgaggcaggagaatcacttgaacccgggaggcagaggttgcagtgagccaagatcgtgacattgcactccagcctgggtgacagacatctcaaacaaacaaacaaaaacaaaaaaaaagatttgtctgggctcagtggctcacacctgtgagcactttgggagttcaaggcaggacgatcgcttgagcccaggagtttaagagcagcctggccaacatggcaaaactccgtctctaccaaaaatacacaaaattagccaggtgtggtggtgcacacctataatcccagctactcaggaggctgaggtgggaggatcacttgagcccaggaggttgaggctaaagtgagctgtgattgtgccactgtactctagcctgggtgacagagagaaaccctgtctcaaaaaaaaaaaaaaaaaagccaatttaaaaataaataaataagtgaaagattcaatacctgtaaagcaccttctcctgcctggcatagaacagggctgtctggagatagcagtgtggttatgatttctgctgctgttcctagtgtgacagtataaggggataggcatgtaatgtggtgacaggcagacaaggatttgaatccaggccccgtaatatcacttgcatgaggcaaggtctctctgagcctcagtttctttgcctatataatgggcactgatatgtcaaccctcaacttgaacttgaggattcaagttccagctgcccacccatccacccaggatggtgtgaagaggacttgggattccaacaggccctggaagggatgacctttaaggtcttgctggtctagcaaggctgaactataaatagtccccagactctggcaggccctataacagggatgaccagcagagcccaggggttgccacactttgggggataaaatctcaccttaccacacccttgagtagtacaggggttacaacctatacaaaatcccaaaagcatgtgacccttttgacctaacagcaacccttccaggaaccacccttcagatgagtgctcacaggtgcacagaaggcttatagcgctattgtccatcctgcaagaggctagggacaacttgaatattcatgaataggggctgctaaaaacaagatgtgaactccctgactggcagacactcactactcagtcttgttcatagctatatccttggtgcctgcatctagtcctggcacagagcaggggctcagtaaatatatgttacatgaataaacaaatccatgggatttttttttttaatttgtagacatggggtcttgctatgttgtccaagctggagtgcagtggctgttcacaggtgcatcatagtgcactccggcctcgaattcctggcctcaaacaatcctccaacctcagcttcaggagtaaataggactacagatgtgtagtcctccagcccaataatgggacaccacataaccattaaaaagaatgaggggccgggcacagtggctcacacgtgtaatcccagcactttgggaggccgatggtgggcagatcacctgagctcagtagttcaagaccagcctgggcaacatggcgaaatcccatctccacaaaaagcacaaaaatttagctgggtgtggtggtgtgcacctgtagtcccagctattcaggaggctgagatgggaggatcgcttgaatccaggaggtcgaggctgcagtgagcaatgattatgccactgcactccaacctgggcaacagagtgagacactgtctcaaaaaaattataaaataaaaaatattaaaaagataaaaaagaatgagacttacatgttctcaacttattacgtgataaaagcaaatatggaaacttactggaagaaaatgtgtgaaagtatcaacactggttatctctataagatgatccctttacactctcgttggtaattttttttttttaagagacagtgtcttgctttgttgcccagattagagtacagtggcataatcatagtttgggtacagccttgaactcctgggctcaagcaatcctcctacccagcctcctgagtagctgggattacaggtgcacaacactatgcccagctaatttttaaaaaattttttggccaggcacagtggctcacgcctgtaattccagcagtctgggaggccgaggcaggtggattgcttgaggtcaggagttcaaaaccagcctgaccaagatggtgaaaccccatccctactaaaaatacaaaaattagccaggtgtggtggcaggcgcctataatcccagctacttgggaggctgaggcaggaaaactgcttgaacctgagaggcaaaggttgcagtgagccaagatcgtaccactgcactgcaacctgggcaacaaagcaagactcggtctcaaaaaaaacaaaaattttttgtaggccaggcacggtggcttatgcctgtaatcccaggactttgggaggccttaggcagatcacttgaggtcaggagtttgagacttggccaacatggtgaaaccccacctatactatatacagaaattagccaggcatggtggcacatgcctgtgatcccagctacttgagaaggtgaggtaggagaattgcttgaacccaggaggtggaggtttgattgagccaagatagtccactgcactccagcctgggtaacacagtaagactccacctaaaaaaaaaaaaaaaaaaaaaaaaaaaaaaaattgggtcaggcatagtggctcatgcctgtaatcctagcactttgggagtccgaggcaggtggatcacctgaggccaggagtggcgaaaccccatctctactaaaaatacaaaaattagccagatgtgttggtgcgcgcctgtaatcctagctactcgggaggctgaggcacgagaatcgcttgaacccaggaggcagaggttgcagtgagccgagatcatgccattgcactccagcctggccaacaagagagaaactccatctcaaaaaaacaaaaacaaaaacaaaaaaattgtagagacgaggccttgccatgttgcctaggctagtctcgaactcctggtctcaaggaatcctcccacctcagcctctgaaagtgctggaattataggcatgagccacttatttttttttcgagacagggtctcactctgtcacccaagttggagtgcaatggcacaatctcagctcactccatcctccacatcccaggctcaaatgatccttcagcctcagcatcccaagtagctgggactacaggaatgtgccaccatgcctggctaatttttgtaacttttttttggagagacagggtttcgctatgttgctcaggctaagctggatatttttgaatgagtatgtattactttttaaattttctaaaaaatctagtttatttttcaaaaatataccaccacataccaagccatacaagccatagttcagagataatgctcgtatcaactcggaagcctagattcagggttctagaatcttagtgatgggagaaagcagtacttattgagcgcctactatatattggggccaagctcaactctctcgaacacaccttcaccttatttcaccaatttgatgagatgaattaatatccttatttatgttcatttttattacttttttctttttttttttttttttttgagacggagtctcactctgtcgcccaggctggagtgccgtggcgtgatctcagctcactgcaacctccacctcctgggctcaagcaattctcctgcctcagcctcctgagtagctgggactacaggcacgcgctaaattttgtatttttagtagagacggggtttcaccatgtttaccaggctagtcttgaactcctgacctcaggtgatccacccgcctcagcctcccaaagtgctgggataacaggtgggagccaccgcacccagccatagtatctttatttaatgggtgagtaaactgagtctcagagaagtgacataacctgtagtgcagataagtatttaagaaaatgagttttcgccgggcgcagtggctcacacctgtaaatcccagcactttggaaggcagaggagggcggatcacatgaggtcaggaattcgagaccagcctggctaacatggtgagatctcatctctactaaaaatacaaaaattagccaggtgtggtggcacatgcctgtaatcccagctactttagagactgaggcagaagaatcacttgaactggggaggcgcagattgcagtgagccgagatcgtgccactgtactccagcctgggcaacagagcgagactccgtctcaaaaaaaaaaaaagattatgggttttcagccaggcacactggctcacacctgtaatcccagcacgtcaggaggctgaggcaggagaatcacttgagtccaggagtttgagaccagcctggacaatatagtgagaccctgtctctacaaaaaatcaaaacaataatagctgggtatggtggcacatgcctgtagtcccagctactggagaggctgtggtgggaggatcacttgagcccaggaagtcgaggctacagtgagccgtgatcatgcaactgcattccagcctgcatgacagagtgagaccctgtctcttacaaaatttttgtttttgattaaaatatatatatatgagttttggcatctgaaagacttgagctcatattccatctctgccatactgtgaccttgggcaagtaatgtcacctctctgagcttcagtgttctcatctatacaatgaacaatgtacctaattcacagggatgacattgaggattcaattaaataacatagggaagggccgggcacggtggctcacacctgtaatcccagcactttgggaggccgaggcgggtggatcacctgaggtcaggagttcgagaccagcctggccaacatggtgaaaccccatctctactaaaaatacaaaaaattagccaggcatggtggcacgcgcctgtagtcccagctactcgggaggctgaagtaggagaatcgcttgaaccagggaggtggaggttgcagtgagccgagatcgtgccactgtactccagcctgggcaatggagcgagactccatctcaaagaaaaaaacaagcatagggaagggacttagcacagtaggtgctcatggtgttgagcacagtgtggatgctcaataagcagcagatgctaccatcctgattattatcactattatttcctccaccaccagcagcagccagggtcacacagctcgtcagggccagaacctgcctacagaggcccacaagacattttaatcaaggtccggggaacaggccagggctggattaagccaagttttgtttgtggggagtcacatggtccaaagctatgcgtgtgcacagccaagtaaacttttccttgagaacaatggtcagaacaacaggtctttgcggccatgggagaactgaacaggagttccattcatgccctcttcctgggacaggggtccctccagcatctctggggcacagcatgactcagctaagttgaaacagggtggccccaaattagctacatccagaatgacatcccgcttttgacagtggtgatgcatcaagccagatcaaaggcaggacacctggcagtggccatcttcctgggaagagccagtagggagctggccttagagttctgaggactcagaacagaaaagctcaagagtcagtcaagctcagcatgattctcaagtcccatcttaaacatttaggaaagtcaacagcaattgaaaaggtgaaaggtaaagtagaaagggtccaagatataccccactgatcagtctccaaacactcaccaagatctaatgtatgttgggctcagtgccagacctgggggctgagagacaagctacatgtggttcctgccctcaaacagcttccagtttactaaagaaaacaataacaggatcaggcgcagtggctcatgcctgtaaccccagcactttgggaggactgctagagcccaggagttcaagactagcctggacaacacagggagaccctgtttctattaattttttttaattaggcaggtgtggtagcacatgccgtcgtcccagctacttgagaggctgagataggaggatcgcttgagcccaggagttgaggctgcagtgagctgcaatcacacctctgtgctataggctgggcaacagagtgagatcctaaataaataaataaaagcctgatctctatgagggctataccttccttactttatataaagcactaaaattcactttattaattttttttttttgagatagagactcactctgtcacccaagctggaatgcagtggtgcaatcttggctcactgcgacatccacctcctgggttcaagtgattctcctgtctcagcctcctgagtagctgggattacaggtgcctgccaccacgcccagctaatttttatatttttcgtagagatggagtttcaccattttggccaggctggtctcgaactcctgacctcaggtggtccacccacctcagcctcccaaagtgctgggattacaggcgtgagccaccttgcctggccttagtattattttttgttttttgtcgggtttttcttttttcttttttttttgagatggagttttgctcttgttgccccaggctggagtacaatggttcgatcttggctcactgaaacctctgcctcctgggttcaagcaattctcctacctcagcctcccgagtagctgggattacaggcgcgtgtcaccatgctcagctaatttttgtatattattagtagagacggggtttcaccatgttgcccaggctagtctcgaacccctgacctcagttgatctgcctgcctcagcctcccaaagtgctaggattacaggcatgagtcaccgcgcccagccagcattatttttaatgcatgacaggctcactgttgtcacagtcctgccagccacactggaatgggaggagggaagggtgttttccttgaggctgtccctccctcttcccccaggcctggccttcaagggcccaggctggccctggcttgaggtctgcacacacaacgggcctctcgaagcagcggacagacacttgttggctgccaacttgggcccagactgtggtcacaaacacacccctctggctgagaacaggatcaggacatttctgcaaacccctgacctagtagaagaaatgttctaggaggcaggttggggttgctgaggctcagctgagcccccaacttaggccagggaagtaaggctctagctgacacctggagtttgctggtaatgcttgttctcccaggacatcctcaggggattcactatccactgagctggaaaaatatccagttgccttgccaagttcacatccaaaggacaggccatccttccatggccccttggaggcgtcctcagtaatgggatgtgagtggggaaatgttgaacaatgtggtcagtgattcaactccggggaaacctaggcccagagagggtcccaggaaccctggctgctccagactggtgcaactgccaggcccagaccttctccactccccaaagtctcaaggaccagccacagcccagcatcctcctatccttcagacctctctgatcactcttgccattcagagattcctgactccagtgccttccaccactcctcctcccctctttgtgctatcttgagtggaatgacctccttccatgagatcttgggccaggagaataggtcgaaaaagacttcaactaaggaaaagtggggaaaaacatgaaggccacattcttctttctcttacccaggccataggcagggttcaccaaggaatgatctcgtcctgtgaaacatctcagagaatataagagcaggggcccctcagtcctgggatgatacacatgttacttctctactgcatctgtagtagacattgctaatcaattccagctcctttctgctgagcccagacaaagcctcccaatccttccaaatatggaactcacagaaccaccagtggagctgacgcttacactcttttttttttttttcctacagagatgaaatctcactgtgttgcccaagctggtctcgaactcctgggctcaagtgatctgcccacctaagcctcccaaagtgttgggattacaggcgtaagccaccacgcctgcctggagctgccactctaaataaaagctattgatcacctctgatctagcctaacttcaataggaaaactgagtcccctagaaggcaagggtcttacccaaggccaaacagagatttattgcagagcagacaggatttcaggcaccagctttttttttttttttttttttttttttgagatggattcttgctcttgtcgcccaggctggagtgcagcggcacaatcacggctcactgcaacctccgcctcccgtgttcaagattttcctacctcagcctcctgagtagctgggattacaggcacgcgccaccatggctcagctaatttttgtatttttagtagagacggggtttcgccatgttggccaggctggtctcaaactcctggcctcaggtgatccacccgcctcagcctcccaaagtgctgggattacaggcgtgagtcacagcacctagccaccggcttttaaagagtttctgtaggccaggcatggtggctcacgtctgtaatcccagcactttgggaggcccaggcaggcagatcactgaggccgggagttcgagaccagcctggccaacatggcaaaaccctgtctctactaaaaatacaaaaattaaccaggccgtggtggtgcacacctgtaattccagctacagaactgaggcagagaatcgcttgaacctgggagaaggaggttgcagtaagctgagatcgcactactgcactccagcctgggcaacagagtgagaccctgcctcaagaaaaaaacacagtttgtgtagaggagatagtgtttatgttttgtctaccctaccacatggtgagctccttcaggagaggccctgggtgtagtttagcttctgaccttaatatacacagcaggcacacagtagatgtccatgaatgtctcttggcttagtgaggaggaatgcatgacatgagttagagggaaggcttgagtattcactcctaaagtcagaagatgcttcaaggtcacacatttacagatactaccttctcaaaacgacatacatgggaacccagatagatacatttttaatctaaagatgaggaggtgggccgggcgcggtggctcacgcgtgtaatcccagcactttgggaggccggggcgggcagatcacaaggtcaggagatcgagaccatcctggctaacacggtgaaaccacatctctactaataatacaaaaaattagccaggcgtggtggcgggcacctgtagtcccagctacttgggaggctgagcaggagaatggcgtgaacccgggaggcggagcttgcagtgagccgagatcccgccactgcactccaacctgggtgacagagcaagactctgtctcaaaaatataaataaataaaaataaaaaataaagatgaggaggtgaggggacctccgtgtgaatgtggatttgaattgtgtctatagcagaaattttaccatagactaaactttcaaacaacagaagctaaaagagctttcaagtcaactaaaatatgacatttcgatgaatgtcagtggtttcaaaccgcattgctgactataaatatcaaagtaatgaggcatgtggggaaagtctcttatatccatatcatttatgtggcattctattatttaactttgccattaaaatatgattgatacacttaagcttctaaggatcaacactctagagtcagctttttttaagtatcaaaaaaatgcatctagactgggcactgtggcctgcaatcccagcactttgggagacttaggtgggaggatcccttaagcccaggagttggagaccagcccaggcaacatggtgaaaccctgtctctacaaaaaattggctaggtgtggtggctcacgcctgtaatcccagcactttgggaggccgaggcaggcagatcacgaggtcaggagttcgagaccagcctggccaatatggtgaaaccctgtctctactaaaaatacaaaaaaaaaattagccaggcgtggtagtgcgcacctgtagtcccagctactcggaaggctaaggcagaagaatcgcttgaacctggaaggcggaggatgcagtgagccaagatcgcgccactgctccagcctgggcgacagagtaagactccatctcaaaaaaaaaaaaaaaaaaaagctaggcgcaggggctcacacctgtaatcccagcacttttggaggctgaggcaggtggatcacaagctcaggagtttgagaccagcctggccaatatggtgaaacctcatctctactaaaaataaaaaaattagccgggcatggtggtgggtgcctgtaatcccagctactcaggaggcggaggcagaagaattgcttgaacccgggagacggaggttgcagtgagccgagatcatgccactgcactccagcctgggcaacagagtgagactccatctcagaaaaaaaaaaaaattaaccaggtgtggtggcatgcatctgtagtcccagccactcaggaggttgaggtgggaggattgtttgagccccggggggtggagggtgcattgagccaagatcatactactgtactccagcctgggtgatagagcaagaccctgtctcgaaaaaaaaaaaaaacaagaaaaaaaaatgcatccatggcatttaaatagatatacctaaaatataaaataaaactttacattttattttctttatttaaattttattttattttatatctgggtcaaccaaggaccgagaacctatttgcttctgtggcctcttggacactcctttagggaaaccaaggcaacccaccaggatttgggcctgggactcaactcagcagcttctctggccgtgttattctccatcagcccccgccacctccctgtgcctgttctgggccataagccagagacacattcctcaggcccccacggggcttccagagctgacagagtttgaggaaagggctgagcaaagcagaaacctcttgagagacatggcacaagatggtcatgggacaacctcagcaggaggcgtgtaacaactgatggggaaaccgaggcccacagagggcaagggtcccacccaagaccacactgtgagggaacagtggagaaagccattcaaccaaggttcctccacaaaactcctctctgatcctggctggaaggatttgatgtcctactctataaaagccaaggcctctgggcgtggtggctcatgcctgtaatctcagcactttgggagactgaggtgggtggatcacctaaggccaggagttcaagactagcctggccaacatggcaaaaccctgtctctacaaaaatataaaaattagctgggcatggtgacgcacacctgtaatcccagctacttgggaggctgaggcaggaggatcacttgaacccaggaggcagaggttgcgatgaaccaagatcatgccactgtattccagcctggacaacagagcaagattccatctcaaaaaaaaaataaagtaaaataaaagccaaggcttctcccaaaggaggatgggtcttggggttttaaggcccaggcactaaaagaacctgaagtcaagagctctccaggccccacaggaaagaatctgacctgccccttccccagtccgcacccctctctccctgtgtcactcaggtgctggcacactctgccatgtacatttttgccctagtcgcaacaacccagaaaggcaggagctacatccctgttttacaaatgaggaaactaaggatcagggaaatgaagtgacttgtccagggctacacagctagtgactggaagacagaaaatgcaaatcaggtctgcttggctctatgccaactctccctccaccaccccacactgtcttcaggcaggtccccaaattctgtttctgttttcagtcctgcccacctcccagcccccagtgctgggatggggccttctgaggcctgggggaggtagagaagcagtggaacacctccacccagcccctctgaaccctggaacgtcagtgcttaccctccagcaccacctccttgcctgtcttcttgaggacctgcaccgcctcatcatgggtagcagaggacaagtcttccccattcacagacaggatggcatcccccacaaaaagggcctctgtctggtcagctgccaatcccttgaagatcttggaaatgagaataggcatcttgttctcccggccgcctgcacaggtacagaaggaggacaagacttaggcagatactccaacacttgggagtcacatcaagacacaattatttctgaaggcttcccttggtgcctagcccagtgctggaaaaggcaatgggagaataaagggaatctgagaaaaatcttggaagtttgggacactagtaacactaataataaatcatttttgattaggtccggtggctcatgcctgtaatcccagcaccttagaaggctgaggtgggcaggtcacctgaggtcaggagttcaggatcagcctgggcaacatgggaaaaccccgcctctactaaaaatacaaaaattagccaggcacctgtggtctcagctactagggaagctgaagtaggaggatcacttgagcccaggaggtcgaggctgcagtgagctgagattgtgccactgcactccagcttgggtggcagaaggagaccctgtctcaataaattaattaattaaataaatcattttcaaaattcataatgctatagtttgatccctggatcttttgattaagtgctttgggtgttcaccagtgtttgtgcaacttacaaagtgcttcaatcactttttcttaaatgttttcgattttctcatgtaacccataaatatatatgcctactatgtacgcacaaaaattaaaaatgaaaataaccggacaaagtggctcacacctgtaatcccaacactttgggaggccaaggtggtcggatcacttgagaccagtagtttgagaccagcctggccaacatagcgaaatcctgcctctactaaaaacacaaaaaagggccaggtgcggtggcttatgcctgtaatcccagcactttgggaggccaaggctgccaggtggatcacctaaggtcaggagttcgagaccagcctggccaacatagtgaaaccctgtccctaccaaaaatacaaaaaattaactgggcgtggtagcggatgcctgtaatcccagctactcgggaggctgaggcaggagaatcacttggacccaggaggcggaggttgcagtgagctgagatcacgccattgctctctagcctgggcaacaaaagtgaaactctgctcaaaaaagtaaataaatacataataaaaaaataaacaaataaaaaaatatggctgggcgtggtggctcacgcctgtaatcccagcactttgggaggccaagatgggcagatcacctgaggttaggggttcaagaccagcctggccaacatggcaaaaccccatctcttctaaaagtacaaacattagccgggcatgggggcgcatgcctgtaatcccagttactcgggaggctgagtcaggagaattgcttgaaccgggaggctgaggttgcaatgagccaagattgcaccattgcactccagcctgggcaataagagcgaaactccatctcaaaaaataaataaataaataaataaatacaaacacaaaaaattagctgggcctggtggcacatgcctgtagtcccagctactcaggaggctgaggcagcagaattgcttgaacccaggaggtggaggttgcagtgagccaagatcacaccactgcactccagcatgggcgacagaacaagactccatctcaaaataaaacaaaaatacaaaaattagccaggcatggcggtgtgtgcctataattccagctactcaggaggctgaggcacgagaactgcttgaacccaggaggtggagattgcagtgagccgagatcgcaccactgcactccaccctgggcaacagagcaagactgtctcacacacacacacaaaaaggcaacaatgtgggaacccactgatacccctcaaaccggaatcaagagacaagtcggctattcctatggcctcaaaagactgctttagcaatcataatgttttacaatccaaagtccaggctggaaaccaaagccttagagtctagagattctaaaaacctgcctgaatggcatcttggatacaaaagaagctaatacattttactaaacatctttattaccaaactcttaaatgcccttttaaaataagaaatagtaataagagttcaccttagttgcacttaccaaatgccaagcactgtgctaaatgctttcaatgttgattcattgcgtctttacaataccccatcacataggtatgttcagtttcctattagggaaactgaagtgtggagggaagccccttgtccaaggtcactccactagtaagtagcgaagccagtatttgcacctaggcctccaggctccagaaccaacactattagccctaccacagacgacaagtcaggccctcagatatcacactcctggctcatccccagaatactgaagatgaagaattagtggcccagagtgggaggtcattgttccaaggtcacacaagtctggtggcggagctgggactggaacacctctcttgacgcccacacaggcccgaccgtttgcttatctgcacagagcttgaagtctaggagaggaaggggtttctatttatatctgccctcccccacctgaaactaggggcttcagttcagtttgaagctatgatcactcatggctgcctcagactaagctagactttataggaggggttaccatggcaacaggagcccagatttggatccaatggaaatacctgaagtctcctaaaagtaccctcccctccacctagaattatggagctggggagtaactttgtgtgaccttgcaaagtccctgctcctctctgagtctcagtgtgtccatctgcagaatggaattctgtatgaataagttccttcctgctttgacacactgagtgtataatttttggattcatctgttgccctatcccatgctggagattgggggtaagactggtgcccataccctcattttctcatttctcctttttagcccctcttggttggctgcctggggatctgcccttctacaggaaagaatcaacttccctgagcactctctgagggacagtagctgataattaaggttcaaatcccagcactgacactcactatgtaatcgtgggaaaatcattttaactttctgagtctcagtttcttcacctgcaatatgggaattatactccctacctttcaccacttgttgccaggatgaagtggatcatgagactagtgtcctgggcacagcacctggcacacagtggtggcattcaccaccatccccaccgcctcagccaagccaaacggtctggaggcactagtcaacagaaccagtaccagggagaccccagagggtacggtatgtattcaaggtggagacaaaggctgataccctttcccaaagcacctgctgggggctgggaccctgagaaacagatgggcaggaatagtgaacccagcagctgggggtgtgcaaggattttaacaactatgtttagttgctttgggagtatctgctggcctccatttttcctctccgctaacagcagtaattaactaggcacctacagtgtgctggtgtggtgagccctgctctcagaaacatcacaactctgtcatcctcttatacagttgaggaaacagattcagaggcgggacgggacttttgcaacctcacacagctgatcctggattcaaacacagtctggttgcaccctaactgcaccccactagcggtcagtcctgggggctgaaagctctatcctgtgcaaggtggagatagtcagatcaggagacccaaatccagctgtcagggctccctgcagccttcctgggtccttagattcctaggtccttgctggccttctgcctgtgaccccagcctgtgcctgcacccaggcctcctatccacccctgtgcttcccagactccaggcttcccctctgcacccaccttggttgcttctcagggactccctcctccctgtcccactggtgtcccggcctcaaccccctttctccacactctgctttccgggggacccctcttgtccttgatgttcatgctggttacccctcagacccccccgcctccacacagaactcccacccacgtgtccttggtgctcccacaatcttatccacacctgtgtcttccgtgccccctaaggccaccaactactgaaaccccctccaaccttggtgtgcccagtgccctccgttacctgtttcctcagaccccccttacccccagacaggaagcctccagctccatgtcctgggcgcgctgccagccccctgcgccctcggctgcccccagacaccacgaccccgcgccctcggtgtcccgcgcccacctttgatgctgatgcccagcccaccggcgtcggccttgcgcaccgtcacgcggcgccgctggagcagtagcgcctctggcagctgcgggggcccggcgcccggctccgcggcgccgttgagctgcgcgggctcctgctcccgcggagcgccgggctcgggaccagggtcgccgtcggcggggctcacggtcagcacgtcctccgccagactcagcagcacccgctgccatcgctcgccgccggcccccgagcccgccccggcgcgcagctccagcagcccggtgcgcggggcgcgcctgccggacgccatcttcgcctccgagcccccgggccgccgcgctcgccctgtcccgctttgcccagcccgctccgaccaagcgcccagggcagagggcagcgggggcccggctgggccagccgccaccctaccccggccgctgggggaggagctctgggggcggggctaccctggggtgtggccagtgctggggagggggcctcgggcaaatgcaggaggccggggcggggcccgggagccgagggccgccgtgtgggactacctagcggggtgggtcagaagggcggcggggcgggccactaagtaaggcgaaagcccgggaggcgtggtgctgggcggggcgtcagggggcggggcttcgcgtcgggggcggaacccagtgagcccgcgcagggggctcggcgctcggaatgcccatcgagggccgggactgtaactcccggacgtgggagcgcatgaaaaagagacagaaccacgtatcctggtgcgaagcactgggcatcgggctgggctgcatatggcggagggctgggctgcgtatggtagagcgttggactccaaggcttgagtttaagaggtagacaccgtctgggcgtggaggctcacgcctgtaatcccaacactttgggaggcctagatgacagcccagaagctcgaggctgcagtaagccgcgatcgcgccactgcactccagcctgggtgacagagcgaaaccctgtgtcaaaaaaaaaaaaaaaaaaaaaaggtagatgctgagccgcgagagaccttgcgggcacagttgctagttggggagctgaggaagaagttggtttcctatcggggagggcgggggatggggggtgggggtcgaggctttggtctgtgggcgtggcttatcgctggcgtggcttctaaagatgacaggccccgccccctggaggagaccgctaccgacaccgcttagggcttgggggaggtgtgggcaggatccccacttcaaaactggagggaagtttaagagattaacccctggctgtgttcacagtcgagtatagaaaagcctgaagtcccacactttgaggcctggcagaaaaaaaacagaactggtgtgtgggaagagggttgcaaggtggggctctgggtctgggcgactggagacatggtttctaatctttgctgcctctgttagctccaagtcgactttggtcccctcacgtcactgctctaggcctcaatttcctcatctgtaaaatgtggatcataataatacctacttcactgggctggtgtgaggattaaatcaatgtgaaaacacgtggtaaactgtgactccctattctatagaaataatcactttcatttagtgaatgcttactcttacctagggctggcagaatattttccaagtgttatctttacattagcctcctggagtagctaagagcacccccagctgggcacagtggctcacacctgtaatcacagctgaggtggcaggatcgcttgagccttggaggtccaggctgcagtgagctgtgattgcaccatcacactccagccttggtgacagagcaagaaaaaagagcacccctattatacagaagggaaaacttggatttagtctaattggcctaggtcacacatttatgagtgaggaagagctgcgattcaaacccaggcctgtttgacaccagtgcctgggcactgaaccactctgctagacagctgacaaatacagaggtaaagcatgattgtaatctgaaaaatccaccacatcacacagctcaactggccttcatacctgctccttgtctctatcctccattcctagctgggatatgttgagcaataaataagtaggactacaccagtgtttagcctccctgaacttttgggtaaaatcctccacataagataccatcaagaaaaaaaagagggggccaggtatggtggctcatgcctgtaatcccagcactttaggaggccgaggcaggtagatcacgaggtcaggagtttgagactcagcctggccaacatggtgaaaccccatctctactaaaaatataaaaaaattagccgggcgtggtggcagacacctataatcccagctactcaggaggctgaggcaggagaatcacttgaacccgggaggcggagattgcagcaagcagagattgcaccactgcactccagcctgggtgatagggtgagactccgtctcaaaaaaaaaaaaaaaaaaaaccaacaacaaaaaaaaggaattgttttaagttagagtggtaggtgtcaaaacaggagagacacaggttttaaaaaaagaacccagggtcttttatacatatatatatgggatgccgaggaggaatgatcacttgaggctaggagtttgagaccacttgggcaacttcacgagactccatctctacaaaataaagaaattagccaagcgtggtaatgtgcacctgtactcccagctacttaggaagctgcagcaggaggcctgtttgaggctgctgctgtgagccacaatcatgccactgcactccagcctgggtgacagagcaagaccctgtctcaaaaataaataaaagaaagtgagaggaaggaaggagagaagggaggcagggaaggaatatagcattgtatataagcattgatatcttaaaagtatgactgtgcttaaagattgtaggacagcctgaggaatttggggtaagcacttgtgataaataactacagcctacttggcttgtggaagcttcactccaatggtagagaagggaggggaggacagacctggcaggaggcaagagaccagcagggaattgaagctcctttcccaagaccaaagcctggaaccagatccttaaaagtccccccacgtactgccctgcttaaaaaagacttaatgaggcccagacaaacttactgagaaagagccctaagagagggcttctcctctgggggacagtttcctgtggatataacaggaaggaaggaagtagggaaaggagtgatgtgtgcaaaggggctaacacagaaagaagatgtagagccaaggaaacagtgacgtgtgtatgcatatgtatacgtctgtatgtgagtatgggtgtgtgtgtttgtgatcacacttgataggcagtgccaatcacctgtagctacccccaagaaccctgtagctgcaggaatgctctatccctacactgtggtcagccgatgcctctctgctgtggctcagaaattggcctcccagatagatacacataggcccggctccctgccaagccccaggcagagctcccagagaaaaccagttcactcccaaggaataggagagggggaaggggaaaaaaagggagagaggggagctgcccagcctactaaagtctctgcaagctctggccaggcgcggtggctcacacctgtaatcccagcactttaggaggcctaggcggctggatcacctgaggtcaggagttcaacagcagcctggccaacatggtaaaaccccattctctacaaaaatacgaaaattagctgggcacggtggctcaagcctgtaatcccagcactttgggaggccgaggtgggcagatcacgaggtcaagctatcgagaccatcctgaccaacatggtgaaaccccgtctctactaaaatacaaaaacttggctgggcacggtggctcatgcctgtaatcccagcactttgggaggccgaggcgggcggatcgcgaggtcaggagatcaagaccattctggctaacacagtgaaaccccatctctactaaaaatacaaaaagaaattagcagggcgtggtggcgggcgcctgtagtcccagctactcaggaggctgaggcaggagaatggcgtgaacctgggaggcggagcttgcagtgaaccaagatgtgctgctgcacctcagcctgggtgtcaaagcgagactccgtctcaaaaaaaaaaaaatctatgcataaatcctaaacaatctactgtttagttttacattttttaacatcacataaatggacatttctccttctgcttttggaagttatattctctagttgtattaagagcactctattatcttcaattacttactctcccaaattatttgctatgttgttaagtatttagcgctaaatatttttctttttatttatttattattattatttttttaagacggagtttcactcctattgcccaggatggggtgcagtggcgcgatctccactcactgcaacctccgcctcccgggttcaagcgattctcctgcctcagccttccaagcagctgggattacaggcgcccgccatcacacccagctaatttctgtatttttagtaaaaacagggtttctgcagtgaaaccccatctctactaaaaatacaaaaaattggccaggcatgttggtacacgcctgtagtcccaccttcttggaaggctgaggcaggagaatctcttgaacccaggaggcagatgttgcagtgagctgagatcacaccactgcactccagcctgggtgacagagtgagactctgtctcaaaaaaaaaaaaaaaaagggggtttcaccacgttggccaggatggtcttgaactcctgacctcagatgatccgcccacctcggcctcccaaagtgctggaattacaggtgtgagccatcgcacccagcctctttttatttagttttttattttattttattttattttattttgagactgagtctcactctgtcacccaggctggagtgcaatggcactatcttgactcactgcaacctctgcctcccaggttcaagcgattcttccaactcagcctctagagtagctgggattacaggcacatgccaccacgcccagctaatttttgtatttttgtagaaacggaatttcaccatgttggccaggctggtttcaaactcctgacctcaggcaacctgcccgcctcagcctcccaaagtgctgggattacaggcatgagccactgcacccagcctgaaggtggcaggcaaagctttctatcaaagaaggccaaatgcctcttgcccaatctttaattatctcttaaattagaatatcttactcaaatctccatgtctcttaactttctttcatatcttctctttacttttttccatactgcattctgagtaatttcttcagtgatatcttccagtttactaattctttctttaactagaactaatctactgtttatcctattctttgaatttaaaatatcaattgttacttttttatttctagaaattctactttttttttttttttttttttgagacggagtctcactctgtcacccaggctggagtgcagtggcacaatctcagctcactgcaacctccacctcctggattcaagcaattctcctgcctcagcctcctgagtagctggggttaaaggcgcatgccaccacatccagctagttttggggttttttttgtttgtttgtttgtttgtttgagatggaatctcacactgttgcccaagctggagtgcagtgtcacgatctcagctcactgcaacctctgcctcccagcttcaagggattctcctgcctcagcctctcaaatagctgggattacaggcacctgccaccacgcccagctaattttttgtattttcagtagagacagggtttcactatgttggccaggctggtctcaaactcctgatctcgtgatccacccacctcggcctcccaaagtgctgggattacaggtgtgagccaccacgccctgccataatttttgtatttttagtagagacagggtttcaccatgttgatcaggctagtcttgaactcctgacctcatgatccgcctgcctcagcctcccaaagtgctgggattacaggcataagccaccatgcccggccctacttttttttccacatctgtctgattatgtttatagtatctttttttttttttgagacagagtcttgctctgtcccccaggctggagtgcaatggcgtgatcttggctcactgcaacctccacctcccgggttcaagtgattctcttgcctcagcctcccaagttatctgggattacaagtgcccacaaccacccccggctaattttttgtatttttagtagagacgggggttttgccatcttggccaggctggtctcgaactcctgaccgcaggtgatccacccgcctcagcctcccaaagtgctgggattacaggcgtgagccaccataactggcatagtctctctattctttacccatgcttttgatacccttttgaaatgtatttaaacctatgaattgtacttattttatattatctatatagtagttcttttttgtttttattttatttatttatttatttttgaggcagggtctcactctgacgcccaggctggagtgcaatggcatgatctcagctcactgcaacctccacctcccaggttcaagcgattcttctgccccaggctcccaagtagctgggattacagacatgtgccaccactcgcaactaattttttgaatttttagtggagacggggtttcaccatgttggccaggctggtctcgaactcctgacctcaaatgatccacccgcctcggcctcccaaagtgttgggattaaaggtgtgagccaccgcgcccagcctctttttgtttttaaagagacggggcttgctttgtgatgcagactggagtacagtggcatgatcctagcttcctgcagcctctaactcctgggctcaagacaggcgagccccaaattgggccttagcctgggaaagttcttggcttctcccaggaaataattcaaaggtgagccagtggtatcagacagcaacttttattgaagcagcagcgtacagcagcagcagagggactgcccttgcagaggagggttaacacacaggcagtgtgcccagaagagtttcatatgggctgggggcagctgtatttatacccactttttttttttttgagacggaatctggccctgttgcccaggttggagtacagtggcatgatcttggctcactgcagcctctaccccactgattccagagattctcctgcctcagcctcccaagtagctgggattacaggtgtgtgccaccacacctggttcatttttttgtatttttagtagagatggagtttcactatgttggccatgaactcctgacttcaggcgatctgcccgcctcagcctcccaaagtgctaggattacagacgtgagccaccccgcccggcctagacccacttttaattatacacaaattaagaggcaagttattcagaacgttctggaaaatggacagtttctggaaccatataaggtaacttctgggccattgccatggccattgccagagcctttctaaactatcatggcactagtgggagtgtctttatgcaaatgagcagtgagggcaactagcggtcactttagtcaccatctgctgattttggctggcgtcttcactgcaccctggattgaccagtttctgctctgatcagcgggatggtgaccagtcataaccagtgcttggaaaacaaatcttgctgatctacctcaaaattcctgggttcaagctatcctcctgcctcagcctcccaaagcactgggattacaggcatgagcctatatagtaattctgattctgaagtgttggtggctctttttactttttcttttttaaaatttgttttaattggccgggcgcggtggctcatgcctgtaatcccagcactttgggaggccgaggcaggcggatcacaaggtcaggagatcgaaaccatcctggctaacacagtgaaaccccatctctactaaaaatacaaaaaattagccaggcgtggtggcaggcgcctgtggtccccgctactctggaggctgaggcaggagaatggtgtgaacccgggaggcagaggttgcagtgagccgagattgtaccactgcactccagcctgggcgaaagagcgagactccatctaaaaaaaaaaaaaaaaaatttgttttaatttactttaaatagaaacggggtcccactatgttgcccaggctggtctggaactcctggactcaagccatcctcccaccttggcctcccaaagtcccaagattacaggcatgagccactgagcccagcctttttcttaaagcaataaaagaatggctactccatagacagcagctggtggatcttttttcttcattacacatgtgtaatcttgtcaactacacagtttatatgcattctttgaggtctggtatgaagtaggttctattccttcagagaggatttgtgggtacttctgtcagatgcctgatgggacagccaacctaagagtgctttcagggccgggcgtggtcgctcacgcctataatcccagcactttgggaggccaaggcaggtggatcatgaggtcaggagtttgagaccagcctgaccaacatggtgaaacacagtctttactaaaaatacaaaacttagccgggcatgatggtgcgtgtctgtcatcccagctactcaggaggctgagacaggagaatcacttgaacccggaaagcggagcttgcactgacctgagatcgcgacactgcactccagcctgggtgacagagcaagactctgtctcaaaaaaagagtgctttcagtacttagcatgaggccagtcacggtggctcacacctgtaatctcagcactttaggaggccaaggcaggcagatcacctgaggtcaggagtttgagaccagcctggccaacatgatgaaaccccgtctctaccaaaaataaaaaattagccgggcgtggtggtgaatgcctgtaatcccagctacttgggaggttgaggcagaagaatcgctcggacctgggaggcggaggttgcaatgagcagagatcatgccactatactccagccaggtcatcaagagcgaaatgccgtctcaaaaaataaaataaaataaaatattttagcacgggatcttttgattcacacaaagagtagaaatacaggttgcaatcccatgtgaggttacgaattctcagagatgctttccccctctgcccaccatgttcacgatggagaaatttctttgctggtgccctctgcaagatttttgcagtccgctctttctttcttttttttttttttttttgagatgaaatcttgctctgttgcccaggctggagtgcaatggcgtgatctcggctcactgcaacctccgcctcctgggttcaagtgattctcctgcctcagcttcctgagtagctgggattataggcacccaccaccacgcctgagtaattttttacttttggtagaggtggggtgtcaccatgctggccaggctggtctcaaactcccgacctcaggcgatctgcctgccttggccttccaaagtgctaggattacaggtgtaagccaccacacccggcccagtccactctttcaatgaggatgcaggctttccagaccctggctttatgtgggggtcacctaacagctttttcaccctgggtgggccctgggtttctctcttgccccataattccaaatgtgcatcaaaactgaagctttgtggccgggcggagtggctcacacctataatcccagcactttgggaggctgaggtgggtggatcacgagctcaggtgatcaagaccatcctgaactgggtttcaacatggtgaaacccagtctctactaaaaatacaaaaattagctcggtatagtggtgcctgcctgtaatcccagctactcgggaggctgaggcatgagaatcgcttgaacccaacaggcagaggttgcagtgagtcgagataacgctgctgcactccagcctgggtgacagaacgagactctgtctcaaaaaaaaaaaaaaaaaaaaggccgggctcagtggctcacacctgtaatcccagcatttcaggaggccgaggcgggcggatcataaggtcaggagatcgagaccatcctggctaacaaggtgaaatcctgtctctactaaaaaatacaaaaaattagccgggcgtggtggcaggcgcctgtagtcccagctacttgggaggctgaggcaggagaatggcctgaaaccaggaggcagagcttgcagtgagcagagatcgtgccactgcactccagcctgggtgacagagtgagactctgtctcaaaaaaaaaaaaaactgaagcttcttggctgggcacagtggctcgtgcctgcaatcccaacactttgggagactgaggctggtggatcacctgaggtcaggaattcaagacccacctggctgatatggtgaaaccatgtctctactaaaaataaaaaattagccaggcatgggggcacgcagctgtaattccagctactcaagaggctgaggcaggagaatcacctgaacttaggaggcagtggttgcagtgagccaagatcgagccaccaccacactccagcctgggcggcagagcaagactctgtctcaaaaataaataaataaataatttttaaaaatgataaaactgtaaagaaattgtttttaagaaaaacaaaaagttagccagtcatggtgctgtgcaccttgtagccctagctatccaagaggctgaggccaattgattgagcttgagaataaaagagttcgaggctgcagtgagctatgatcacaccgctgcagtctagactgggtgacagagtgagactgtgtctcttaaaaaaaaaaaaaattagggctgggcacggtggctcaagcctgtaatcccagcactttgggaggccgaggcaggcggatcacgaggtcaggagatcaagaccagcctggctaacatggcaaaaccccatctctactaaaaatacaaaaaattagccgggcgtggtggcaggtacctgtagtcccagctactcgggaggctgaggcaggagaatggcatgaacccgggaggcggagcttgcagtgagtcaagatcgcaccactgtactacagcctgggcgacagagcgagactccatctcaaaaaaaaaaaaaaattaggccgggcacggtgactcacacctgtaatcccagcactttgggaggctgaggcaggcagatcactgagatcaggagttcgagaccagcctggccaacatgctgaaacctcatctctactaaaaatacaaaaagttagctgggcgcggtagcatgcctgtagtcccagctactcaggaggctgaggtagcagaatcacttgaacccaggaggcagaagttgcagtgagccaagattgcaccactgcactccagcctggcgacagagcaagactctgtctcaaaaaaaaaaatgaagttgttcacagggcaggtggtggtgacctgaactagaaaggtgactgcagtggggatggaaagggctaaatataattaagaggtattaaggaggtaagattgctaagccttgctgatggcttgcgtgaaggagattaaggagagtcaatgacatatggaagatatttaaagtgtgtgacagtcttaagataacctataggaagagagcatagagaaagaagaaaaatgggccatgtgctgagccctggagtagatacaaagctgaagaggagagagcaagcatagacaaaccagctctggaagcagcacactcgctgtagtgaggggtgtataggatggtgattaacaagttttccacttaaaccagacatgaatcctgggcctgcaattctggccccacagcaagaaaatcaaccttgttgggtgatggtgatgcttcaaactgggctctgatgatgctcaattagggaggagtaagacacttccagagattagaagcacaggggcccgtacgccatggctcacgcctgtaatcccagcactttgggaggccaaagcgggtggatcacctgaggttaggagttcgagaccagcctgaccaaaatggtgaaaccctgtctttactaaaaatacaaaaattagctgggcatggttgcgggcagctgtaatcccagctactcaggaggctgaggcaggagaatctcttgaacccaggaggtggaggttgcagtgagcccagatcttcccattgcactccactccagcctgggcaacagagagactccttctcaaataaaaaaaaagaagaagaagaagaggaaacacaggggatagaaaccagggcaaagggtttggctttttctttttttttcaccctcgagacagagtcttgctctgtcacccaggctgtagcgcagtggcccgatcttggctcaccgtaacctctgcctcctgggttcaagcgattctcctgcttcagcctcccgagtagctgggattacaggtgcgtcccagcacgccggctaatttttgtatttttagttaagacagggtttcaccatgttggccaggctggtctcaaactcctgacctcatgatccgcccaccttggcctcccaaactgttgggattataggcatgagccacccggccggtttttttttttttttttttttttttttttgagacagggtctcactctgtttcttttttgtttatttctttgtttttggagaagggggtctcaatccatcacccaggctggagtgcagtcgtgcaatcatggctcactgcaacctccacctcccagactcaagtgatcctcccacctcagcctcctgactagctgtgattaccagtgtgcaccaattttttttttcccgtagagacagggtttcaccatgttgcccaggctagtttggaactcctgagttcatttgatccacctacctcagcctcccaaagtgctgggattacaggggtgagccaccacaccctgcagggtttggctttttggctggagatggtgaaaggccaggctttttctttttttttcaccctcgagacagagtcttgctctgtcacccaggctgtagcgcagtggcccgatcttggctcaccgtaacctctgcctcctgggttcaagcgattctcctgcttcagcctcccgagtagctgggattacaggtgcgtcccagcacgccggctaatttttgtatttttagttaagacagggtttcaccatgttggccaggctggtctcaaactcctgacctcatgatccgcccaccttggcctcccaaactgttgggattataggcatgagccacccggccggtttttttttttttttttttttttttttttgagacagggtctcactctgtttcttttttgtttatttctttgtttttggagaagggggtctcaatccatcacccaggctggagtgcagtcgtgcaatcatggctcactgcaacctccacctcccagactcaagtgatcctcccacctcagcctcctgactagctgtgattaccagtgtgcaccaattttttttttcccgtagagacagggtttcaccatgttgcccaggctagtttggaactcctgagttcatttgatccacctacctcagcctcccaaagtgctgggattacaggggtgagccaccacaccctgcagggtttggctttttggctggagatggtgaaaggccaggaagatgttatccttggcagagaaagattcagagtcatggtctaggaacttttagtcccaatccagaatttcatgagggaggaaccagaggcccaagaggaggtatccccagccatgtccttcccacccttgtattggtcactcacaaaagacacttgctgcgctgaagacaggctgaagatttcgcatccaggcgccacctctgacagatgccaggagggggcagcagagagccagggtcgcaaggtcctagcaggtgccatgagccctgcaagtgggaaggtgggaataggatgggaagctgggctccttgaggttgtcactttttgtttgtcagtttggttttggtttctgaggcagagtctcactctgtcacccaggctgaagcatagtagcacagccacagctcacatgcagcttcgaactcctgggttcaagtgatcctcccatctcagcctcccaggtagcccaccaccaggcctggctatttttcttttttttttttttttttaagacggagtctcactctttcacccaggctggagtgcagtggtgctatcttggctcactgcaacctccgccttccgggttcaaacgattctcctgcctcagcctcccgagcaactgggattacaggtgcctgccactaggcccagctaatttttgtatttttagtagagacagggtttcaccatgttggtcaggctggtctccaactcctgaccttaggatccgcccaccttggcctcccaaagtgctggaattacaggcttgagccaccgcacccagcccaggcctggctatttttctttaattttccgtagagatggagtctcgctgtgttgcccaggctgagattgtcactttcaaagcatgtttttcccttctccatgtgaggattacacaaccatttcacacataataccgataataataattattatcaccattattatatcagtcaccatttaatgggcccctcccatctctgcatcccaaccctccagagtcacagactgaaccaatggaaagagaaccagtgtgagggtgggcacagtggctcatgcctgtaatcccagcactttgggaggtcaagaagggtggatcatttgaggtcaggagttcgagaccaacctggccaacatgatgaaaacatgtcttggctgggcgcagtggctcaggcctatagtcccagcacactgggagcctgaggcaggtggatcacaaggtcaagaaatcgagaccatcctggccaacatggtgaaaccctgtctctgctaaaaatacaaaaattaggccagtcgcggtggctcacgcctgtaatcccagaactttgggaggccgaggtgggcggatcaggaggtcaggagatcaagaccatcctggctaacatggtgaaaccccatctctacttaaaaaaaatacaaaaaattagccgggcgtggtggcgggcacctgcagtcccagctactcgggaggctgaggcaggagaatggcttgaacccaggaggcggagcttgcagtgagccgagatcgcgccactgcactccagcctgggcgacagagtgagactccgtctcaaaaaaaaaaaaacaaaaattagctgggcatggtggcatgtgactgtagtcccagctactcaggaggctgaggcaggagaatcgctagaacccgggaggcggaggttgcagtaagcagagatcgcgccactgcactccagcctggcgacagagcgagactcgtctctttttttttgagactgaatttcgctgtttttgccgaggcaggagtatgatggctcgatctcgggtcactgcaacctccgcctcccaggttcaagcaattctcctgcctcagcctcctgagtagctaggattacaggtgcatgccaccatgcccggctcattttttgtatttttagtagaaatggggtttcatcatgttggccaggctggtctcgaactcctgacctcaggtgatccacctgccttggcctcccaaagtgctgggattacaggcatgagccactgtgcctggctgagactttgtaaaaaaaaaaaaaaaaaaaaaacacacggtgtgggggtcagaccaagggtatcaaaccctgattttcccacggcctcatcatgtgacctcaaacaggtaacaggtcacttcctcgctgtctcacttttctcatctgtaaaatgaggataataaaacaaaagactggagggttctgaaagcactaaattggccttgtgtaagcaaagtacctggcacatgagagactccatgaacttcagttccttcccctggctttattttagttatttgtttgtttgtttgcttttctactccacaatagaggtaatggactgtttttatttaaacaaatgttaaaatgtcatttaacagatattcactgtcactgtgtccctggtcctgtccttggtactggtaacatagagtggcatcccaggtgagcaggaagcagggaggcaccccctgtgcaagggcgatccccaccgagactagggtctgcctatctggattaagagccacgattccaaattcctgctgccttgccactcactatgtgatagataataatgttttgtgatcctaaacatgtcaaaatggagtcacttatgacaagtgactcagcctacagttaaactgctgacctctcaaagtgtacggtggacagaggggataacacctgctgtggtcaggcacccccaagacctaacaagaaagagaagccacagggcagctgagataatggctatggagactcttgcagagggccatgaacaccgcaataaactgaccatcacggggcgtcatggctcatacctgtaaccccaacattttggaaggatgaagtaaggagattgcttgaacccagcagttcaagataagcctggcaacatagggagacctcatctctacaaaaactttaaaaagttggccaggcacggtggctcacgcctgtaataccagcactttgggaggccaaggcaggcggtcacttgaggtcaggagttcgagaccatcctggccaacatggtgaaaccccatctctgctaaaaataccaaaaaaaattagccgggcatggtggcacatgcctgtagtcccagctactcgggagggtgaggcaggaaaatcgcttgaacccaggaagcagaggttgcagtgagccaagatcgtgccactgcactccagcctgggtgatagagcaagactcagtctctgaaaaaaaaaaaaaaaaaaagctaggcggtgtacgccggtagtcccagctacccctgaggctgaggtgggaggatcacgtgagctagggaggatgaggctgcagtaagccgtgatgatgcctctgcactccagcctgggtaacacagcgagaccctgtctcaaaaaagaaagaaaagaaaaagaaactggccatggcagagatgcctgtgggagctctaccagtgagaactctgaggcctcttttccatcaggcaaccctccgaagctctgctgggagaagagcctcggcccccccaccccttcagccccccaacccttgttggcattctgagggaaaacagtcagcacagtcatcccagagctactggagctactccctgtggcttgttcctcctctctcattactgcctatgtgttggtgtgaaagcctctcaataaaccatgaatttgtaaacatttaattggccattgagtcatcacaaaacttccctcccacccccacctcccaatcagagttagcataactaggctgattcgcacctgacacaaacacaaagcctatgtgattgctgggcgtggtggctcacatttgtgagtgaggaaccatctctacaaaagatcagaaattagccaagcgtggtggcgtgcacctgtagtcccagatattcagggggccaaggtgagaggatcgcttgagcccaggagatcaagggtgcagtgagccttgatgcagcccctgcactactccagcctaggtaacagagtgagaccctgtgtccaaaaaaaaaaaagactatgtgatcttgggcaggcaactctctctctctgagcctcaattagatcatttggaagatggaatcattatagtacctagaggatcagtgtgacacttaaatgtgacagtaggccaggcccagtggctcacacctgtaatcccagcactttgggaggcctaggtgggcagatcacctgaggtcaggagttcaagacagcctggccaacatggcgaaaccctgtctctattaaaaatacaaaattagggccgggcacggtggctcacacctgtaatcccagcactttgggaggccaggacgggcagatcacgaggtcaggagatcgagatcatcctggctaacatggtgaaaccccatctctacttaaaaaaaatacaaaaaattagccaggcgtggtggcggacacctgcagtcccagctactcgggaggctgaggcaggagaatggcgtgaacctaggaggcggagcttgccgtgagccaagatcgtgccactgcactccagcctgggtgaccgagcgagactccgtctccaaaaaaaaaaaaaaaacaaaattaggcagggcgaggtggctcacgtctataatcccagcactttgggaggccaaggcagacggatcacgaggtcaggagttcgagaccagcctcgccaacatggtgaaaccccctctctactaaaaatacaaaaactagctggacatggtggcaggtgcctgtaatcccagctactcagaaggctaaggcaggaaaattgcttgaagctggcaggcggaggttacagtgagccgagatcatgccattgcactccagcctgggtgacagagtgagactccatctcaaaaaataataataataaataaataaatgtgacagtgcactagcaaatgctttgcatcatgcctagcacatagtaagtgtagtaagtgctcagtaaattcaaaaacaaaacagtgttagcttccctggaagttacttctcccctggcagcccttactgcttactcaggtcaccaataaccctcttcagattaccaaagcagcctggcattagagaggaggcaaaaacccagcatctgaaggctgaaattgcatcccagctccaccaactaccagctgtgtggccttgggcagtcagcctctctgtactttagtttcctatgtgaaaaattgggatcagaatagtagctgcctcttaggcttgttgtgaggattaaataagagcacagaacgggcacaatacatgttcaagtcattattactgttattattattactacaactactactgctgtactttcttccacacccaccctggtaccaattcctacagattcaacctcctaaaagcctctcaaagcagtctctggcctccatttcccaggcctggcccttcctatcatttcatgcctctattaggggctccttaaaacagattgtcaggtttggtgtggtggcctgagcctgtaatcccagctgctcaggaggctgagacaggagaatggcttgaacctgggaggtggaggttgaagtgagccgagatcacgccactgcactccagcctgggcaacgcagcgaggctccatctcaaaagcaacgacaacaggtcaccagtccccaccccagagttactgattcagtggctctgcagcagcctgagaatgtgtatttttagcaagttcccaggcgatgaccatgctgtcagtccaagagtcacactttgacaacctctgcttctgagctctgcccaatttctctcatgagctctgcccaatttctctttactcatctaacccttctccaggctggtggcctcagggctggggggattctgtgggtggagatcagtcaaggatagtcagaggctgggattgtgaaaaggggttggcctctggctccaggttttgttcttcaccctggaatctgctgctttgtaccagccaaagtcagggtgctcctagggcctgaaaatcctacaccctggttacacacacacacacacgcaaacacacacactcctcccctattatttactccaaaagtcccatgcacatgcatgaccctggggtggtcccctccaagcccccctaccctgccccacgcaggccagagctcacccaccctcaggattcatcgctgacggccctgcatccctttcctcacagatgtttcacttaccctattctctgctctgaaattccctcaaaagcattcactagtaatttttctaaatcacagtaattacctcattactttgatattaatagacttcgcttggcagcaaggagccagttgaaaggtgcccaggctctgtgtgtggggagggattcctggaggcagccccacgtgagtgctggccgggctgcagccctgtgtctcaccctggcctgcttgcctccccagcctgcctgggctctcatgtgctcttccccaagtcagggaaaatctttgaaccacccacttctgagaaatggtgaaagagagaaggaaggaagaaacgaaagacacaggaaaggggccaggagcagtggctcacccctataatcccagcactttggcaggcgaaggtgggaggattgcttgagctcaggacttcgagaccaacctgggtaacacagtgaaaccctgtctctacaaaaaaatcaaaaattagctgggcctggtggtgcacacctgtagtcttagctactcaggaggctgaggtgggaggatctcttgaccccaggaggcagaggttgcagtgagccgagattgcatcactacactccacattgggtgacagtaagagaccctgtctcttttttttttttttttttgagagagagtctcactctgtcacccaggctaaagtgcagtggcaccatctcagctcactgtaaattccacctcccagattcaagtgattcttgagcctcagcctcctgagtagctgggattacaggtgcatgccactacacctggctaattattgtattttgagtagaggcacagtttcaccatgttggccaggctggtcttaaacttctgacctcgggtgatccacccacctcggcctcctaaaatgcttggattacaggcgtgagccaccgcacccagcccaagagaccctgtctcaaaaaaaaaaaaaaaggctgggcatggttgctcatacccgcatacctgtaatccctgcactttgggagactgaggcaggcagatcacttgtggtcaggagttcaaaaccaggctgaccaacatggcaaaaccctgtctctaccaaaaatacaaaagttatctgggcatggtggcaggcgtctgtaatcccagtacatgagaggctgaggcaggagaatcacttgaacccaggaggcggaggttgcagtgagccaagatcgtgccactgcactccagcctgggcaacacagagacttcatcttgaaaggaagaaggaaggaaagctgggcactatggctcatgcctgtaatcccagcactttgggaggccgaagcaggcagatcacgaggtcaggagatcgagaccatcccggctaacacggtgaaacctgtttctactaaaaatacaaaaaattagccaggtgtggtggcaagtacctgtagtcccagctacatgggaggctgaggtaggagaatcacttgaacccgggaggcggaggttacagtgacctgagatcgtgccactgcactccagcctcggcgacagagagagagagagagagaaacagagagaaagaaaggaaggaaagaaagcgagagagagagagggggagagagagagagagagagagagagaggaaggaaggaaggaaggaaggaaggaaggaaggaaggaaggaaagaaggaaggagaaaatcaaggatgatgaggtttaggacgcacgtactgagtccttactatctgccagatgccttccttgcattatctttcctcatcctcaggactgttctctatgatgaggcctcagggggctgcatttcagctggggaaattgagagcttaggtgatctgcccaaggactcactctcagtagcagatctggattaacgcaggtaggcctgactcccaagcctaacctcctaaccatgaggctcttctgcaagcatcctccactctaggcctcagtttccccattcatagcagtcagagactctgttgatgagggctcactgagagccagacaccagtttgccacctggcccattgcacttaatcctattactgcatttgaatctatgacatgttataaccacggggccatgctgccttggttttacctgctcactctcaagttgatgataagtgagtttccaagtccaagagtctccaggaacgttgcagacttcctctacaaacaggatcaggaagagaagatctcagcagaaaggcaccccggggtgggacaggccagggctgagagtgattgggcagccacagactagactagccaagctggtcagggtcagggtgggggtgcagtatagaggatcctttgtcagggcagaagctgcaagcctccccatccccaccatctggctccagctccagcccagtgatgcatgatgaggagaatgttgggggggtgttgctgagggctgcccacctgctctgcctcctgggataagccaacccgagacctcccaggcccatctggctaacacatccctaggccctgaccacccctgggactccttttgacagactgaaattggccgggagtgtggccagcctgtcagggtcacaggtcaccattaatctgccagaacaagggagggcaggcgggtgggcaagcagccggtgtgggcaaagccctggcagttcctgccgtctgctgtggtggctgtggagagaggctttcctcttctgggaggcagggagatggattagaaagaatctaggaccctaggaaaattgaagatactcacgtctcactacccagcaattccacttctaggtggggccccagtgaaactcacccctgtgcacaaggtgtcattgaagcatagcatgtgatagtgaaataccagaagaaaagtaagcgcccatcaatagggaacaggataaatataaaaactgagacaatcatattcaatgattaaggctgagaactgaggtcctctatgtcaacaagatttgactgtttcaagaaattcttacctggaaagataagactgtaaaccaataaatagcctcaccgtttgcctcaggaaactcttgcaaaccaatttttttttttttttttgcaagaagttggttcaccttggcaaatacttccctttttcagacaacactttactcttcaatgtatcaagagcttcttctcaaatggtgagcactcctaagctcttttttttttttttttttcagacagtctcactgtcacccaggctgaagtgcagtggtgcaatctcagctcactgcaacctccgcctcctgggttcaagccattctcccgtctcagcctcccaagtagctgggattacaggcgcccaccaccacgcctggctaatttttgtatttttagtagagatggggtttccccatgttggtcaggctggcctcaaactcctggccccaggtgatccacccacctcggcctcccaaagtgctgggattataggtgtgagccaccacacccggccactttttttttttaagggacagcatcttcctttgatgcccaggctggagtgcagtggcatggtcatagctccctgcagccttgaactcttggtctcaagcattcctcccacctcagcctctcaagtagctgggacttacaggtgtgtgccaccacacctggctaatgtttaaactttttgtagagatggggtctcactatgttgaccaggctcatgggatgtttttgtttttgtttttgttttactcttgttgcccaggcgggagtgcaatggaaccatctcggttcactgtaaactccacctcctgggttcaagcgattctcctgccacagcctccagagtagctgaggttacaggcatgcgccaccacccccagcaaattttttagtagaggcagggtttctccatgttggtcaggctggtcttgaactcccggcctcaggtgatccgctcacctcagccccccaaagtgctgggaatccagatatgagccactggtcccagccacaaacaaatggcataatttctttttttttctttttattttttgacacggagtttcgcttttttgcccaggctggagtgcagtgctgcgatctcggctcactgcaacctcagcctcctgggttcaagctattctcttgcctcagccaccccccgaggagctgggattacaggcatgtgccaccacacctggctaatttttgtatttttagtagagagggggtttcaccgtgttggccaggctggtctcgaactcctgacctcagataatccacccatcttggcctcccaaagtgctggaattacaggtgtgaggcaccgcgcccggccatgggctgtttttataatagccatccgatgggtgtttaaagtgggatttaaaaaaaatacgggccagatgtggctcacacctttaatcccagcacttgaggaggctgaggcagatggattacttgagctcaggagttcgagaccagcctggccaacatggcgaaaccccatctctactaaaaacacaaaaattagccaggcgtggggcaggtgcctgtaatccctgctactggagaggctgaggcaagagaatcccttgaacctgggaggcagaggttgcagtgagccaagacttcctctcaaaaaaaaaaaaaatacagatgggatgggccagtgcagtggctcacgcctgtaatcccaacactttgggaggctgaggtgagcagatcacttgaggttaggagtttgagaccagcctggccaacatggtgaaaccccgtctctactaaaaatacaaaattagctgggcatggtagcgtgcacctgtaatctcagctacttgggaggttgaggtaggagaatcgcttgaacttgggaggcacaggttggagtgagcctagatcacaccattgcactccagtctgggtgacagagcaagaccatgtctcaaaaaataaaaaaatacagatggaccacgacttacacctataatcccaacactttaggagtccgaagcaggcagatgacctgagatcaggaatttgagaccagcctgggcaacatggtgaaaccccgtctctactaaaaagacaaaaaagtagcctggcctagtggcgcatgcctataatcccagctactcagagggctgagacagtagaattgttgaaccccggaggcggaggttgcagtgaactgagatggtgcatccctacatatgtatatagggatggatgcggtggctcaaccctataattccagcactttgggagaccgaggcgggcggatcacttgaggccaggagttcaagaccaacctggccaacatggggaaaccctgtctctactaaaaatataaaacagccgggcgtggtggcaggctcctgtaatccccactacttggaaagctgaggcaggagaatcacttgaacctgggaggcagaggttgcaatgagccaagatcacaccattgcacttcaacctgggcaacagagtgagactctgtctcaaaaaaaaaaaaaaaaaaaaaaaaaaggccgggcgcagtggctcacgcctgtaatcccagcactctgggaggctgaggcagggggaacacctgaggtcacgagatcaagaccagcctggccatggtgaaacctcgtctccaataaaaatacaaaaaagtagctgggcatggtggtgcgcacctgtaatcccagctactcgggaggctgaggcaggagaatcgcttgaacctgggaggcggaggctgcagtgagctgacacagtgccattgcacttcagcctcggcaacaagagcgaaactccgtgtcaaataaaaaaaaatatatatatatgtgtatatatatatatatgtatatatccccattgtgcagaagaggaagaggaggaggctcagagggtccagggagccacccacagccacatatggcagaagtaggatctgaccttagcactgaaattcttaccctctataatttggtgccttccacggaaccttatcctgatcccaagagttcagtagagggtcctacacatcaggaagtttaagtaactcagtgatagtaataacttatatttaatgagcacttgccaagcaccaggccccttgctaagctctgaatcctcacaaccctagtgagcaggtttttgtttttgttttttttgagacagtcttgctgtcatcgaggctggggtgcagtggcacagtcacagctcctcatcctacctcagcctcccaggtagctgggactacagttgtgcaccaccacacccagctaatttttgtatttttggtacagatggggtttcaccatgttgcccaggctggtctcgaacttctgggctcaagcaatccacctgcctcggcctcccaaagtgctgacattacaggcatgaggcactgagcctggcctgagcccacatcattcggctctctgatgtggaaatagagtctcaaatgggtcaagagatttgctgaaagtcacacagtaatagcatcaatctgtttggttgcagaaccataactgtcctattcttgggtgcctcatgggggatcctcagggccatgacttccagaccatttctgagcttcatcagtggtaccttcccagtctgcagatgctatgtgaccttcatcttggtttcttgggcccccaaagcctccttccagtaccagcaagctccaaaccaaatagggtcttattgaggcaccaggagcctggctgggacccagaaagagccaagtgtcccctgccacacacaacaccaggaggcagcaagggcgatccccagcccccagactcccagcatctgtgatgctataacattccaaacagtagaattctctggctgtgaaattctaagtaatagaactcagaaggcttgaagttctaatcaatcaggaaaacttccagatgaagggaagctgctggggtgcaaaaatctcagagagcagcggggcatggtggtgcctgcctgcagtcccagctacttggaaggctgtggcaggagaatcactaggagttggaggctgctgtgagctgtaattgtgcctgtcccctgccccagttcattactcctttcagtaatcagctcagactccaggtcctcagagaggagaatgggggcctgtctgggtcttaaaatcaggcctcagggcacagttttctaaggcacggtaaagagccctgggctggaatatgtatgaataattaggattatactgtagttaaataataataatcagagaacaataataatagctggccttgagagcttatcagtgtgctaagtacacattgcctcagttaatcacttctctcgagaatgctgggaggtaagagtcatctttttccatttccaggaagtgaaaatcaagctcagagaggttagtgaacttgcccaaggtcacacaggtgccagataactggcggagcctgaagagtggagaccttatccagcggatgcttcttgggggactttgggaagtccccaaaagatttcccaaagatttatcccccaagaggataaatcctcttggagcctcagtttgcccagatgtacaaagtacatctggaaaaggcagagggaaaaaaacaggagcaaaggcagagggaaaaaacaggagcaaagaagccaggcgtaattacagcttatgcctgtaattccagcactttggcaggctgaggattgctccagcttgggagttcaagactagcctgggcaacacagcaagactccatctctacaaaaaatgttttgaaaaattggctgggcctgccggcatacgcctgcagtcccaactacttggaaggttgagatgggagggtcactggagcccaggaggctgagaatgcagtgagctgtgatcctgtcactgtactcaagcctgggcaacagagtgagattctttctcaaaaaaaaaaaaaaaagaaagaaagaaaatgaacaggagcaaagaagcatggaccaccacagtttgatggggacatgtaatcagaaaggataacctggggggaggaagctgaaagtcccaagaactttgtaagtggcgtctaattaagcccatgaggcaggaaaatagcctatagtcttaggactaacactatccatgagccaatccttaagtaagcagaatgtagaaggcttgatttcatggctgacacagagcagagtcagtggcagcttttactattattatttttttttctttttatttatttatttttttgacatacggtctcactctgtcacccaggctggagtgcagtggtgcgatctcggttcactgcaacctccacctcccaggttcaagcgattttcctgcctcagcccctgagtaactgggattacaggcacgcgcctccacgtctggctaatttttgtattcttagtagagacggggtttcaccatattggctgggctggtctcgaactcttgaccttgtgatccgcccccctcagcctcccaaagtgctgggattacaggcataaaccaccgtgctcaaccctaattttgttttttattttcatgctttttttttttttttgagacggagtcttgctctgttacccaggccaggctggagtgcagtggtgcgatctccgctcactgcgacctccgcctcctgagttcaagcaattctcctgcctcagcctcctaagtagctgggactataggcgcccaccaccacatctgcctggattttatatttttagtagagacggggtttcaccatgttagccaggatggtctcgatctcccgacctcgtgatccacccgcctcggcctcccaaagtggggattacaggcgtgagccaatatgcccggctcacacctctaatcccagcactttgggaggccgaggcgggtggatcacctgaggtcaagagttcgagaccagcctggccaacatggcaaaaccccaatctctactaaaaatacaaaaattagccaggtatggtggcaggcgcctgtaattctagctacgtgggaggctgaagcatgagaattgcttgaacctgggagtcagaggttgcagtgagccgaaattgcaccactgcacttcatcctggtcaacagagcaagacttagtctccatttcagagtcattataggcatgagccaccatgcccagctcactaatttttttttttaagagactgggtctcgggcaggcgcggtggctcatgcctgtaatcccggcactttgggaggccgaggtgggtggatcacctgaggtcaggagttcgtgaccagcttgaccaatatggtgaaatcctgtctctactaaaaatacaaaaattagccaggcatggtgacatgtgcctatagtcccatctacccaggaggctgagacaggagaactgcttgaacccaggaggcagaggttgcagtaagctgagattgtgctactgccctctagcctgggcaacagagcaaaactccttctcaaaaacaaacgaaaaagagactgggtctcattctgtcgcccaggctggagtgcagcagctactcataggcacagttatagctcattgcagcctcaaactcctagtgatcatcctgtctcagcctccgtagtagctgggactgcaggcgtgcaccaccgcgccccactgatcactgagacttttgcaccccagaagctttccttcatctagaagtttcctgatagattagaatttcaaggcttctgagttctattagttagaatttcacaaccagagaattctattgattagaattttatggcaccacagaaatattgattagcatttcatggccatagaatcctattactcagaatttcatgacttgagagtgctattgatttgaatttcatggcatcttgatgttccagcaatgcaggcgtccccagatacccacataaattgctcagatctctgctcaaactgtcgttttcccagggaggccttccctgacctccttattgcaaattgtctgtctgccacctgctttgtttttttccatgctgtttatcaccacttaacaatatgtcacatacattacttactcctcctcggctagaatgtaagaagctctaacaagacagagatttttaaatttttcttttttttttttgagacagggtctcaccctgtcacccaggctagagtgcagtggcacaaccatagctcactgcagcctccatctcctgggctcaggtgatcctcccacctcatcctcctgagtagctgggactacaggcatgcagtcactattttaaaaataattatataaaccgggcctggcactgtggctcacacctctactcccagcactttgggaggccgaggcaggtggatcacctgaggtcaagagttcaagaccagcctggccaacatggcaaaaccccaatctctactaaaaatacaaaaattagccaggtgtggtggcaggcacctgtaattctagctatgtgggaggctgaggcatgagaattgcttgaacctgggagtcagaggttgaggtgagctgagattgcaccactgcacttcatcctggtcaacagagcaagactcagtctcaaacaaacaaacaaacaaacaaacaaaaaacagtagtgactgttaagttgtctacctgccttctctagcatgctccacccccactcaatgtttcaattcatgggtggagaggggagtcactgtgcccgtctccctaaaaaataggtctcacctgagatgagatctacactcctaggacagggaaaggaattgaaatgatgcagacggatgagtccagaaagggatgtcctagcacctggaacctactcatttttcagatctcgaatgttaccatcacctgctccaggaagctctccctgacagccaggttaactttgcttccctgtcaaatgctcttcaagctccccacactctgttcacaggactctgtactgtttgcatttaattatgtatttatttgaggcaagatttctctctgtcacccaggctggagtgaagtggtgcaatctcatttcaccacagcctccacctcccaggcccaagtgatcctcccacttcagtctcttgagtagctgggaccacaggcattcaccaccatgcccagctatttttcttaccttttgtagagacagggtgccaccatgttgcccaggctggtctcaaactcttgggctcaagcaattctcccacctcagcctctcaaactgcaggaactacaagcgtgaggcaccacacgtgcccttttactgtttgtatttagagatgtgctggatgactgattgatgtctgcagacaaggaccatatctagtttgtaactcctacctagaccagtgcctggcacacagtgcatacgtgtagaatgaatgcatgaataccacatcacattcttgcaagcaggatgcaaaaagacctgctgggcataagagctgccaaggatcaggggatgccagagggaggaggaccttcggggaactgagagtttggattccagctgcccctccagagccagctcctgggtaagaggccaactagagaagggataggcagaccgtgtgcggtggttcaagcctgtaatcccagcactttgggaggctgacacgggcagatcacctgaggtcaggagctcaagaccagcctggccaacatagtgaaaccccatctgtatcaaaaattaaaaaatggggccaagcatggtgatgtgcacctgtaatcccagctactcgagaggctgaagtggagaatcacttgaagctgggaggcggaggttgtggtgagctgagatcgtgccgctgcactccagcctgggtgacagggcgagaccgtatctcaaaaaaaaaaaaaaaagagagagaaacagactaaaccatataccatactggcgctgagacctgtggctcctgatgctgtcacagcaatcagccatgcacaatttgagcaaacagacaatacataacgacacgacacgggtggctgtgtttcaacaaaactctcctaattacactaaagtttgaatttcacatatctttatcggttggggaaaagtctcccaatcccagagattaagtgttcagtttaaagtaagggtgagagcctcaggtggaagagagaccctttttttcccacccctgagatgttagacaagtcccttaactgctctgagcctggagcgcctggtttggtaaagggtctaataaaagtccttgactcccaaggcggtcgtgaggattaactgagataacaccttgagctccagccaggtgggctcagcatgagctaccggattgctattgttggtaataattattattactattaccagggggactttgagaggagcaaacggaaggacgcatgcaaatcctcttgtgcaatgtctggcaccaaggagaccttcctaacctcccctgttctgcaaacccgttcccaccctaggtcattccagacggtccaccccagcatccttcactctcccctcaaccccctcaatgctctcctcctccccacgatccctggctcagaccagaggtggtcatggcagctggccagggtgcagagagggccaggcacagagggaggagggttccaaccaggccccccgcccattgtctgagcctgccagcccgccagccagctgatgtcctgggtctccgacaccagctggccagccccacccccaccccaataccccctcctcccaggtccctccctgtcactcagcctctgcccccatccgcccacagcccagaaagactcagggtgtgaccagagggtctgagcttttgtcccccaaatcggaggctgatttgcatcttttagcaatttgcacaccccattcatttgtgtagagctagactgccacaaagccagcctggtccttggggcttatttatttgagtggggttataaaatgtgattttgggtgttccctttcagccttcagcacttcctcattctgggactttgctcagtggcttcaccactgttccttatctgtaaaacggaggcaacactttcctatacagtggttgcgaggagtaagatgtgtgtgatgtgcctggaataaagtgggtgttcaacaaacaagagctgttattatctaaacatcctccagagttaactgttaaaacctgtgctggcctggcgcagtggctcatgcttgtaatcctagcactttgggaggccgaagtgggcggatcacggggtaaggagttcgagatcagcctggccaacatagtgaaatcccgtctctactaaaaatacaaaaatttggccggtcacagtggctcacacctataatcccagcactttgggaggctgaggcaggtggatcacgaggtcaggagttcgagaccagcctggctaacatggtgaaaccccgtctctactaaaaacacaaaaaattagccggacgtggtggcgggcgcctgtaattccagctacttgggaggttgaggcaggagaatcgcttgaacctgggaggcagaggttgcagtgagctgagatcgtgccattgcactccaacctgggcagcaagagtgaaactccgtctcaaaaaaaaaaaaagaaaatcaaacaaacaaagaaaaattagccgggcatggtagcgcgagcctgtagtcccagctaatagggaggctgaggcagaagaatcgcttgaacccgggaggcggagattgtggtgagccgaaatcaagccactacactcctgcttgggcaacagagcgaaataaataaaataaaataaaaggaaaggaaacatgtgctgtccattgggtggccactaggctatttaaatttcaattaattaaaattaaataaaattggtactttagttcctcagttgcaccagccaaatttgaagtgctcgacagccatgtgcggtggctatcatactgagctgcacagatcactgcagaatgttctctgggatagtgctgattcaaaccctctaattctccagagtttttctcccttttcagaatagggctctcttctctgcagcctttcttcccctcacccccaacaaggcccatcgaggcacagtaatctgccccaccccacccccactgtatcctctgggcatagattccaaaacccccagtgggtggctgaaactgcaaatagttcctaaccctccatagtttgtacttgcaatgaccttggtgcgaaggtgttcttttgttctctgcagggcctgcacctgggatggaggctggagaacaggtgtggagctgtgccctggggcaccgaggggataggctcaattgttggtgttgtaaagcaaacaactgcacccaactctgtcccaggcgccagcagaagcctccaccttcggaggtggacgagggagggaagccctggggaattgtgggccctgtccccactatctcccagaggcagtttaagatcacataataagtctgggcctggaatgaacagtttccagcacagctgacacctggggcaggtgctccagatgggaggcccagagtgcagggggaggaaaggcttggcaacctcacaaaggccaaggctcatctgcactggaggctgtggaaggtgcgaataagtcacattcagattatttcaacctatacacattccacatccactgtggccccaacaccaccagcagagaaaagcaggagtggagaaaccccaatcctatctacaccctcatgcagacatcccaaagttaacatccccagacctgaactcctgctttcgcccttggcatgtgtttgttcatcccacagctgtcaccacctcagcctgtggctgctccatcctttcagctgctcagcccagaaccttggagtcacccttcatcctgctcttttccataccccacaaacaagccatcagcaaactccaccatctccaccttcaaacagaacacacatccaacccctactcaccatctctactgccactaccttgttccaagccatcacggtctccctccagaatcacccagtggttttccaccgttgcctcccctggcatacccttctctctagagggatgatcatgtcgctcctttgctcaaaactatctagaggctctgaaatttgtggagaacaaattcaaattcctggcagagcacagtggctcaagcctataaacccagcactttgggaagccaagatagaaggattgcttgagcccaggagctctagaccagcctgggcaacataaagagaccttgtccctacaaaaaattttagctgggtgcagtggctcatgcctgtaatcccagcactttgagaagccgaggcgggcggatcacgaggacaggagttcaagaccagcctggccaacatagtgaaaccccgtctctactaaaaatacaaaaattagctggacatgggggcatgcgcctgtagtcccagctacttgggaggctgagacaggagaatcgcttgaacccaggaggtggaggttgtggtgagcggagatcacgccactgcactccagcctgggcaacagagtgagactctgtctcaaaaaaaaaaaaaaatttaaaattagccaggtgtgtctgtggtctcagctactcaggaggttgtgatgggagggtcacttgagcccaggaggtcaaagctgcagtgagccatgatcgtgccactgcattccagcctgagtgacagagtgagacccagtctcaaataaatacattaaattaaattagaaataaaaaataaagtcagatttcttactatggcctaccaggccccacgttatctggccgcagtcccctttctcagtctctgctgtatcctgatgtcctttctgtgcagccatctttctgcctccgggcctttgttcctgctacccttactcagcctggcggctgtcttaccttctccaggttttagagtttaattaacacctccttagagaacactctctctgcttccttatataaagtagcacttggccgggtgcggtggctcacacctgtaatcccagcactttgggaggccaaggcgggcggatcacttgaggtcaggagttcgagaccagcctggccaacatggcaaaaccctgtctctactaaaaatacaaagttagccggacgtggtggcacatgcctgtaatcccagctactcgggaggctgaggcaggagaatcgcttgaacccaggaggccaaggttgcagtcagtcgaaatcgcaccactgcactccagcgtgggcaacagagcaagactctgtctcaaaaaaaaaaaaaaaaaaaaaagttgggttgcacctcttgcctttctcctgccttgtttttccttggagtacctagcatagtgtatactgactatgctcattgccagttcatggtcactgtcccctcacagaatgcctcccccgtggggtgggaatttggtctgtcttgtgcacagttgtagccctgatgctcaggacagtgcttggcacatggtatgtgtttggtgatggagggaagaatgcacaagctctgtgcttggtgccatgcacagcacctaatatggttttctcacccactacccacagcccctaagccaggtgctgttctcacagatggggaaatgccacatagagactatgatttaccccagcctagtaacagacctatccaaagtgtgtcttttgtaccactcccccatagacaatcagacttgatagccaggttgctgtttgagaccaaattctgagggcccctagggattcacatgcatcagcatgagatctgggaccttctgctctaagggtgggcagctctgaacaggtaagtctttaacattctcaaagaaggcttcaaatatctggatttctcctctcttttagcctgtctagggccatttgtttagaggaaaaatttaaaaagcaaatcacagtcctccagggcattcatgaaaccatgtatatgccttccttggcctcaggcttaaacatcccttccctggtctccaagattgcagcgtgcagccccgcccactctgcctagaggtctctctgtccctccagcctgaacaactgggacaaggggtgggacagagggaatgaaaagctctgcgggtgtggaaggtaaagaagaggtgatggggccatgctcagtagctcatgcttgtaatcccagtactttgggaggccgaagcgggtgggtcacctgaggctaggagtttgagaccagcctggccaacatggtgaaactttgcctctactaaaaatacaaaacttagctgggcgtggtggcgggcgcctgtaatcccagctactcgggaggctgaggaaggagaatcatttgaacccgggaggtggaggttgcagtgagttgagatggtgccccattgcactccagcctgggtgacaagagtggaactctgtctcaaaaaaaaaaaaaagaagaggtgagggaagtgataggctgggtccaaacaatgtaggactttgtagatcatggtgggcagtttgaattttattttaaggacattagagtcttggaggtgtcatttgtttaacttttatttatttatttatttatttatttatttgagatggagtctcgctgtgttgccaggctggagtgcagtggcccgatctcggctcactgcaacctcggcctcctgagttcaagcaatcctcccgcctcagcctcccaagtagctgggataacaagtgtgtgccaccacacttggctaattttgtattttgagtggagacagggtgtcactgcattggccaggctagtctcaagctcctgaccccaagtgatctgcctgcctcggcctcctaaagtgccgggattacaggtgtgagccaccgtggccagccttttttttttttttttttttttttttgagacagagtccactctgtcacccaggctggagtgcagtggcacaaacttggctcactgcaacatccacctcccgggttgaagcgactctcctgcctcagtctcctgagtagctgggactacaggtgcgtgccagcacgcccggctaatttttgtatttttagtagagatgaggtttcaccatgttggccagtctggtctgaactcctgatctcaagtgatctgcccaccttggcctcccaaagtgccaggattacaggtgcgagccacagcaccaggcctaggatagtttttcaaaaggcaggatgcaggctgggcaaagtggctgtaatcccaacactctgggaggccgaggcaggtagatcacttgaggtcaggagttcgagaccagccaggtcaatatggtgaaacccccatctccactaaaaatatgaaaattagctgggcgtgctggcacgtgcctgtaatcccaggctgctcaggaggctgaggcagaaaaatcacttgaacctgggaggcggaggttgcagtgagccgagatcaatgccgttgctctccagcctgggcaacagagtaagagtctgtctcaaaataaataaataaataaataaataaataaataaaaatattaaaaaaataaaaggcaggatgcagaaatgtgctaatagtatgatctcaattatgtaaataggtccatgaacagaaaaacgttgggaatactatacagtaaaatggtgacaatttctttcttttttctttttattttttgagacagagtcttgctctattgtccaggctgaagtgtagtggcataatcactgctcactgcagctggccaatggggttttgctatgttgcccaggctggtcttaaactcctggcctcatggaatcctcccaccttggcctcacaaagtgctgagattcaggcatgagccaccacctccctggcctattcctcaatgttaagaattaagataatctgtcatgagattagagttaaggaaaaaaagaattcactgttatttttgtcacaatcttcttatgtagtgtacaaattcttcaccatgactatgctcacattcctctcataagcataaacaataataaattttaatcatataaccagtagccaaagaactcgttcatctctccctctgggagttttgggctcttcagcctttttgggagaaaaagccttgcttattagaaaagccccagctgctgggcctagtggctcacacctgtaatcccagcactttgggaggccaaggcgggtagatcacctgaggtccagagttcgagaccagcctggccaacatggagaaaccccgtctctactaaaaacacaaaattagctaggtgtggtggctcatgcctgtaatcccagctactcgggacggtgaggcagggaaatcgtttgaacccgggaggcagagatgccgtgcattgcactccagcctgggcaacaagagtgaaactgtgtctcaaaaaaaaaaaagaaaagaaaagccccagccctgtcaaatatttttctggcacacaaagagattttttttaaagtgccatgggtatttcagactcctgtttacccaagaaggaccaacacctctaagtcgcttcccctcgctgactgtcatctggcctggccttgtgtttatccttcattagcggaacgggcatggccagggcagatggcaggcagcacacacttctccctaacgcccatctttatccttctcgtcactagttaaagaaaaacagtcactggacttggacaagaaagagccagggcctcaagcaatttccttaggtctatctaagtctacaaggcttccagaaggctgtgaaaagaatgtcagaattaagttctatcacctgagtaaccttcagactcaggctgaccttataatatctcttaacttccctggcgctggaaaatttagttattgcaaggttgaagtcaaattcagtttataaggcacctagccctgtcccttgacttgtaaatgttaatggtttatggctctgatgtgctccccaaaggcctatcccccaccccaaaacataaacacattccaccatgaactatgcaagaataacaaataaatagaaaaggttggtgacttgtgtcaactaacttattgtctctatatttgaaaccacacagaacttgagaaatctctatctttgaaaccaggccttgtccaggcccttagcaacaaagttttatcttcagaaacagtagaatgagaccaagtgtggtggctcacgcctataatctcagcactttgggaagccgaggcgggtggatcacttgagtttgagaccagcctggccaacatggtgaaactctgtctctactaaaaatacaaaaaattagccgtgcgtggtggcatgtgcctgtagtcccaggtattcaggaggacaaggcagaggcaggagaattgcttgaaccaaggaggggaggttgcagtgaagcaagattgtgccactgcactccaacctgggcgacagagggactccatcccccccaaaaaaagtggccaggcatggtggcttatgcctgtaatcccagcactttgggaggccatggtgggcggatcacttgaggtcgggagtttgagaccagcctggccaacatgatgaaacactgtctctactaaaaaaaaaaaaaaaagctgggcatcatggtgcacacctgtaatcccagctacttggaggctgaggtatgagaattgcttgaacctgggaggcagaggttgcagtgggccaatatcacaccactgtactccacactccagcctggtcgacaaagcgagactccatctcaaaaaaaaaacaacaagtttttgaatcaaccttgtgttccctgggtaatcctaatttgttcataatgtattatactttttatatattgttagattccatttcctaatattttctttctttctttttttttttttttttttttgagatggagtttaactcttgttgcccaggctggagtgcaatggctcgatcttggctcaccgcaacctccacctcccgggttcaagggattctcctgcctcagcctcctgagtagctgggactacaggctcgcgctaccacgcccagctaattttttttttttttttgagacaaagtctcactcttgtcccccaggctggagtgcaatggaacgatcttggctcactgcaacttctgcctctgggttcaagtgattctcctgcctcagcctcccgagtaactgggattacaggcgcctgccaccatgtccagctaattttttttgtatctttagtagagacggggtttcaccatgttggccaggctggtctccagctcctgacctcaggtgatctgcctgtctcgacctcccaaagtgctgggattacaggtgtaagccaccatgcccggccaatttttgtatttttagtagagacggggtttcaccatgttggccaggatggtctcaatctcctgacatcgtgatcctaccacctcagcctcccaagtagctaggactacagagatgcagcactatgaatggcaaatgtttgtattttttgtagagctggagttttgccatgttacccagcctggtcttgaactcctgggctcaagcaatccacctgcctaggcctcccaaaatgctgggattacaggtatgagctgccatgcttggcctaaccataaatgtaattttttttctgagacagagtcttgctctgttgcccaggctggagtgcagtgatgtgatctcggctcactgcagccttgacttctcaggttcaagtgatctttctacctcaacctactaagtagctaggaccatggtcttgtgccagcatgcctgctaacatttaaaatttagtttttgtagaaacagggtctcattatgttgcccagtctgatcttgaattcctaggtttaaggaatcctcccaccttggcctcccaaagtgctgggattacaggtgtgaaccaccgcacctggcctaatattcttaatatatataggatattcagatgatcaccttattcagtaagctttagtagttggcatctttctttttttttctttttttttttttgagacggagtctcgctctgttctccaggctggagtgcagtggcacgatcttggcttactgcaagctctgtctcccaggttcacgccattctcctgcctcagcctccggagtagctgggactacagacggccgacaccacgcctggctaattttttttgtatttttagtagagacggggtttcactgtgttagccaggatggtctcgatctcctgacctcgtgatctgcccgcctcggcctcccaaagtgctgggattacaggcgtgagccaccgtgcccggccagtagtttgtatctttcaaggaaattattgattttatctaaaatgtcaaacttgagggcataaaattcttcataatagttctttttttttttttgaaatggagtctcactctgtcacccaggctggagtgcacaatctcagctcactgcaacctccgcctcccgggttcaagcgattcttgttctttttttttttttttgagatggaattttgctgttgttgcccaggctggagtgcagtggcgcgatctcggctcaccgcaacctccaactcccaggttcaagcgattcttctgcctcagcctcctgagtagctggaattacaggcatgagtcaccacgtccggctaattttgtatttttagtagagacggggtttctccatgttggtcaggctggtctcaaactcctgaactcaggtaatccacccacctcggcctcccaaagtgctgggattacaggcgtgagccaccatgcctggcacgattctcatttttcagcctcctgagtagctgggattacaggtgcatgccaccacgcctggctaatttttgtatttttagtagagacgaggtttcatcatgctggccaggctggtctcaaattcctgacctcatcatcagcccgcctcagcctcccaaagtgctgggattacaggcgtgagccactgggcccggtctctcttacttgaatcttaaaaagtttgaaggttgggtgtggtagcgcgtgcttacaattctagcactttgagaggcccaggctggaggattgcttgagctctaggagtttaagaccagcctgggcaacacaaagagacaccacctctactactactactactactaataataataattagctggtcggggtgggtgccatggttcacgactgtaatcccagcactttgttttttttttgttgttgttgttgttgttttttctgagatggagtctcgctctgtcgcccaggatggagtgcggtggcgcgatctcagctcactgcaagctccacctcccaggttcacgccattctcctgcctcagccttccaagtagctgggactacaggcgcccgccaccacacccagctaattttttttttttgtatttttagtagggatggggtttcactgtgttagccaggatggtctcgatctcctgacctcgtgatccgccagccttggcttcccaaagtgctgggattacaggcgtgagccaccgcacccggtcaatagtaattatttttgagacagagtctcactctatcgctagactggagtgcagtggcatgatctcgacttaccataacctcagtctcctggttcaagcgattctcctgcctcagcctcccaagtagctgggattacaggtgcccgccacaatgcgagctaatttttgtatttttagtagagatggggtttcaccatgttggccaggctggtctcaaactcctgacctcaggtgatccacctgcctcagccttccaaagtgctgagattgcaggcatgagccaccgcatccggccaaattattatcactctttttttgaggcacggtcttgctctgtcacccatgctggagtgcagtggtcggatcacagctcactgcagccttgacctcctgggctcaagccaatcctcctgcctcagcctcctgagtagctgggactacaggcgtgcaccaccatgccttgctaatttttttattttttgtagaaaggaggtctcactttattgcccagtcttgaaaattattttttgataggagcattggagagattttcacaaaggaagtgaaatttcagctgggctgttaaccccatctgaattcctcatagccttttagttgtggtttagagacccttcctgggactctctgagtacattggtaccttttattgtgttttccaaaaacgttctagggagggctttcttcatcagtgctcatggcactttaaagagtatatatatacatgcatgttcttttcttttttttgagatgaagtttcgctcttgttgcccaggctgaagtgcaatggcgcaatctcggctcactgcaacctctgcctcccgggtttaagtgattctcctgcctcagcctcctgagtagctggtgttacaggcatgtgcccagcaaattgtgtatttttactagagacagggttcctccatgttggtcaggctggtctcgaactcccaacctcaggtgatctgtctgcctcagtctcccaaagtgctgggattacaggcatgagccaccatgcctggccacatatgttcttttcttctctctcttttttttttttttgttttgttttgagacagagtcttgctttgtggcccaggctggagtgcagtggcatgatcttggctcactgcaactgccacctcccaagttcaagccatcctcctgcctcagcctcctgagtagctgagactacaggcacacgccaccactcctggctaacttttgtatttttagtagagacaggttttcaccatgttggccaggctggtctcgaactcctgaccttttgtgatctgcccacttcagcctcccaaagtgctaggattacaggtgtgaaccactatacccagctggtatatgcacatatgttcttatttctacatttttttttctttttttgagacagggtctcactctgttactcacgcctgatctgttagatcaggccagagtacattggtctgatctggggtaactgaaacctctgactccctggctcatatgatcctcccaccgcagccttctgtgtagctgagactacaagcgtgtgtgcaacaccatgtctggctaatttttgtattttttgtacaggcgcggtttccccgtgttacccaggctagtcttgaactcctggactcaagcgatccacctgccttggcctcccaaagtgccgggattagaggcataaaccactgtacccggccggcctacattctgtcttttaaaatttgttttcaatacacaagtaaaatacaaatgcattctatattcttggtgtgagatatctgaaataatactgagaaacaagagtctttattcttttcttttcttttcagacggagcttccctctgttgcccaggctagagtgtagtggcgcgatttcggttcactgcaacctctgcctcccaggttcaagcgactctcctgcctcagcctcccgagtagctgggattatggacacccgccaccgcgcccagctaatttttttgttttgttttgttttgttttttgagagggagtctcgctctgtcacccaggtgggagtgcagtgtcgtgatcttggctcggtgcaacctccgcctccggggttcaagcaattctcctgtctcagcctcctgattagctgggattacaggcttgtgaaaccaagtccagctaatttttgtatttttagtacagacggggtttcaccacgttggtcaggctggtctccaaatcctgagctgtgatctgccagcttcggcgtcccaaagtgctgggattacaggggtgagccacagctcctggccttgttttgtttttttgatacggagttttgctctttttgctcaggctggagtgcaatggctccgatctcggctcactgcaacctccccctcccggattcaagtgattctcctgccccagcctcccgagtagctgggactaaaggcacgcgccaccgcaccaggctaatttttgtatttttatttatttatttttttagtagagatagggtttcaccttataggccagactggtcttcaaactcctgacctcgtgatcctcccgcctcggcctcccaaagtgctaggattacaggcttgagccactgcgcccggctctaagttttgtatttttagtagagacagcgtttcgccacattggccagactagcctcgaagttctgacctcaggtaatccaccctcctcggcctcccaaagtgttaggattataggcctgagccaccgtgcctggtctattttttatttttatttatttatttttttaatagagacgctagtctcaaactcctgagctcaagtgactctcctttggcctcccaaagtactaggattacaggcgtgggccaccacgcccggccaacagttattaaaattacgatgatgaaattttaggcatttagaatacttcaggccaaaaacactttgagccagggggctcgctcaaaggcatgcgcaaaagccatcaggcctgtacctggagaactcaggtgagacgttgccactcgttgtaatccctccccctagcactcggcccccgagcctgggccactgccctggctacaccgggaagtctggagctagaaagtgggccgtgcgcgtgacgggcgcgcgtgacgccgagggggcaggtctgagaagcaggctgcgccgggattcggcggtcggttcccgcggaaggggcgggtcaggttagggggcggtgcttaatgggagctggtcttggggccgggcttccgcgtgcgttggcctggcggcgagagcgcgcggcgggggcgtgcccggcgggcggggcggggccagccgggggcggggcggggcgcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcgtaagtggggcgtgaatgcgggcggccgaggggggcgtgtgagggcctgcggctccgcaggcgcggtgattccgagtgccccgggcgcgaggccgggagtggaaactgaggcccgaagcggggcggcggatccaaggtcacgcagcggggcgggccttcccgggctcctgaggccaccccgtcgcttcctgcgccgcccgaagagctcggggctcacggtgtgagggaaattgtggggcccgcggcctcggaacttaggccgggccggcgtccatgggacttgccggcgggcaagaatcattttgttgtcccagcgctggggccacgaagtccggctcctggggaaatactacacccgcccgatgttgagggttggaggagatgagaatggcccctcggagggcctgtttgagcgcaggctcagtagttggctacctgggttcacatccaggcttccccatttaggtagtgaccttggctctcccggtgcctcagttcccccatctgcaaaatggggatgtggagcgggttccctccctcccccagggttcttgggttttgtgaggccagtaaaacgcttgacaccgaccgtggcacacacacaattgtgaaaactgtcattattgtaatcgtcctttattaatctgatccagtgtgcaccgcactcggaaaagtccgaaattaggctctagccgtgttaagattttgttttgttgtctgttagtcctgctccatgatctaattgttattcttacttccatttagccattccagtatttatctagtgttcctccttgatgtgtgagatccttgggggaggggtggcttctctgaataagaacaataaaattttaattgtttttcattattgtaattataatagccaacatttttttgagcaccagacattttgcattctattcacttaatatttattaaatcatatagtaagtttaaaaataccattccaggccctgggaatacaataaacaagatagaccgaactggggttttgagtttagttaggagagggagagacatagtaaatgaggaaacagataaacatgttttgcatgtttttttaattgtttaatcttgatgacatcctaagtaagacattatttgaggatgcccattttgcagaggatgaaactgagtaacagaaggtactctgagtactagtctcagagctgatgtccttaaacacgtgaaagggaggctttacgcttctttttttttgcacccattaaatgttggattgaagatagaaaaagtagatacacccagcttgcagttactgcttttgatggtttgatccattcctcatgaaatttccaactaaagaggcggatagtgattactcttttaggcttgcaaaggtacagcatctctgtaaaatgaaaggcttttttttttttgagacggaatcttgctctgtcgcccagactggagtgcaggggtgtgatcttggctcactgcaacctccgtctcctgggttcaagctattctcctgtctcagcctccggagtagctgggactacaggcatatgccaccacgctcggccaattattttattttattttattattttttttgagacggagttttgttcttgttgcccaggctggagtgcagtagtacaatatcggctcactgcaacctccccccgccccaggttcaagcgattctcctgcatcagcctccagagtagctgcgattacaggcgcctgccaccacacctgactaattttttgcatttttagtagagacggttttaccatgttggccaggctggtcgtgaactcctgaactcaggggatccatctgcctcagcctctcaaagtgctgggattagaggcatgagccactgcgcccggccttaatttttatatttttagtagagacagggtttcaccatattggtcaggctggtctcgaacccctgacctcaggtaattcacccacctcagcctcccaaagtgctgggattacgagcgtgagtcaccaagcctgaccagaaaggactttttatttgaaaaaattggggggctcttctgcctatgaagtagtcttcctttgtttctttacttccataataaacttgctttcacttaaaaaaaaaagattgtgtccaaatttcttttgtgtagtatttagtttaaaatatgcccaaaagcacaacttttgcttctgttacgtaactacatttttgttttcttttttcctttttttgagacagtctctctctgtcacccagactggagtgcagtggcgtcatcatggcccacagcagcctcaacctcctgggttcaagtgattctcctgcctcagccacttgagtagctgggactccaggcgccaccacacccagctaatttttttattttttgtagagatggggtcttgctttgttgcccatgctagtccggaagtcctgggcttgagtaatcctccttcctcagccatccaaattgctgggattaaagtcatgagccactttgcctggccttttttagtgtttctaagagaattctgtattacattcctagacagtacacttggtgtagtactcagcctcctgaggagctgggattacaggtgctcaccaccatgcctggctaatttttttttgtattttttgtagagacggggtttaaccatgttttggctgggctcctgacctcaagtgatctgcccgcctcagcctcccaaagttctgggattacaagtgtgagcctctgcacccgcccttgattgaagttttggttttttttttttttttttttttttgagacggagtttcactcttgttgctcaggctggcgtgcaatggcatgatctcggctcactgcaacctccgcctcctgggttcaagcagttctcctgcctcagcttcccaagtagctggtattacaggtgcgtgccaacacgtccggctaatttttgtatttatagtagagatggggtttcactacattggccaggctggtctcgaacgcctgaccgcaggtgatctgcccgcctcggcttcccaaaatgctgggattacaggcatgagtaactgcacctggccttgattgaagtttttaactggcatgctgggaaagagaatataggagttcagtcttaaaatcggtgcttcaacccctgagccagagtccttggggaagtagtctagaactgtggcctcacatgtttgttttttctttttttaaaactgaggtggggtcttgctctgttgcccaggttctgctgcccagtgagcatagcttctgcagcctcttatctctggggctcaagtcagcctcccacctcagcctccctagtagctgtgactacaggcatgtattgccatgcctggctaattgtttaaaaagttttgtagacatggggtttcactgtgtttctcaggctggtcttgaactgctgggctgcagcgatcctcctgcctcagcttcccggtattgggagtagaggcatgagccaccatacctggccacctaaaatgtttttagtgttcattccatcagtaaatagggttgagtatgcacacacattctatgaatgttttattttttgtttttttatggttttttttgagacgaagttttgctcttgttgccccagctggagtgcagtggtgcgatctcggctcactgcatcgtccatctcctgaattcaagtgattgtcctgcctcagcctcccaagtactgggatttcaggtgtatggcaccacccctggtaattttgtgttttcagcagtgatagggtttcaccatgttggtcaggctggtctcaaactcctgacctaaagtgatccacccgccttggcatcccaaaatgttaggattacaggcgtgagctaccgcgcctggcctgaatgtttgttttaaatggcgattatagtgtgactgtactatgtattaggcatatatatgtgtatatatatatatatatatatatatatatattttttttttttttttttttttttttgagacagagtctcgctctgttgcccaggctggagtgcagtggcacgatctcagctcactgcaagctccacctcctgggttcacgccattctcctgcctcagcctcccgagtagctgggactacaggtgcccgccgccacgcctggctaattttttgtatttttggtagaggcggggtttcaccctgttagccaggatggtctcgatctgctgacctcgtgatccgcccgcctcggcctcccaaagtgctgggattacaggcatgagccaccgcgcccggccactgtattaggtgtattgttttgttttattttgttttgagatggagttttgctcttgttgcccaggctggagtgcaatggcgatcttggctcaccacaacctccgcctcccaggttcaagcgattctcctgcctcagccttccaaatagctgggattacaggcatgcaccaccacacccagctaattttgtatttttagtggagatggggtttcaccatgttggtcaggctggtctcaaactcctgacctcaggtgatccgcccgtctcagcctcccaaagtgttgggattacaggcatgagccaccacgcctgtcctaggtatgttttataacatacaaaaatagacattttacagaaggataaggtaaaataaatggaagtagcagttccaacgttgtctttctacacccagtggtgaattttaacaatacctcctggggtggagatcattgatcttgtagtagtaccttctcaatccattaggtctattgctctgatgaaatctagtttattcggtagaagtaaaatgtaatggctgggtatggtggctcgcgcctgtaatcccaccatttggaaggtcgaggtgggcggatcatctgaggtcaggagttttgagaccagcatggccaacatggtgaaaccccatctctactaaaaatacaaaaagaagctggctgtggtagcgggggcctgtagtaccagctgaggcaggagaattgcttgaagccaggaggcagaggtggccgtgagctgagatcccaccattgcactccagcctgggcaacaagagggaaactctatctcaaaaaaaaaaaaaaaaaaaggccgggcacgatggctcatccctgtaatcccagcactttgggaggctgaggtgggcggatcacgaggtcaggagttcaagaccagcctggccaacattgtgaaaccccgtccctaccaaaaaacgtacaaaaaaaatcagctgggcgtggtggcgggttcctgtagtcccagctacttgggaggctgaggcaggagaattgcttgaaagaaactgcggaggttgcagtgtgctgagatcgtgccactgcactccagcctgggcaacacagcaagactctgtctcaaaaaaagaaaaaaatgtaatggttaagatttaaattctaaagttttgaaatttaattctggagttgtgctgaggttaaaatcctgggaaccaatcctaacaagttttgagacttcaggctcattacttaaccttcttgtgcagttcattttcctcatctgaaaaatggagataaaatttctaccccatttgcaggtttattatgatggttaatatatgttaatatatgtaaagtacttaaaaccgtgcttgacacattctgttctggtggttgttagtggctgagggtataccatctgacttagggtctcagtctaggaggggccgtgcacaagtcaacaggtaatgataaagtgttttaagtgctttaagcgtaaggcttttgggaaggcaggggagacataactaattattccttgagattccaggtaaggtccagctaaaggggtgacattaaaccaggctttaaaggagaagggaggcttttcccaggagaaggaagggtgaagtctactggctgaaggtagttgagggcttggtgagtagtttatcagatctggacctacagggaacctgattgaagcttatataccttgttaatagtgaattctggctggagttgttcctggcaggggccagatggcaaagaagcctgttacagaacttttcacaccaccacagccctttccttctctctctggcacatacctcattctgccttcttagttatctaagaatataagcttctaaattataaactccttgagggttttgacaatgtttgcatttttgtaattttattttgcctagcaaggtaagtaggaagttcattagtgtcgagaaaggtatataatcattggaccttcaaggaagtctaaacagttaaaagtggaatggtaaatgaccatatttactagtgaaaaacttggttacaaatgttttgtagtagataggacctgtgcattactatttaaaaggggtaagaatgatcatcttcagtatccctttccttatctggcacttatccattgggattacagaagagatcggaaagtgcatcagaaaggcttgtctgacgttgaataggtaccttttgtttgctcttctaggtctgctttccatcctttttcaccctatcctgtgccctgggaagctgacttacctatatggactacatcaatgagcttccttcccctttgaggttatgaaatttattttcctactcccgtctcatgggttgtgcccttagctgactctgtcccttgactgaaggtcactgcttctctaaatgtggtcctctcggccgggtgcggtggctcatgcctgtaatcccagtactttgggaggctgaggccggcagatcacctgaggtcgggagtttgagaccagcctgaccaaaatggagaaaccatgtctctactaaaaatacaaaattagctgggcatggtggtgcatgcctgtagttccagctactcaggaggctgaggcaggagaattgcttgaacccgggaggcggaggttatggtgagcagagatcacgccattgcactccagcctgggtgacaagagcgaaaccctgtctccaaaaaaaaaaaaaaaaaaaaaaaagaatgtggtcctttctgtgtgacatcctccatgtaggtttggaaagtttttgttccctttggttgttgggcctagagatctagagatgctctcattagtcccagggtattacagctatcccttgtgcctatcttgtaccctgctcacatatttctttctagttccattattaaaccctccttgaattaaccttactggagtatgccatgtttcctgctgggaccatgactgtgtttgaagcttgtatactttttttttttttttttttttgagaaggggtctcactctgtcgctaggctacagtgcggtagtgtgatctgggctcactacaatctctgcctcccgggttccagcgattctcctgcctccgcctcccgagtagcagggactacaggcacacgccaccacgcccagctaatttttgtatttttagtagagatggggtttcaccatgttggccaggctagtctcgatcacttgacctcgtgatctgcccgccttggcctcccaaagtgctgggattacaggcgtgagccaccacacccagcttatttttattttttttatagagacaggatgtttctatgtttcccatgctggtctctaattactgggttccaatgattctcctgccttggactcccaaaatgctaggattgcagatgtgagccattgagtccagcccttctttgacttttgagtaagtttatcctagtttggaaccagttagttttctttttatcttactgtatttttaaaatttttgtttgttaattttgaaaccaggttatgagaccaacttttgtatttttggtagagacagggtttcttcatgttgcccaggctggtctagaactcctaggctcaagtgatccacctgccttggcctcccaacgtgctggcattaacaggcatgaaccactgtgcctggcccagttaattttctttcttttttttttttttttgagatggagtttcccttttgttgcccaggctggagtgcagtggcactggagtgcagttgctcactgcaacctccgcctcccagggtcaagccattgtcctgcctcagcttcccaagtcgctgggtttacaggcatgcgccaccacacctggctaatttttgtatttttagtggagatgggggtttcatcatgttggccaggctggtctcgaactcctgacctcaggtcatctgcccacctcggcctcccaaagtgctgggattataggcgtgagctaccgcgcccaacctgacctagttttcttatatacagaatcaaaaaatcagcagagaggttgggcgtgatggtggtgccactcagctgtagtcccagttactcggaaggctgaggtaggaggatcgcttgagcccaggtgttggaagctgcagtgatagtgccactgcactccagcctgggtgacagagagaccctgtctcaaaataataaaaaataataatggccaggcacagtggctcatacctgtaaccccagcactttgggaggccgaggcgggcggatcacctgaggtcaggagttcgagaccagcctggccaacatggcaaaaccccgtctcttctaaaaatacaaaaattagccaggtatggtggtgggtgcctatcatctcagctactcaggaggctgaggcaggagaattgcttgaacccagggggcggaaggttgcagtgagctgagatcacgctgcttcattccagcctgggcgaaagagtgaaactccgtctaaaaagaaaaaaaaaaaaaataagcagagagattgagtttaagcttgttctcaagtgttaaatgttgtataggttatgtgaatccagagttttaggcaggaagaatggtttaaatgatagtgcttaatgaatgattgcagccctgggatcaaaatgagttaattcactaagttcagggtaatgaaaataggaggaagaggtggggaagtaagatttctcacctgccaattttgttctcattccttagagtattgttttgaatctcatagaaagtgaccattcttttgtaaagatttacttcaaatccctgaaagcttggaggctaatgaagaagaatcactctggttattgtttaggctttagtaagattaccaaggaagggatctcataatgctgtagtaatagtttacatgtgcgacatgagctagtgtttgtacatgtgacagaccttgtttctggattttattaaggctggttaagtagctttttgcctctgtctctggtttctgtctctggccccttgaggctatctgaaattttaggagttggggtaccataacttgaacttttgaaatgagtcaataagcagatacgtcagccgagtatgactttaagtctagttgaattcttttaagaaaaagtcttggctagattttctgctgggcattttttatgtacatcaatcatctcatttaattatagatcaaacttgggagagagtatctctgttttactgataaggaaatcctgggcgacagagtgagactccatctcagaaaaaagaaaaaaagaaatgagttagagaatttaattgtccaaggtcacacagttaataagtagtagattcactcttcctaactagtttaatcttggtgtcaagttcattcattatgcattgagtgtccaaacacccatttattttttattttttattttttttaaagacagtctctgtcgctcaggctgagtgcagtggtgtgatcttggctcactgcaacctccaccaccgaggttcaagcagttctgtgcctcagcctcctgagcaactgggactacaggcgcccgtcaccacacccggctaatttttgtatttttagtaaagacggggtttcaccatcttggccaggctggtcttgaactcctgacttgtgatctgcccgcctctgcctcccaaagtggtgggattatagacgtgagccactgcgcccagccaaaaacccacttttttttaaccctctatcgcatggcttctttttgctagactaggggtttttagacatgtgttctacaggagcccagagcttcctgaagataattgatttcccataatctttcttcaactttctttccctaacaactcttcttatttaaaaaaaaaagtccaggccaggcgcggtggctcacgtctgtaattcaagcactttggggaggctgaggctgatggatcagctgaggttgggagctcaagaccagcctgaccaacatggagaaaccccgtctctaataaaaatacaaaattattcagccatggtggcgcatgcctgtaatcacagctacttgggaggctgaggtgggagaatcacttgaacctgggaggcagaggttgtagtgagccaagatcctgccactacactccagcctgggcgacagagcaagactctgtctcaaaaaaataaataaaaatttaaaaatttaaaaaagtccaaataattggggtatgatttaaagatagctatatgagaccttgttcaggggtatcctaagttggccttagagatgaattaaaaaaataaaaaggcaacagaaactgtcagcagtctttaacaattcatcccatatgtttcctgatcttagcagtgaagcagatgatggcagtgaacatcaaaagcccaagaaatgtccatgctaattttgcatggctctatgaggagctgtcaaatatggatcatcaaatatagtatatagactatgcaatgaagctttactttgcaatgtggctctttaagatttgattttacccttctattttgtgttgtaattaaatgcagaaatcaaagtataaattcagaataacccagagcttggtatccttctgtctgaatttatagctttggagttggctagacctttcagtcaaattagctgatggtgacaaatatgtaatgtgacctctgtagcagctccagtgaaatgttaatatcaggcatagcacagctcccttgatacactattttggccttttcctctcttacaaatgtttcccttatttctttgttaatttagccatctccatgcagaggtcgtgcctgcttttaatttttcgaagccacatgagaacagacatttaaacaacacagatttattcattttggccttgtatccctagagctacactaactttatgtctgggactaaaggtggaagtagctgagattagggaaatgcagaatggtgagggagaagtgccgggagaggtgatggttttagctcctgcattccccagccaattgctgaaattcagctccccattaattttcccttgataagttggtctggctaagtagttgaaactatattcttagccttccttttttttttttttttttttttttttttgagagggagtctcactttgtcgccaggctggagtgcagtggtgcgatctcggctcactgcaacctccgactccctggttcaagtgattctcctgctgcagcctcctgagtacctgggattacaggcacatgccaccacacccagctaatttttgtatttttagtagagacagggtttcaccatgttggcctggatggtctggatctcctgacctcaggtgattcgcctgagtcagcgtcacaaagtgctgggattacaggcatgagccactgcgcctggcctaattacaaaatttacttaattttttattttgtagagatgaggtctcactttgttgcccaggctgatctcaaactcctgggctcaagttattctcccacctcaagctccgaaagtactgggatcacaggcgcaagccaccttatgtggcactagccgggattatagacaagcgtcagctaatttttgttgttgtttctgtcagtccttccttgcttattagttaatattcttctgcagagcattttcttatctttgtgtatatatattaatatggatttatggattcttattttaatactctgttactgtcattatttgttgtgttcacattgttccagatttggccagggagatccccttcaagctggcttttgtgtcattttgacacattcccacattttttaactgctttttttgacacaccaaaaaggtgttgtaggcttagtttctgctcttcattttttttttcttttttttcgtgtgtgtgacggagtctcgctctgtcgcccaggctggagtgcagtggcccgatctcggctcactgcaagctccgcctcccgggttcacgccattctgcctcagccttccgagtagctgggaccacaggcgcccgccaacacacccggctaattttttgtatttttagtagagacggggtttcaccgtgttagccaggatggtctggatctcctgaccttgtgatctgcctgcctcgacctcccaaagtgctgggattacaggcgtgagccaccgtgcccggcctagtttctgctcttcttaccctcttcttggaatcggccatttctccaaactgtttctctcctaattcctttcagtggagaaaattatttagaaatcaagatttggaggccgggcgcggtggctcacgcctgtaatcccagcactttgggaggccgaggggggcggatcacgaggtcaggagatcgagaccatcctggctaacacggcgaaaccccatctctactaaaaaatacagaaaattagccgggcttggtggcgggcatctgtagtcccagctactccggaggctgaggcaggagaatggcgtgaacccgggaggcggagcttgcagtgagctgagatcgcgccactgcgctccagcttgggtgacagagcgagactctgtctcaaaaaaaaaaaaaaaaaaaaaaaaagatttggatgctgtgtgtgctcattcctattggaatattgttttttagaacttcttaatggacagagctaggaaatatatacacacacatacatatacacatatcaaaaaatatgtatctaaatttctttctttctttcttttttttttttttttttgagatggagtctcgcccagtcgcccaggctggaatgcagtggcgcaatctcagctcactgcaacctctgcctcccgggttcaagcgattctcctgcctcagcctcccgactagctgggattacaggcgcccgccatcaggcccagctaatttttgtatttttagtagagacggggtttcaccatgttgaccaggctggtatcgaactcctgacctcgtgatccgcccgcctcggcctcccaaagtgctgggattgcaggcgtgagccaccgcacctggccattttgtgtgtatttttaggaaaaaaattattgtataaaactagatagcagtgaaatatattcattttgtatggtttatttatttatctttttttcttggtgcttctgtcttggcagagtctcagaataacttgaaatctttttaaattttttgtgacagggtcttactatgttgccccggctggcctcgaactcctggcccaagcgaatctcctgcctcgatctcgcaaagtactgggattcaggcatatgccactatgcgtggccaagatgtaatttatatacaatcaaatttactttttttttttttgtcagtgggtagagaaaaaaacttgctctttttcatggcatagttctattagttttgtattattagtatgcagttgtaatcatcaaaccagatagagataattttcattcttcctgtaagttttctcacacccctttcttttcacctcgctcttggaagctactagtttatactggtttttgtcactcacagttttatgggggtttttgtttgcttgtttctctactttttcttttctataatgtcatatacatggaatcatacagtatgtaacctttgtgtctgatgtgtttcacttaccataatgcttttgagattcatccacgttgtgtcatgtatctataggttgttcctttttattgttgagtaacatgttatgttcaccagctgatggacatttgaactgtttcccattttgatgattatgaataaagctttaaatattcatatacggttctgcatgtggacatatgtttttctctctcttggataaatacctaggcatgggattgctgggttctatgataatttcatatttaactttttttttttttttttttttttaagatggagtcttgctctgtcacttaggctggaatgcagtggcatggctcacggcagcctccgcctcctgagtttaagcaaattctcctgcctcagtctgccgagtagctgggattacaggtgtgcaccgccacgcttggctaatttttgtatttttagtagagatggggtttcaccatgttggccagactgtctcgaaatcctgacctcaggtgatccacccaccttggcctccaaaagtgctgggattaaaggtgtgagccaccacgcccggcctatacttaacttttttggaaactgccaaaatgttttccaaaatggctataccataccattttgcatttccactactaatgtatgacagtttcacttgcttgttggtatttttgttttgttttgttttagaattaattgttaaggaagcactatatctgggtgaaatcaattttggtcatctcatttctacaatgaaaggaatactctctgttacttgttttagaatgtagggtcccttgctatttatattcttttggggttagtgcagttcttatttacacatcatttgcagaaataatggtaactaccatttgtgtatcagaacaattttcacatatctaatttttatagcaattaaggtaggtagaagtgtcttcatcctcttaacttgtataaggagattggttcgggtaatcaggtgatttactcactgtcacacggctagaatgtgagagtgtggctttttggatttggagctgtgaggggacattctgtctctcttttaagtagaggtgtaatagaggaagatatgggtgtcatcccagtcctttcttttacctcaaattcataagcagtgcagtcttgaacaattcatatttgaattttgagttaatttcatcttttcacctgtctacctgaaaaggtgagaatcagttgagggactgttaaaggatgttttgaacactgtatgttacctcatgattaattttatagtactctccatttgtagtggtttccatagttgtttatgggaacaagtttgcagaaaaaaaatggttgaatagaaatagaaggggtcggccgggtgcagtggctcacgcctgtaatcccagcacttagggaggccgaggcgggtgaatcactggaggtcaggagttcgagaccagcctcaacatggagaaacccccatctctgctgaaaatacaaaattagccaggcgtggtggtgcatgcctgtaatcccagctgctcaggaggctgaggcaggagaattacttgaacctgggaggcggaggttgcagtgagccgagatcgcgccattgcactccagcctgggcaacaagagcgaaactcttgtttcaaaaaaaaaaagaaagaaatggaaggggtcaggtgtggtggcttaggcttgtaatcctaacactttgggaggctgaggcacatggatcacttgatatcaggagttcaagaccagcctggccagcatggggaaaccctgtctctactataagtatgaaaattagccagactggtggcgcacgcctgtaatcctagctattagggaggctgaggcaggagaattgcttgaacccagaaggtggaagttgcagtgagctgaaatcgtgccactgcactccaacctaggggacagagtaagactgtctcaaaaaaaataaaaataaaaaaagaaaagaaatagaaggggctgggtatggtggctcaagcctataatcccagcattttgagaggccacagtgggaaaattgcttgagtccaggagtttgagaccacactgggccaacacagaccctgtctctacaagataataataatagtcataataatataaattaatacaaaaaagaagagaagcaatttaatacaagagctgaatagcaaaatggccagtactactacaatacacacagagacacaggtcccctcttttttcatatttactttgttttatgtaatacataaatacattgaaaaaaattaatacagataaaataaaaatccacttcctacactaagtgaaaccattaacaactgtattatggagctgttagatgcagggattgcgctaagtgccatagggctgccaaggtaggtaagattcggtcccggtcctcagtgattttctagttttccttctgtgccctaacagtttttggatagctcttgtaataaaaacttttaaacagatgttttaagtttagatagtgattaaccatcttttcctcttgtaattgatgccatcgagtgagagttctgttgggaaatagtgaaacaaggattctggttcaatcaatggaggcagggaatttcggaggaaggagatgggatgccatccatgccccagagccactgagcacttagctgcagctgtggagagcaacacttggctagctatgagttttctgtaggtctctaaatagttcatgctaattttgtggatgttggactctgaggaatggtgtgttcaatggggagaatgtccaaaaaaactgtaactggtaagtagccatttggaatactgaaatcaatttctgattatgtgaatgtcccttttttgtaaattattttagcttacttgccagttcagtttcttggtgttaccctgttagttaaattcaatatgtcatttatttaagggcctgatatttgtattctattagaaggacaaacagctaattatactagaaggtggactataatgaattgtcattacagtgactaaaagttattgattttctaggatattcttgatttcagatatttactttgacaaacgtttattgaattccttgtatcagatcctgggggatataaagagttctgaggtcctggaggactatgtagtccagtaagggagattgatagcttcagtaccaaatgctaagcagtgttaatggcaagtaacatcctaccaaggatgggcatctgacctaatgtgtaagtatgcatgtgtgagtgtgtttcaaaaaaggcttcttagagaaaatgatatctgttttgagccaatctgtttttccttacaacataaaaaaataatttttggactggctatgtatttagctaatttaacatttgaaacgaacaaagaatacttattgaagtttctctcacctctgcaccagccagtcttttccccttcctggaagcagctagcattaccatttttttctggaccctttcgatacattcctgtaggccatataatgtcggtaggtaaagaacttcctcattttgcattgtatttcattgtatgactgcaccatactttttcccccctactgctgatggacatttacctttcaatcctttgctgttgcaaacaatgctgcataaccttgtagcaattgtcttttcatagatctgtagagtaaattcctagaagtagaactgctggggttaaggggtttgcctgtttgtgtaattttgatagatgttgccagaataccctctggagaggtatatcagcttttatactcctaccagcaaagcatgacccaagtgaagaatgggtaggagatgggtgaagttgaggctgggtcaggtttatgagtgtgagggggactgaaagtagttatgtattattgaagtgtgaagtgctgggtaaagaatagcaggagatgagagtaggaagcagacgggtcaggtccctttgcctttgtgctgtttttgtttgtttgatagcctcttactctggcccaggctagagtgcagtggcgcaatctcagcccactgcaacctccgcctcccgggtttaagtgattctcctgcctcagcctcccaagtagctggtattacaggtgtgcgccaccacacctggctaatttttgtgtttttggtagagatggagtttcaccatgttgctcaggctggtgtcaaactcctgggctcaagtgatctgcctaccccggcctgccaaagtgctgggagaacaggtgtgagctactgcaccccgcctgcctttgtttttatgcttgtatttttttgtttgtttgtttttttagcttttaagttgagggctacatgtgcagatttgttacataggtaaacttgtgtcatgggcgtttgttgtacagattacttcctcacccaggtattagcctagtacctgttatttttcctgatcctctccctcctcccaccctccactttcccataggctccagtgtgttttgttcccctcttatatgtctatgtgttctcatcatttagctcccacttgtaagtgaaaacatgcggtatttgcttttcttttcccatgttagtttgctaaggataatggcttccagttccatccatgtccctgctgcaaaggacatgatcttcttttttatggctgcatttataagacaagaggggtttatttaaacttctgctatcagaagtaggaaattgggatcccattagggcttaacttaattggtttgatttcagctttttagcttggaggctgctgaagagttaatttattgtatgagagtttggccgtgtgtggagcacaaacttacttgttttaaagaaaggatttctttgtacatttattcatttgccagatcagtcgtttacatgtgaaccctcttcacagttagttatagggaaaacaagcagataattcatgccagttaaatattacaatatgtcagacttggctgggtgtggtggctcacacctgtaatcccagcactttggaaggctgaggtgggcagatcatctgatgtcaggagtttgagaccagcctggccaacatggtgaaatcccttatttactaaaattacaaaaattatctgggtgtggtggcacacacctgtagtcctagctacttgggaggctgaggtaggagaaacacttgaactctggaggtggaggttgcaatgagtcaagattgcaccactgcactccagcctaggcgacacagcgagactccctctcaaaaaataaaaaataaaaagaacacgacacactgattcagatcccaagattaagggggaaaacaaggcttcagattttattaaacttatcctaaataatgatgtttttaaaaggaaacctttggggaaataatctgtcggtaacagatgtctaaatttttccttatttgaaaaggtcctggctgggcacggtggctcacacctgtaatcccagcaatttgggaggccgaggtgggtggatcatttgaggtcaggagtttgagaccagcctggcccaatgtgatgaaacctcgtctctaccaaaaatacaaaaattagctgagcatagtggtgggctcctgtaatcccagctacttgggaggctagggcaagagaatctcttgaacgtgggaggcggagcttgcagtgaactgagatcacaacactgcagtccagcctgggagatagagtaaaactctttttttttttttttaaatacaagttctagggtacatgtgcacaatgtgcagttttgttacataggtatacatgtgccatgttggtttgctgcacccattaactcgtcatttacattaggtatttctcctaatgctatcctgccccctgccccccaccccaccacaggcctcggggtgtgatgttgcctgccctgtgtccaagtgttctcattgttcaattcccacctgtgagtgagaacatgcggtgtttggttttctgtccttgtgatagtttgctcagaatgatggtttccagctgcgtccatgtccctgcaaaggacatgaactcattgttttttatggctgcatagtattccatggtgtatatgtgccactttttctttttttcttgtttttttttttttggagacagagtctcgctctgtcgcccagactggagtgcagtggcgctatcttggctcactgcaagctccacctcccgggttcatgccattctcctgcctcagcctcccgagtagctgggactacaggtgccctccaccacgcccggctaattttttttgtatttttagtagagacggggtttcagttgttagccaggatggtctcaatctgctgacctcgtgatccgcccgcctcggcctctggaagtgctgggattacaggcgtgagccaccacgcccggccacattttcttaatctagtctatcattgatggacatttgggttggttccgagtctttgctattgtgaatagtgccgcaataaacatacttgtgcatatgtctttatagtagcatgatttatgatcctttgggtatatgcccagtaatgggatcgctgggtcaaatggtatttctagttctagatccttgaggaatcaccacactgtcttccacaatggttgaactagtttacactcccacccacagtgtaaaagcattcctatttctccacatcctctccagcatctgttgtttactgaccttttaatgatcgctattctaactggtgtgagatggtatctcattgtggttttgttttgcatttctctgatgaccagtgttgatgagcattttttatgtgtctgttggctgcataaatgtcttcttttgagaagtgtctgttcatatccttcacccacgttttgatggggttgtttgtttttttcttgtaaatttgtttaagttctttgtagattctggatattaaccctttgtcagatggatagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatacctgtgtcctgaatggtattgcctaggttttcttctagggtttttatggttttacgtctaatatttaagtagttagtccatcttgaattaatttttgtataaggtgtaagaaagggatccggtttcagttttctacatatggctagccggttttcccagcaccatttattaaatagggaatcctttccgcatttcttgtttttgtcgggtttgtcaaagatcagatggttgtagatgtgtggttttatttctgaggcctctgttctgttccattagtttatatatctgttttggtaccagtaccatgctatttgagcaaaactcttaaaaaaatggtttatgtaaagagaaaagtaacagaaaaaaggctgtcttccaaaaggattacaggtgtgagccatcatgcctggccataaactttttattaaatagacaaaatgcataaatcataaatgtacagctcagtgaattttcacaaagtgatcatacctgtgtagctactatgtagatcaagaaataaagcattagggcatggtggtgcatgcctgtagtcccagctactcaggaggctgaggcaggaagatcacttgagcccaggagttctgaggatgcagtgagccatgatcatgccactgcactccagcttgggctacagagcaagaccctgtctcaagaagaagaaggctgggcacagtggcttacgcctgtaatcccagcactttggaaggccaaggcagggagatcacttgaggtcaggagtttgagaccagccaggccaacatgtgaaaccctgcctctactaaaaatacaaagattagctgggcgtggtggcatgcgcctgtaggcccagctacgtgggaggctgaggtaggagaatcgcttgaacccgggagggggaggttgcagtgagctgagatctacgccactgcactccaggccagcgacagagcgagactctgtcttcaaaaaacaaaaattagccgggcatggcggtgtgcaggcggtgtgcacctgttaatcccagcctctcgggaggctgaggcaggagaaccacttgaacctgggaggcaaatgttgcagtgaaccaagatggggctactgcactccagcctgggcgacagagcgagactccctctcaacaaaaaaaaagtaaaagaaaacattaacagcaaccacttcagaagcctaccttcttacttgccagtcactgtccctccttctccaaggggtaaccactatcctgacctctatcaccattcattagttttgctttattctttttgaactttatataaagagtcatataatgtgcattcttccatatctggcttcttttgctcaacagtaatgatacatgatcttgtgttagtaataatagtccattctcaaatttctgtctagggttttgccacagtaatataccacagtcggtccattctgctgttgaggtatattctgattgtttctagttttggactattaggaataacgctgcagggaacattcttctgtgtatgtgggtgcacgtatgtatgtctttttttttttttttttggagacggagtctcaactgtgttgcccaggctggagtgcagtggcgcgatctcgggctgactgcaagctccgcctcctgggttcaagcctttttcctgcctcagcctcccaagtagttgggactacaggctcctgccaccaagcccagctaattttttgtatttttagtagagacagggtttcactgcattagccaggatggtctcgatctcctgaccttgtgatccacccaccttggcctcccaaagtgctgggattacaggcgtgagccaccgcacccggccacgtatgtatgtctttttgttgggtgtatgcctaggaatgggattggagggacatacagtgtgcatatgttcagctttagtagatgctgctgctgtcaaagttttccagagttgttctatcagccaatgcttgcatcagcagtctgtgagagttccatttattacacatcctctccagactaacaacttgctgttgttaatgtttaacctttttgaagagcctctgctttgtgagataggtagagggcatacagtcgtgaagaaaacagtgctgctttcatagaccgtaatgggtttttttgttttttttttggtttttttttttgagatagagtctcactcttgtctcccaggctggagtgcagtggcacagtatcagctcactgcaaccttcacctctcaggttcaagcgattctcctgcctcagcctcccaattacagctgggattacaggtgcccaccatcacgcccagctaatttttgtattttttagtagagacggggtttcaccatgttggccaggcaggtctcgaactcttgaccttgtgatccgcctgcgttggcctcccaaagtgctgggattacaggcgtgagccaccgcacctggccagattagctggggcatggtggcaggtgcctgtaatcccagctacttgggaggctgaggcaggagaatcgcttgaacccgggaggaagagattgcagtgagccaagattgcgcaactgcgctactggccgggtgacagagtaagactctgtcccaggaaaaaaaaaaaaaaaaaaaagaatgttgtacctgtttaatatatttaggtgttgataagtacttgctgttttttgttttgtgtttttttttgttgttgttgttgttttgagagggggtcttttgcccaggctggagtgcagtggtgcgatctcggctcactgcagcctctgcctcctgggttccagcaattctcctacctcagcctcccaagtagctgggattgcaggcaccggccaccatgcctggctactttttttgtatttttagtagagacaggattttaccatgttggtcaggcgggcctcgaactcctgacctcaggtgatccacctgctttggcctcccaaagtgctaagattacaggcgtgagccaccgtgccctgcctttgttttttttttttttttttttttttttgagatagagtcttactctgtcacccaggctggagtgcagtggtgcgatctcggctcgctacaacctccacctcttgggttcaaacgattctcctgcctttgcctccccagtaactgggatgacaggtgtgtgctaccacaccgagctaatttttgtatttttagtagagacggggtttcaccatgtctggagaggagcagtccaggcaaaggtaatagcgggtgttgaggccctgaggtaggaacatgcttgatatgtttaaagagcaccaaggaggctagcatggctggagcaggggatggagcgaaaagctgatgtcagggaggtagatgggggccagagcacacagcgcatttggggtcatggtaaggattttggatttgctgaatgaaatcagttttgagcaggagggtgacattatcccctttaccttttaaagagattgcttttatttatttatttattttattattattatttttaaagacaaagtcttgctctgtcctataggctggagtgcgatggtggggtcttgctcactgcaacctccgcctcctaggttcaagtgattctcctgcctcggcctcccgagtagctgggactactggtgcctgccatcacacctggctgattttttaattattagagatggggtttcactgtgttggccaggctgttcttgaactcctaaccttgtgatccgcccgccttggcctcccaaagtgctgggattacaggcgtgagccactgcactgggtctaagagattgcttttagagaaaacacctagtgaatcaagggaggaggtaggaatgtgaattaagaagttactgttggccgggcttggtggctcacgcctgtaatcacagcactttgggaggccgaagcgggtggatcacctgaggtcaggagtttgagactagcctagcaaaaacatggtgaaatcctgtctctactaaaaatagaaaaattcactgggtgtggtggcaggcgcctgtagtcccagctacttgggaggctgaggcaggagaattgcttgaaacctggaggtggaggttgcagtgagccaagatcgtgtcactgcactccagcctgggtgacaaagcaagactccatctcaaaaaaaaaaaaaaaaaaaaagtgtggcactgcacaccagcctgggtgacggaaaacgtgtccttggccaaatagtggtatcctgctcaatgagggataatgttatttatgctataatatctacctattatttattctgtagtgttctgcattgacactatagttttttatttttatttttttattgagatggagtctcactctgtcatccagcgaggctgaggtgggtgggtcagagacctcaagtttgagaccagcctgacaaacatggcgaaaccctgtctctactaaaaatacaaaattagtcgggcatggtggcgtatacctgtaatcccagctaattgggaggctgagacaagagaatcacttgaactcgggaggcagaggttgcagtgagccgagattgtgccattacactccatcctgggccacaagagggagactccatctcaaaaaaaaaaaaaaaaaaaacggggcggggggaatatcttataattactttcctaaagatagctttcaaaaattacagtgtcgagaaggctcatacctgtaatcccagccctttgggaggacaacacagaagaatagtttgagaccatcctgagcaaaatagcaagaatgcatctctacaaaacataagaaaaattagccagtagcacacctgtaatcccagttactcaggaggctgaggcaggaggaggctaagcccaggaggttgaggctggagtgacctgtgatcatgtcactgcactgtgcctgagagacagagcaagacccggcctcaaaaatgtaaaaataaattcaaaaaatgaacaataatttaaaaactacagcgtcagacgggcatggtggctcacacttgtagtcccagcactttgggagtccgaggcgggcagatcacctgagatcaggagttcgagaccagtctggccaacatagtgaaaccccatctctactaaaaatataaaaattagctgggtgtggtggtgcatgcctgtaattccagctactcaggaggctgaggcaggagaatcccttgaacctagcaggcagaggttacagtgagctgagagcgtgccactgcactccagcctgagcaacagagtgagactccatcttaaaatataaaaataaaaaactatagccaggtgcagtggctcacgcctataatcctagacttcgggaggccgaggtgggcagatcacaaggtccagagttcgagaccagcctgaccaacatggtgaaaccctgtgctgggattacaggtgtgaaccaccatgcccagccaagacattctttaaaaatgcctagcaaatatagtaaaaagtaaaaattctctttcacctcatcgctgaaagtttctgtatattttcaggctttttggtatacctttatacacatctgtaatactcacgcagtgttttttctaaatggaatgatactgtacataatactttgcagtttttataatttacagtcagatgggaaggacacaaaactattctagaagatctttgctttaaacagtagtgaagacatttatctcttctgttgttttaagtgccttggaacagattttatgaacaacagcaacattcgatattgatttgctcagtgttagtagtgagatgcctttagtagtgagatcacacctttcagagaactttctaaatgctctgtaaataaaagcagatatgtgatggactgcttcatgatgttgccaagcaccattcacatccttttccctttctcagaaagtgcagagtcatccattttggagcagttagttcttgcagatctaccaattacctgtggttataggagatgatgtttctctatctgcctgaaagtggaaaaaggaattaatgaacctgtgaagttcagttctgtaactagacagagctgtgctggaaatgaaaataagtcctttctgttattcatgacatatgggaagaaaagcttcaggtagatcaagctctgcaggcctaaatccacagaagccttgccaattttcagctcattattgccatcaaggtattttggtgattatttccactattgtaaactaattcataggactggtttttttggtttttttggtgtttttttttttttttgagacagagtctcgctctgttgtccagactaaagtgcagtggtgtgatcttggctcactgcaatctccggctcaatcactcaagtgattcttgtgcctcagcctcttgagtagctgggactgtaggtgaatgtcaccatgcacagcttttttgtatttttagtagagataaggtttggtttggttagtagagcctaggttggctaggctgctatattttgcctttttttttttttttgaagacggagacttgcttgcaacctccgcctcccggttcaagcaattctcctgactcagcctcccgagtagcttgttctacaggtgtgtgccaccatacctggccaattttttgtatttctagtagagatggagtttcactgtgtgggccaggttggtctcaaactcctgaccttgtgatccacccgcctcggcctcctaaagtgctaggattacaggcgtgagccaccgtgcccagcttacattttgcttttattttttttgagacagagtctctctctgtcacccaggctggagtgcagtggtgcaatctcggctcactgcaaccttcaccttccaggttcaagtgattctcctgcctcagcctcccaagtagctgggactacaggcacgtgcaaccatgcctggctaattttttgtattcttagtagagactgggtttcattgtgttagccaggatggtttcggtctcctgacctcatgatccgcctgccttgcctcccgaagtgctgggattacaggcgtgagtcactgcatcctgcctacattttgattttaatgtcttactgttaatgatccatgcaccaaattcccatgctgttagtatttttctcagaatgacaaaggaattgaaatgccattgtgggataaaattaaatattgtcaaaggcctgctctgagccagtctatggactaggtagatatattggggagataatgaagtaggctcttgttggaaacagagcagaccaaaccaaacagaaaatgaatttgtcagaccaggcacggtggctcactcctgtaatccccacactttggtaggctgaggcgagtggatcacctgaggtcgggagtttgagaccagcctgatgaacatgaagaaactccctctactaaaaatacaaaaaaaaaaaaaaaattagctgggcatggtggcacatgcctataatcccagctacttgggaggctgaggcaggagaatctcttgaacccgagtggcagaggttgcggtgagctgataacacgccattgcagtccagcctgtgcaacaagagcgaaactccttctccaaaaaaaaaaaaaaagtgaatttatctgtgtcttggttttctttttttctttctcttcttttttttgagacggagtctggctctgttgcccaggctggaatgcactggagcgatcttggctgactgcaacctccgtctcccgggttcaagcgattctcctccctcagcctcccaagcaactgggactacaggctcacagcaccatgcccagctaagttttgtagttttagtagagacgggctgtctcagttttcaaataatgaaggtgaattcaactggtaaatgtaggtttctattaaataatgattaaggaaagaaaaataatatttggccctctgtttctgtgggttttgcatccatgaattcagccaaccatggatcgcaactattcaggaaaaaaaatatacagattgtggctgggcaccatggttcatgcttgtaatcccagaactttgggaggccaagatgggcagatcacctgagatcaggagttcgagaccagcctggccgacaaggtgaagccccatttctactaaaaatgcaaaaattagcccggtgcagtggcatatgcctgtaattccagctattcaggaggctgaggcgggagaatcgcttgaacccgggaggtggtggttgcaatgagtcgagattgctcaactgcactccagtctgggcaacagtgcgagactctgtctcagaaaataaataaattatttaaataaagagtattagaggtatgggtaggttatatgcaaatattataccattttacgtaagagacttgagcattggtggattttggtatccacacggattccttgcaccagtctaccgtggatactcagggacaactctgtgtatggtatacaccttggtgtgtattctaatcatctgggaagcttgtgaaatgtaggttcaccccctggatttttaaatcctggaaggtctggggtagggtccaggaatcttcattttcagcagcagggttcctaaataattctcttagaggtaacctgaagactcctttgaggagcattggtgtctcagagggtgtctaaacctgacaaagaccatctaaatctagttggctgagccgggcacggtggctcacgcctgtaataccagcactttgggaggccgaggcaggcggatcacctgaggtcgggagttcgagaccagcctgaccaatgtggaagaaacctcatctctactaaaaataaaaaattagccaggcatggtggctcgtgcctaatcccagctactcgggaggctgaggcaggagaatcgcttgaacctgggaggcagaggttgtggtgagccgagatcacgccattgcactggagcctgggcaacagagcaaaattccgtctcaaaaaacaaacaaaaatctagttggctgaagagttatggggaggaaaaactattttgatatagcacaaactttgtgataaaagtgataaacggagataactgagaaactattaaggaaagagatcagttaacgctcactgaggtagggaggagaggcagatgtctgattttatgttaaacttgaggaatatatctttcatttgattgccttgttttatatacctcataatgctatattgtcttggtaaccaagctctcatatctgtatattactgcagtcctggggcatctctaacttctaacatatactacttttttgataagctattgaactgtcctaagtaggccgggtttggtggttcacacctgtaatcccagcactttgggaggccaaggcaggtggatcactggaggtcaggagttcgaaaccagcctggccaacatagtgaaacccagtctctactaaaaatgcaaaaattagctgggtgtggtggcacgcatctgtattccaagctacttgggaggttgagccagagaattgcttggacctgggaggcagagtttgcagtgagctgagatcatgccgctgcactccagccttggtgacagagcaagactgtatctcaaaaatgaaaaaaagaaatatcttaaataacttttcaacgttcaaactaactcgtggactatggcataaaatcatttgttactcatgagtgttttcgtttatttgttcaggaaataatcactgtttttacacacgcacgcgcacacacacacacattttcacctgccatcacatacacacacacacactttcacctgccatcacacacacacacacacacacacacacacaattttcagctgccatcctagatagtttaccaatattgatgagtctttcttaatggggggacatttctcggaggatttaagtataggttaagtcgatttaaggctttagggggagaagaaaacatttctcaattataaagtatacaactaggaagaaattcttatttctcatattctgtttatttagcactatccattcatttagcacatttacttgtattgacactaccatgcttatgaagccgtgatggctagggagtaatgagcttgttttgctagtgttatcttctataaatgttctaaattaagtagttggggaagtggttaatgacaaccaaatttgtaatctaggattgttaccctctaatcaattctttttaaatttcttcctgacatttatcttgttataataataactctctgacattattattataacaaaattgttgtatttgtgttttggggataaaaggcatattttagcatcctatagtttaaaatggtgtttgttttaatctgggtgataagatggaaatgctgacctgggcttgcctgatctacagctaacattgttctaataaactgcatggagtccaggtgttttactttaactgcagctgtaccatctgtgggagcaggtggacagattctgtgtcatcaggaaaatacagctggtgagactaaggagaagagctaattgattgcttttccagctctctccagtcatatatacctaagcatagcatttaccttggcacaggtgttgcctttggtctggatagtaacagcaaaattgaacaaaaaaagatgtaaatttgagctgcgtgtgtgtgtgtgtgtgtgtgtgtttcttggttggcattgagaaagataatttaagggttttttgtttgtttgtttaggttttatttttgtttttagttacttgaagatatttccagctcgttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagtaccagggcctggttccttggagaattgggttaaaattcaaaataaccttctaaaaaattctttcagaaacgagtagtgaaagccagtggatcaaattcagtgatagttaacagagaaacagcagcatagataagtaagccaatttaatgtagggagcaaccactagtgtacatgatctcagctcatctggtactaccaagtaaaaatgaacctgggccagccacagtgactcatgcctgtactctcagcgctttgggaggccaaggtgggaggattgtttgaggccaggaatttgagaccatcctggtcaacatagcaagaccctgtttgtttaaaaaaaaaaaattaaaaaaataaaaatttagctgggcttcgtgatatgtgcctgtagtcccaacctacttgggaggctgaggtgggaggatcatttgagcccaggagttcaaggctgcagtgaggcatgattgcaccactgcactgcagcctaggcaactgagtgagaccctgtctcacaaaactaataaataagtaaataaataaaacagaacctgtattatagtgttattttagaaacaattataccattgagatgcatgaagagagctagtagttttgcctatcatacttaaggtttaacttcttcagcttaagagatatatgagagcagcttttgagaggatttaaaagatccctaaaaaaagaaaatccaatggaaaggttcaaaaacttgtgtctgatgaagagaaaatacagaagtttgataagcctttaaggattgttttgtagaagttggctagttgtatacttatccctttagaactagacaggaaggggcaaatttaccttagccatggggaatatagatacgcattgtagattctgggtatgagcagcagcattgccacctgggaacttgttaaaaatgcagaatctgggctctggcccagacctactgaatttgcattttagtaagatttcccaggtgattcatatgaacattaaaatttgagacatattgggataaatcataggctttattttttatttatttatttttttttatattttgagacagtcttgctgtgttgcccaggctggagtgcagtggtgcaatcttggctcactgcaacctctgcctcctgggttcaagcagttctcctgcctcagcctcccatatatgtttgcagcctccctgaattataatttaattacagagtctatcttaattaaataataaagatcattcttatttttcaaaagcatttaaaaaaatggggttcttatctagatgagagaggttttactccataaggatcacagtctagtgatccaataagcaaacaaacgtgtactaaaaccccaggtggggataaatactttgaagaaaaataagctaagattggagagtctttcagtttaagacctaatttattccctatgtgttgtgttttttgttttgttttctttttttcccaggatggaatttcacccttgtcgcccaggctggagtgcagtggcatgatcctcaccgcaacctccgcctccctggttcaagcaattctcctgcctcagcctcccgagtagctgggattacaggcatgcgccaccactcccggctaattttgtatttttagcagagacggggtttctccatgttggtcagactgatctcgaactcctgacctgaggtgatccgcccgcctcggcctcccaaagtgctgagattataggcatgagccaccacgcccggccagtgtgttgtgctttttttttagtttttaatggttatcacttgtaggtaggttttagagcagacttcagttttttgggtttttttgtccctctttttttgttttctcgttttttagacttcagttttcaggacaaaaatatgtacaggttttaaaattattattattattaaaagaattaccttaactcagtgcctggcacatagttaacatttaactgggaatgtttcataataaatctcaagtaagatcttaagaaaatcaacactgattgttacctgtcacaagtcacgtgggctgagatttctggctaggcaggaaagaaagaaaagttcagtcttttgttctctttttcatattattatgatttttggattctgtggattccagaatcagagtttgaacagagaagtggtttctacactttgttgcataccagatgggtatggttttggaataatgaaggggctttcagactgtgggttcttgagtgatttatgacatttctcccgctttgtagttgtttttcttggaacttgcctagatgggcatgccatgaacttgcaaacgttgttctcattttcaaataaaataattttgttgcaatttatttttaggattaaaaaaaaaatccagatgctcacttaaatacataagaagacaaaccaggatcaatcttaataggagaaaggtatacatgtagaggggaattaactttatgcttgctatgctagaaatgagctggttgagttgcactcaggtaatagtatggtaaggtatatttttttggttaatttgaaaagaaaatgtatatatgtatgactgctatatatgtcagaaaatgtgacaaatagcttttttttgttgttgagatggagcctcactgtgttgcccaggcatggagtacagtggcacgatctcagctcactgcaacccttgcctcccgggttcaagcaattctcctgcctcagcctcccaagtagctgggcttacaggtgtgtggcaccacgcctggctaatttttgtattttttaatagagaagagatttcaccatgttgtccaggctggtcttgaactcctgacctcaagtgatccacctgccttggcctctcagagtgctgggattacaggcgtaagccagtgcacccggccgctttttttgtaaatggctttgttgagatataattcacataccctacctccatttttttttttttttgagacagagtttggctcttgttgcccaggctggagtgcaatggcacaatctcggctcaccacaacctccgcctcctgggttcaagtgattcttatgcctcagcctcctgagtagctgggattaccaggcatgtgccaccatgcccggctaattttgtatttttagtagagatggggtttctccatgttggtcaggctggtctcgaactcccgacctcaggtgatcttcctgccttggcctctcaaagtgctgggattacaggtgtgagtcactgcacctggccctaccctacttctttaaggtatacaatttaatagtttttagtatgttgacaaggttttataaccatcactgcacacagtgcagtgaatatttatatcactccgaaaagaaaccccatacccattaacaattactgtctatttttcctttccccagtccctaatctacttttttatttttcccttgagatggagtctgactttgtcacccagattggagtgcagtggtacagtcacagctcatcgcagcctcgaccacctgggctcaagcaattctcccactacagcctcccaagtagctggaaccactggcacatgccaccatgcctgtgaccagtttttaaattatttgtagagatgaagtctcactttgttgcccaggctggactcaaactcctgagctcaagcgatccttgtgccttggcctcccaaagtgttggaattacaggtgtgagccactgcacctggccacgtaatctactttctgtctatggatttgcctttgtgttttttattggtgattggccttcaagtataatgctgaagtgctgtctcctgtttccaagagctagaaagctatgctgtactttagaggaaaatatattaaataagctttgttcaggctgtttgacatgttaatgaatcctcccgccttggcctcccaaagtgctgggattacaggcgtgagccaccgcgcctggccttacatatattttaagtaaggtgttaacactatataattcatctgtgtaacccaaaactactgtatccctaaggctattgaaatttaaaataagtaaataaataaggtgtctttcatcagaaacacataaaaaagaaggtgtgtactgatgatctactgacaaaaatgtgactagaggctcacaggaacctaaccgtgtgttttcctctaggagcaaaggttcaggatttgctagttcaacgtttgtagcaataaaaataatctattataccacattttgtttattcattcatcagttgatggatttgtgacctgttttcactttttggctattataaataaagccactataaacatttgtttactggtttttatgtggacacgttttcatttctctcactgcgcccagcaatgaatacatttattttatggcaaaactaaaagtttgtcaaacacccaaattcagtatgataagttagctttttataggatactgacaggttattgtgggtactccaatcttgttcagcaaggccaaattttcaaaaaaaaaaatgtagatttattacaataagggaaatatatatcttaagctatatttccatgtgttctatgaagacaactctgagaggaagttagcagtttgtgtggttggaagcctcagaaagttctcctacttctatctcttactcacctggcttgcattgcaatatttagggtaagagtcacaagcatactcgggtgcatttgaatgatggtctaagcagatctctacacctgtcgttatctgggtttgtgatcattccagtgtttcctaagtttataggatgaattggcagtaagtgacttttgttccagtcctcagctgcattataaagacaatacaagactatgctgaaatagctatttggtaaagttttgtaaacccagaagcctttttaaaaagtattgttcttcttaatctcttaattatagttttttaaaatcacatatcacttaattttgtgtgtgtatttttgtttgtttgttttttgagatggagtctcactacatcacccaggctggagtgcagtggtgtagtcccggctcactgcaacctctgcctcccaggttcaagtgattctcctgcctcagcctcctgagtagctgggattacagggctgtgccaccaggcccgactgattttttttttttttttttttttgagatgaattcttgttctgtcgcccgggttggagtgcagtggcgtgatcttggcccactgcaaccactgccttccgggttcaagcagttctcctgcctcagcctcccaagtagctggtatcacagatgcgtgccactacgtccaactgatttttgtatttttagtagagacagggtttcgccatgttggccaggctggtctcaaactcctgacctcagatgatctgcatgtctcaggctcccaaaatgctgggattatgggagtgagccacctcacccagccctaagtcttattgttttttcttttcttttcttttttttttgttgtatttttagtagagacagcgttttgccttgttaaccagtttagtctcgaatgcctgacctcaggtgatctgcctgtcttggcctcccaaaatgctaggattagaggtgtcagcctccactcccagcctgatttgtatatattttatgtttgttttattttcttttttttctttgctgtattattattattttgagatggagtcttgctgtgttgtcaaggctggtctccaacttctgggctcaagcagtcttcccacctcagtcagctgaacagttgggattgcaggctcatgccactatacctggctgaagtgttggtttttcttttctttttgtagagacaaggcctcactccattgtccaggctggtctcaaactcctgggttcaagcagtcctcccacctcagcctccccagtaactgggattacaggctcttgcctctatacctggctcaagggtttgttttctgattcttcaaagtttacttctctcagatctggagactgtgatatgtataagacaagtttcccatgtcttaagaaacttgatagctagtaagagaggtaaggcctgtgaactcaggtaactaagcaagacagaaagacagatgaagatgaggacatatgagtagaataaaggaagtgatcagtaaaggttgcatgtggaaaatgttgtctgaatcagtcgaagaattgccttcaacatgacctagagaagagcagatcatgaccgaaatccagaccttttcactggcttgattgtttggtgggctatttttctctcttttttgaatcagaggatcccagatgagggctttattatcagcctttgactgaagtctcagttatattcttgttcccagcccatgcgtgtggaatcagggatatgacttacatgcccttttaagctgctctgtacctttttgccagttatatatacatgtaactatgttaacctgccttaaatgtccactcgtgtgtgtgtgtgtgtgtgcgtgtgtggtgtagtgacgggatctcaccatgttgtccaggctggtcttgaactcctgggctcaagcaatctgcccactttggcctccaaagtgttgggattacaggcgtaagccactgcacccggcctaaaatgtcaactcttggttgagaatgaaggctaatttgcctaagaaccaacttaatccatctgttccagccagtaccaagttttgggctcgtgatgccaccaattggctggtgtgaggaagtgtttaacctttttcttttccttttgggagtttgcactacgcgtggaccagtttgtttgttttttttgtttgtttgtttttttgagacggagtcttgttctgtcgcccaggctggagtgcagtggcgcaatctcagttcactgcaagctccgcctaccgggtttacgccattctcctgcctcagcctcccgagtagctgggactacaggtgcctgccaccatgcccggctaattttttgtatttttagtagagagggggtttcactgtgttagccaggatggtcttgatctcctgacctcgtgatccgcccacctcggcctcccaaagtgctaggattacaggcgtgagccaccgcgcccagtgcaccagttatttttaccttacgacattttctcacagattcatgttctcctttggtaaccttccatcaagcctctttcaactctggtttaactagtgcaggagctctttccatccctctttcctttactttgttctctttgtaagttacaaaagagacaagccaggcatggtggctcgcgcctgtaatcccagcattttgggaggccaaggctgaggcaggtgaatctcttgagcccaggagtttgagaccagtctgagcaacaaaaaatgcaaaacgttagctgggcatggtgatgtgccacacctcaggaggctgagatgggaggattgcttgagaccctgtctttaaaaaaacaaacaaaaaaaaactaggcataagattacttctagtgtcttgtatcaagaaagaagaaagcagttatatatatatatatatatatatatatatatatatatatttctttttttttttttaatgagatggagttttgctcttgttacacaggctggagtgcagtggtgcaatctgggcacactacaacctccccttcctgggttcaattgattctcctgcctcagcctcccaagtagctgggattataggtgtgcgccatcacacctggataatttttttgtatttttagtggccacagtgttgcaccatgttggccaggctggtctcaaagtcctgcactaaggtgatccacctgcctcggccttccaaagtgctgggattacaggcatgagccacctcgcctggcctattttattttattttttaatagagatcaggtctccctgtgttgtccaggctggtctcgaacttttggactcaggtgatcctcctgccatggcctctgaaagtgctgggattacaggcatgagctatcacacccagcctctttgtttctcttttgtatcttgttcaatctctgaatctccttaaggctggcttcacctctggtggcaaaatgactaaagctacatgtccttatacctcactgtcataatgagagcatgagaggcaatgcttggcattccacgtaggagtccagcaaaatagcctgattgaaccagcttttaggtctgatgcccattgtttgttttttttgaaacagagtctcactccgttgcccaggctggagtgcagtggcacaatcttggctcactgcaacctctgcctcccgggttcatgcaattctcctgcttcagccccccaggtagctgggattacagccatgcgcagccacaccagctaatttttgtattttttgtaaagacggggtttcactatgttggccaggctggtctcggatcaccttaagtgatccgcccacctccacctcccaaagtgctgggattacaggcgtgagccactgcaccagcccacatgcccattcttgatccacttgtaggaagcactataaaagcacatgaacaaagtgcggtgcgtgttccatgaaaataaagatggcgccaggcgcggtggctcacacctgtaatcccagcactttgggaggccgaggcgggcggatcatttgaggtcaggagtttgagatcagcttcacctacgtagtgaaaccccatctctactaaaatacaaaaattagccgggtgtggtggcaggcgcctgtaatcgcagctcctgtaatccaggccgtggcaggagaattgcttgaacctaggaggcggaggttgcagtgagccgagatcacgccattgcactccaacctgggcaacagagcaagactccgtctctaaataaataaacaaacaaacaaacaaggcttctagttgcagtaggagggacgaattgagagcaagggtttaaggactaaatgcagggtgcagtacagtgtcagtgtcagtgtgcagtgctcaggaaatatttgttgaaggggaagagtatgcttcttcagtccaaggtggaagcatgaaggaaactgtaagcacattgatctagaccacagtttcaggtacagaggggagcgttaactaaagctcagagcggggaaagcacagggtgcttacaaaatggcaaatgctgtcatttaggccagaatcctactcacactgctgctgtatatcctcttcatctgtgtttaggattttgaaatgcatttttgttggattattgccccactagaaaaaacagttcagatctgttgcagtttcacatttgaaactactttcattctggaatccttatccttagaccttcctaataatttctgtggtcacactggacctgatctcttcctgtgctaaacaaaagcacacaatcacaaaactgtgtaggcataaatgagaggcatatgggagtggtgtaaaaggaactggaagagtcttaatatgcctgggtgggcgagctaaactaatagctcccagcagtttttctgaatcagacattgtggagccaggagtctagcatttggaattccactgcctgtgcaaagggtctgtcttttatcctccaaaccaccatttgttaactggttaatgacccagtggacccgttgacaacaaaggagggaaagctggtaaagatcaagttaaaaggaaaaagaaaagttcaaaggtaggaaagtaagaacaagaagggtttaatcatatcttcacctactctttattttttaacaatttattgtggggaattttgaacatacacaaagtagatggagtaatgtagtgacctcccatgaacctatcccctcagccccaataagctgcagttaccagacttaatgaaaggaaaccagaactctggtgaggcttaggtttggtttccagacctctctaggccttgtcacctttggccttatcccatcaaacacctcttttccccatttttagctcctggtgtgcacagaacactgcgtttaggctagtgatgagtatgacagtacttaacctctaatagattaaggaaataactgttattgttcaagtatggttttgagagcagaaaagtgtaattctgtcaaaggtacacaacgaagagggaacttaggaaggcattattgagaagttgacatttgagtttacagcagaaacgttgggcaaggggtagggaatgatctctgagatagcagcatacccgatctactagctctttttcaccaggctatttagagtttgacatttatgttacatttataacaaggtacatttcaagtgtagctttcctttttgctttaagcaactgagacatgtaagtcaatttcagttattttctgctaaactgtgtgtctctttgaatgttcactatcaaggtgaattatacaaggtgtgttagatccttttaacatttcagagcaaccaaaaccaagtttgaatgtctcatttaacactgtgagaggatgtatcttgtctgcatcttgtgtttcagttgtatttatcggtaaaataagccaggggagtattctgacttgcagtttaaaagctgacaggcctaggggaatgttccacaaaatagtatattttgtatatggcatggtattatagataaatgagctattgtgctgcctggcactgtcttctcccttgtgctgtcttctgctgtttctcaaggagtgattcctctctgtgttttggaaccgtgtttctcactgcctacagatgatgtccatttggcttatttcactgtcatctcatacacagctgtttcaaactgcatggaatcctcagagaactacacgccccttcctgaacaaacagtgcttcttcctgcattttcttcttaaacttttatcacttttccccccttacatatacttttgttttattctttcactaaaaaaaaaatgaggtttaattgacttacaataaactacacatatgtaaagtgtacagtttgctcaggtttggcaggtatacctgtgaaatgatcactgcaatcaagatagtcaacatatcattcactccataaagtatccttgtgcccattggtaatctctccctcccatgctccccctgccctgtctccaagcaaacactaatctgctttcagtcactatagattagtgtgcattttatagaattttatgtatatatgttttatatagatgaaatcatacaatatgcactcctttccttccatcctttcttcctttttaggtctggtttctttcatccagcataattattttaagatgtatgtatcagtagtttattccattttattgttgagtagtattctgttgtatggatatatcacatttgtttatttgcctgtggatagatgtttgagttgtttccagtctttggctattgcaaataaagcttctttgaacattcatatataaatgtttatatggacatatgcttgcttttgtcttttcttttttaaaaaaaaaagcacagatgggaaccgggcgtggtggctcatgcctgtaatcccagcactttgtgaggctgaggtgggcggatcacctgaatgttaggagttcaagaccagcttggccaacatggtgaaactccgtctctactaaaaatacagcagttagccttgcatggtggtgtgtgcctgtaattccagctactcaggagggtgaggctggagaaccgcttgaaccctggaagtggaggttgcattgagccgaggtttcagtgagccgagatcacgccagtgctctccagcctgggtgacagagcgagactccatctcagaaacaacaacaacagcaacaacaaatagagatggggttcgagcccaggctagtcttgaactcctgggctctagtgatactcctgccttggcctcccagacaaagtgttgggattacaggtgttaaaccactgtgcccagactctttttcctttgtaaatacataggaatggtgtggttgcatcatatgttttaactatttaagaaattgccaaactttttctaaaatattttcaagtacttaccatctatatatcttctttggtgaaatgtctgtttaaatcttttacccatttaaaaaaattacattgtttattttcttgctgttgaggtttttgtttgtttgtttgagacagtctcactctgttgcccaggctggagtacagttgtgcgatcccagctcgctgcagcctccacctcctgggttcaagtgatcctgaacttcctgagtagctgggactacaggcacgcgccaccacgcccggctaatttttgtatttttagtagagacgaggtttcaccatgttggccaggctggtcttgaactcctggcctcaagtgatccgtccacctcggcctcccaaagtgctgagattataggcatgatccattgcccccagcctgttgaggtttttttttaaatcaggtatataatcaggtatatgctttgcaaatattttctcccagcgtattacttgtctattttcttaacagtttctttcaaagaatagagttaaaaagattttttgtatctttttagctttttttttttttttttttttgagcagtcagaacacacacagcatttattggaagttttccatcttatatgggcacagtttgtggctccccaaaacaattagaatagtaatatcaaagatcactgatcacagatcaccataacagatataataataatgagaaactgtgaaatgtcgcaaaaattaccaaaatgtgatccagagacaggaagtgagtgcatgctgttggacaaatggcactgatagatttgcttgacacagggttgccagaaaccttccatttgttaaaaaatgcaatatttgtgaagtacaataaagtgaaacacagtaaaatgaggtgtgctgggcatcctgccatttatgcacatgcctctttaggtagaaaataatcctgtaaaagttgaggctgtggttgcctttctgagaatcttgtctacagaaatggtcaactggtggccagctagccaaagggctaatctagcccacagacatgtttagttggggctacatagagctttttacaaatttgagtcaatatttagaaaataaaagtctggattttgggattcccttacaaaaactggaaaatttggccacactgggtcatattcccacatagtcgtggtggttggggttcagtagcagtagctgctgccccttaagacaggtccccatggtccccactcagttgcttccttatttatcttacaagcctggcaaggaatttgagttgaactgatctagaagattggtgctaagaaccagctcagtggcttagctgtcctggggtctgcaggagaaggcttctttgttaggcccaggcaggaagtctgggcatggattgagttttatttttatttttttattttttctttttttttttgaccttttaaatatttatttattttattttattttatttatttatttatttttaattgatcattcttgggtgtttctcgcagagggggagttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacgaagcacatcttgcaccgcccttaatccatttaagcctgagtggacacagcacatgtttcagagagcacagggttgggggtaaggtcaccgatcaacaggatcccaaggcagaagaatttttcttggtacagaacaaaatgaaaagtctcacatgtctacttctttctacacagacacggcaaccatccgatttcccaatcttttccccacctttcccccctttctattccacaaaaccgccattgtcatcccggcccattctcaatgagctgttgggtacacctcccagacggggtggtggccgggcagaggggctcctcacatcccagtaggggcggccgggcagaggcgcccctcatctcccagacggggcggctggccgggcggggggctgaccccccccacctccctcccagacggggcggctggccgggcagaggggctcctcacttcccagtaggggcggccgggcagaggcgcccctcacctcccggacagggtggctggccgggcggggggctgacccccccacctccctcccggacggggcggctggcctggcgggggctgacccccacctccctcccggacggggtggctgctgggtggagacactcctcacttcccagacggggtggctgccgggcgtaggggctcctcacttctcagacggggcggctgccgggcggaggggctcctcacttctcagacggggcggttgccaggcggagggtctcctcacttctcagatggggcggccgggcagagacgctcctcacctcccagacggggtcgcagccgggtgctctcacatcccagacggggcggcggggcagaggcgctccccacatctcaggcgatgggcggccgggcagagacgctccttacttcctagatgggatggcggccgggaagaggcgctcctcacttcctagatgggatggcggctgggcagagacgctcctcacttcctagacgggatggcggccgggaagaggcgctcctcacttcctagatgggatggcggccgggcagagacgctcctcacttcctagacgggatggcggccgggaagaggcgctcctcactttccagactgggcagccaggcagaggggctcctcacgtcccagacgatgggcggccaggcagagatgctcctcacttcctagacggggtggtggccgggcagaggctgcaatctcggcactttgggaggccaaggcaggcggctgggaggtggaggttgtagcgagccgagatcacgccactgcattcagcctgggcaccattgagcactgagtgaaccagactccgtctgcaatcccggcacctcgcgaggccgaggctggcggatcactcgcggttaggagctggagaccagcccggccaacacagcgaaaccccgtctccaccaaaaaagtaagaaaaccagtcaggcgtggcagcgcgcgcctgcaatcgcaggcactcggcaggctgaggcagtagaatcaggcagggaggttgcagtgagccgagatggcagcagtacagtccagcttcggctgggcatcagagggagaccgtggaaagagaggaagagggagaccgtgggccgtggtgagagtgagagggagagggagagctctttttagcttttatagcttttgttgtgtctaaggaatctttgcctaacccgagttcacaaagattttcttgtatgtttttttctggaatttctgtagtttttagatttacatgtagatctaatattttaatacatggtatgagatattaaggatccaagttcagttttttgcatatgaatatccagctgttttagtaccagttgttgaaaggactatcattcctctaccggattgtccttgtacctttgtcaaaaatcagttgtttatatatctgtgggtctgtttctggactctgttccattgatatgtttaccttatctttatgcctgtaccacactgttttactataacttgaagtgaggcagttttagtcctctagctatattcgttttcaaagttgttttaggtaatctaggttctttgcatttccaaataaattctagaattagcttctcaatttcttaaaaaaaaaaaaaagcacgttgggattttgattgggactacattgaatctgtttgggggaagagctgacgtcttaacagtttaggagagatacaaattaacaaattaaattagtgattttattttaattaatgtttctcagtagtatttttgtgtttttcctgtacaggttttatgtcttttgtcaaatttttctcttaatatttcacaatttttgatactgttttaattttttcagaatttcagtatttggtcattgctactctatagacatgaagttgatttttgtgtattgatcttgtatcctgcaacttggctaaattcacttattttaatagctttttggggagattccattggattttcttttttctttttccttttttttttgagatggagtcctgctttctcacccagactggagtgcagtggcccaatctcggctcactgcaacctctgcatcctgggttcaagcaattctactgcctcagcttcctgagtagctgggattgcagttgcctgccaccaggcctggctaattgtatttttagtagagacaaggttttaccatgttgcctaggctagtcttgaactgacctcaggtaatccacccacctcggcctcccaaagtgctgggattacaggcatgagccaccgtccctggcctccgttggattttctgtacatcatttgcaaataaggacaattttacttctttccaattatcacttgttttacttatttacttattatcagtattttctgtgttgtcactgcttcagagattctgtccttttcaattttcttttgttatcttcttggtcttagatattatcatattgttgtttgttttttttttttaattagttaatggctttctgtgaggtattctctcagtctatgttgtcttcagaaaacactggtttcattttgttcagggccatatcataattcctagctaccaattacatgaagttccaacttatttattcctccacattgggatcaaatatttcttcctgtcaataattggcatttctgtttaccattgcaacttattctagcctaggtcccacttaaaattatagttggggagagagcatcagagttgaggttcggaaatttggtttgaattcccattttgctgcttagtgtctgtataatcttgggcaagttttttaactgttaggcctgtttgcttatctgtaggaagagagtaacacaagaactttacaatatgtcatgtgaattgaaagagagaacatagaaatcatagccatgtgcctgcaacacagtgtgggtagtctgtaaatatttagtctggcactagtgtgagcaccaagtgaaggaatgaatgcttgtttgcatatcctatttctgcactgttgcttatgctgttctccaatctcttttcaggccctctgcatcttcctcatgtttcgaggtcaatgaagcccatctttattactcatttcctatcattgtttacatccctgttgagttgatatcttactaaacttagggactgggagtatatctttggaaaatatttgttttcctcaaaatgcctaccataaatgtattataggtccctaaaataattggttgattgtatagttaatttggaagcagtgcatcaaaatactttgtagggtgacagcgaagtaaggttttttttgttttttgtgttttttttttttttggtagaagacagtctttgtctgtcactcaggctggagtgcaatggcatgatcacagcttacttcagcctcaaactcctaggctcaagcaatcctcccacctcagcatcctgagtagctgggactataggtgcgtaccaccatgcctggataatttttttttttaatttttatttattgtagagatgcagtcttgctatattggctgggctggtttcccaaaggcctcctcaagtgctgggattattggtgtgagccaccatgtctggcctgtttgttttttggtcagatttaggttttaggagtgaagtaagttgaattttacatgctacagtggaagtggcagaaatgtttttgtttgattaaaagtagctttaagagaacagtaattaactttttaattttggccatcaaacaaggagggttgctcataaaacagaatgggagtttggtaactataaaccatttattaaatgttttttaaaaatcacattgtttcaacattgaatgtggtagaatattcagtatttcctttaggtttacatgtatagtcttatgtcttttaacaacagaaatatgttctgagaaatgcatcattaggtgatgtacaaacattatagagtgtacttacacaaacctacataatatagcctactacacacctaggatatatgtaaacctgtaatagtagctaacagcatgttactgtactgaatgctgtaggcagttttaacaatggtgtttgtatatctaaacatagaaactgtacagtgaaaatatagtaatcttatggtaccacctttattgactgaaacttcagctaaaaatgataaacctgattaatatgcaaagcagcccttataacatgctttttcaaaaacagcttaagacttttcagatttcgttaagaagttatatggtaacatgctgactagagaatgatttattgggctagttagcattttaaagtaaagggaatggaaaccagaagatgatgcaagggtacttttattcgttgtgttaaaaagccatagtaaaagccgtagtaatcattctaaactgttggatgcttccttagtgctgcgtatataaagtatgttaataaatttgatatctagggtacttgttagaaccctaactggcatagcctataactccagaatcaccattctaattgtattctggagttgtgctctacagtggtgctattcacatagaatataatgtgaaaggtaaccctagagttgtgcaagtagaaggtactagcttaatgaatttggctctaataagttaataaagtaatttgaacattccttgagaggtaaagtttaagatgcactgtgggacgctagaaagtaatttgcaggcagccaggaaatctggtttctggaaccagtcaactggcacctcactttccccatagtaccatggaaactttgattagatgtctcttccattgctgatattttgcatttaggtgatggattgaagtcaggaactagatctagcattgagggcactgaaaggtggttgtcatgtagtccagaggtcaagggtcaagtgattagaagcagtttgttcagaggtcaagtgattagaagcaggttaagccaaagttagactcatgattttagcagggaatgtgaatggaaatccatatacccgcccatctccattggttggagaccagcgggtcatctttcttaaattgtatatgggtgtatggaagggatttgaaattgacgagtcgtataactgagtaaggacagagaagccggactctatttttccattaggtctagggctttctagtgcttaagatgagttcttgctcctgctctgttactcaggcagtggcttgattgtggtagacacttatgacctacacattttagcctaggctgatgcctttccacagttatgttcctggtttgtttgtttgtttttagttctttctctgtcagttacaggtacattttcccaaatcatctgaactcaaaattctcctaacttttccatgaagcctttattgttctttgcctagctggaagagactttttctataatttttggtactttttacttgttactttttattatatcttgtgttatgcatacatttatcccctactatattactgaaagcagggactttgtcttagtgctacaggtttttgtttttgtttttgtttaatttgagacagggtcttactctgtcacccaggctggagtgcagtggcatcatcatagctcactgcagcctccatctcctggactgaagtgatcctcccgcctcagcctcccaaagtgctgggattataggcatgagccactacacctagcagttttctcaaactttagtgtatagaggagtcacctgaagaacttattaaagtttggattcctggaccccctattctgattacttggttctgatttaggcctgggaacctacattttaacaagttcctcagatgagcttgagtatgtgggctagaggaacatgtggtttacagcatctagcctagtacctcgttttgctcttctattgcctgagtggttaagtcagtgatcagttaaaaccaataatcattggtaactctgctagaagaaccagtcttaacacctgtgaggaactagatctattttgttcctggctacctagtattttacaggtttttgtgtttacatgaactttttgtaccctcagtttaagatgccctttgattttagttttaaatttttttttattataatttttttcattaagcctcttccattttaggatgattttaattttaaagcttctgaatactctctcaattatcaatgtatatatattgtggacatatgcatttgagttttgttgttgttttgcctttaaacttatatgtcttattaaaataaactctacagaaattgctatattcagtctttgtaggaactaacagaagaagtctttcttactaagtctttttttggggggttcaggaacagggtcttgctctgccatggaggctggagtgtggtggcacgatcttgactcattgcaacctcctcctcccaggctcaagtggtcctcccacctcaacctcccgggaagctgggactacaggcatatgcggccacacctgactaattttatgtagttttggtagagacagggtctccccgtgttgttcaggctggtctcctggactcaaacaatctgcctgcctggcctcccaaagtgctggaattacaggcttgaaccaccatgcccggctatttcttactaatacttaatttgtattaagtattagtaagacaaatttttattattattattttttgagacagagtcttgccctgtcgcccaggctggagtgcagtggcatgatattggatcactgcaatctctgcctcccaggttcaagcagttctcctgcctcagccccctgagtagctgggattacaggcgcatgccaccatgcccggctaacttttgtgtttgtagtagagcagggtttcaccatgttggtcaggctggtcttaactcctgaccttgtgatctgtctgcctcggcctcccaaagtgctgggattacaggcgtgagccaccgtgcccggcgaaaaattattattttatagtgatacacttttgtattagatattatagggaaaaccagaataagtagatacttaaagattttctggcgcaatggagtgctgaagacaaacacgtaaaatagttaacattcaaggcagttcgcaacataggaccaaatgaatggtctgcatcaataaaagtaaatagttattagagttcaaagaagtgggggagatgaacacgtactagagaacctggaaagcctccatggagaaggcaacaggagctgaacttgaaggtgttttagatttcagtcagaggaaaagagcgttcttagagggaagaacatacaaagattcattttacaattggaaaaaacggaagctcagaaaggtaaagtgagtgtgtgctgaggtgccagtctcctgaccactgctctgctttgtgcagcatttggaggtttttcattgttgccaagtagaagacaggcaacattatgataaccatatttcaaagcactgataactaaattaaattaaattaattaattaatttatttatttattcattttgaggtggagtctcactttgtctcccaggctagagtgcaatcctgtttgttctaccttgagactatatccagaatccagaatccaagtaacatcttacctttaccccttccattcttgtccataccactagcatctctggcctggattattggagttgcttcctagttgttttccctgtttccattcttgccctaccatctgttttgaacatagcagccagagtggttcaatttagtcaggtcatgtcaattctctgctcagaaccctgttaatgactcccattttactgaaagagaccaaagtttttccagtggctggaagctatctgtgatctgcttccctctccctgcccactgcttgacctctcagctcatatcctactacttttcagcttcagccacactaacttcttgcagttccttgaagactgtaggcctagtcttgcctcaggacctttacctagacaattcttttttcacctgtcctgctgcggctcatttcttcccttctctgcaaggtcaaccaggctaccttatttaaaactgtgccccatctcactttaccagcttattaccttctgatatactgtatatagtatttattaattttgtttgttctttgtctcctcttgctagtttcagagaagacagggaatcttgtctatttgatttatttttatttttatttatttgttttttatttttttgagatggagtctcgctctgtcacccaggctggagcgtagtggcgcgatctcggctcactgtaacctccacctcctgggttcaagcagttccctgccccagcctcctgagtagctgggattacaggcacctgccgccacgcctgtctaatttttgtatttttagtagagatggggtttcaccatattgggcaggctggtcatgaactcctgacctcatgatccccccgcctcagcctcccaaaatgctggaattacaggcgtgagccactgtgcccggcctatgtggtttattgatgtatctccattgcctcaaacatggtcaggcatctgatagatgcacaataaatatttgttgcatgcatgagtgaatagaatagaacagaatagaatagaatagaatagaatagaatagaatagaatagaatagaatagaatagaatagaatagaacagaacagaatgcaaggtagacaggcagtcccaactctcatgaagcttacagtttgtggtttctttactccaaatgacgttaaccatgtttttcacattttttggtatgtgtaattcaaaacctttgtgaaataataagcatttaaactttaggaagcagtgtttcttaaaaagaatgtgatcttggggtatgttttgaatcaactgaaaactataaaacattaaatagaaaagctgtgtgccaggaaaggtgattgcttgatcagtttttgaaaaatgccactagataatttttgatcttaattcattcctgtggaacacttaactacaaaatttccttgaaataaaatgcaagttattagtgggattgttagtgggattcccaaatgaaatgatttttagctctcattaagactctttctttctctttctttctttctttctttctttctttctttcgttcgtttgttttcctctaggctggagtgcaatggcacgatctcgcctcactgcaacctctgcctccgggttcaaggattctcctgcctcagcctcctgagtagctgggattacaggcacatgccgccatgcctggctaattttttgtatttcactagagatgggcttccgccatgttggccaggctggtcttgaactcctgacgtcaggttatctgtcccctgttggcctcccaaaatgctgggattacaggcgtgagccaacatactcagactttttcttatctttttgcagtctaccatagaaaaacacagaatttcatttctgttcatttaaaattctgtggtagaaaatcaaatatggaagacttttgaacaaatatccagtgttgaagcaaatgtaaatagtagatattatattgatgccaactgaggaaatatgattagacttagtcaataaatgaagctgttaacataatctgtcatgtgccagtttaaataatgaaagcattactgtagtaggatgttttgttaaatgtcctacaaggcctgtatctttctgtgcaagcctaccatgtggtagacacttaataatagttgatgataataatgctgaattatctgcctcttaaatttgtttatctgagggaagaggtgcttatttgtatataaactgctaatttatctgttagtaactgacattttttctttactttttcctgaagatttgcaattaatttaataatagaataaacatttttgtattgtttttatataggataaataatgaagcttataaaaccaggccttagcagccacactgtaaagactaaagaaaaggacattttcagttggtataaattttctttttgtttatttggtgtaaattttgaatttcttcttttttttggtctgaaaaattaatttagctcagcatggcctatctggatatactttttttttttttttttcttggagacacactctctctgtcatccaggctggagtgtagtagcagccaggatcacggctcactgcaacctttacctgctcagctctagcaatccttccacctcagcctcccaagtactctgcaggcatatgttccacaggcacctgccaccatgcctggctaattttttttttttaattttttgtagtggatacaatttttattttttgtagagatttattttttgtatttttttatagaggtctccctctgtttcccaggctggtcttgagctcctggggtcaagtgatccacctgcctcagcttcctaaagtgttgggattacaggcgtgagccactgtgcctggcctgggtgttttctttacaattgagtttaccatttgtagcagcaaaagaaaagaaaaataactccacattacctctctgtttagtttcatttcggagccagagtttgttaaaagtgtgaaatactgtgccaggctcagtggctcatgcctgtaatcccagcattttgggaggccgaggcgggtgaatcatctgaggtcaggagttcgagaccagcctgaccagcatggtgaagccccaactctactaaaaatacaaaaattagccaggcatggggtacacatctgtagtcccagctactcaggaggctgaggcaggagaattgcttgaacccaggaggcagaggttgcagtgagccgagattgtgcagttgcactctagcctgggcaacagggcgagactccgtctcaaaaagaaaaaaataaaaaagaccggaaataaaaagtctgcttgggaccaagcatggaagattatgcctgtaatcccagctatacctttgaagctgagtcgggaggatgacttggacccaggagttcaaggctgcaatgaactatgattgggtcacagcactccagcctgggtaacacatctctgagaaataaaaaatttaaaaataaaaatataataaaatggccagtgctgttgctcatgcctgtaatcccagcactttgggaggcttaggcaggtggatagcttgagtctaggagtttgagaccccatctctacaaaaaactgcaaaaaattaaccaggcatggtgacatgcacctgtagtcctgctactcagaaggctgaggtgggaggatcacttgaggtgaggaggtcaagactgcagtgagctatgattgcacccctgcactccagcttgggcaacagagcgagaccctgtctcaaaaaaatgtgtgtgtgtgtgtgtgtgtgtgtgtgtgtgtgtgtgtgtgtaagtaaaattaaaagtctgcctggcagaaaattaggtgtatattataaaaatctgtataggcactcccagtattttgaatgaaggcatgtcaacaaaactagatgtaaaaacctctctgtgaagtgaacattatttcgttactaatttttatttataaaaccagaaatactttactgaggggtaaggcagttacacttgttttttgttttgttttcttttctttttgtggagaatggggtcttgctgtattgcaggttttgaactcctgggctcaagcgatccttccacctctgcctccttaagtgctgggattacaggcatgagccactggacgatacctggcctgaggtgtaggaagaagaaataattccagtatataaagttggaaattatacaaagaaggcaggatctctagattattctgcttgtcttataattgctgggcctctaattaatttttagcattcacctgtaggtttccttttattttgagtactgggagtttttatttttattttttttattttttttttgagatggagtctactctgtcgcccaggctggattgcagtcacgcaatcggctcactgcaacctctgcctcccaggttcaagtgattctcctccctcagcctcccaggtagctaggattacaggtgcccaccaccgcacctggctaatttttgtaattttagtagagatggggtttcaccatgttggccaggctggtctcgaactcctgacctcaggtgatctgcctgcctccgcctcccaaagtgctgggattacaagcatgagccaccgtgcctggcctgatttcttaattagttgtgtagtctttggacttagtttcctgtgggttcagcaataagtatagttatcttaataaaactcatattttaggcttttcaacctcagattttctgcatatatcaaaataaattctgggctgggtacagtggctcacatctgtaatcccagcactttgggaggccaaaatggggagattgaggccaggagttgaagaccagtgtgggcaacatagtgaaaccctgtgtctacccttcccccgaaaaaaagccagacatggtggcattcttctggagttgccgctactcaggaggctgaagcaggaagatcacttgagcccataagtttgaggttgcagtgagctatgattccctcctttgcacttcagccccatcctggatgatagagcaagaccctgtccatctgtccatccgtccatccatccatccatccatccatccatccgtattcattcattgtacttaagaatgagctatataaaagtgaaaccacgggagttctagaagaacatataggtgcatattcttataatctgggacgaggaaaatctaaacatgatattaatattagttgacaaactactgatgagagcataatgtcagaataatcgaaaaattattaaaaactatttggttagggcagaatttctggaatgttggattaaggtgcttgggaaatcctccctccataaagcagataaaactggacaaatttataaaaaaaaaaaatcaaccattttgaacttgtgtagattgttcccagcagcattactaaatagccaaaaattggaaacaatccaaatgcccattaactggtgaatagataagcataatgtgtattcatcagtagaatactactcagcagtaaaaaggagtgaatcttgatacatggtacagcatgaagctcagaaatattttgctaaattaaagaagccacaaaagatgacatatcctttcatttatgtgaaatgtccaggaatagcgaatttatagggacagtgaaagcaagattagtagtggttgtctagggctgtaaagggacatgagggatcttttaggggtgatgaaaatgttctaaaatggaattgtgatgatcgtacaactgtaaatttactaaaaatcattgacttgtacactgaaaataggcaaattttatggtctgtatattatacctcaataaaacttatttaaaatgttggcaggggcagagggacaacaggttttttcccctgctgcaaaggagtagtccaagtacagcacatgtctgcagatggcatttatgtataatagatggctgctgcttttttttttttttttttttctctaaatcaggtgtcctgagagattgggaccaagagggagatagaacactggcagttggggttcatgttagggtttcagacacatcaaagacagcatccttctttgttttaagtttataaaatagggttcaataaatacctgtcttatagaatttggacagttttttccacataaagccttccagaagatactaagagctatagattttaataacttaacaaatgtaataacgttctacattgtctttgcaaataggtgtataccccaagtatgaatgataccttattttggatgggacaggatggtgaaaatggccacgatgtttggaaaaaccagttcaggggcaataatttttaatacttattagcaaagtagtcttgaaattattaattttttgtcaaaatcctcccattaaaaaattcttgaagacagcataatttgatttgaatacatcacatttaatagaaatttaattcaccctttcagactttaactcccctccccctattttaattaaatggagggattggcttggattctttctaagctaatgctttgtggtttgatcctgttaaatttattttttaaacaaacagcatattttaatttatttacccaacaaataagcattaaacatgttaatcaagacacaccacctgtcctcagagaacagtaatgggtacatttggtcaacaaataactcaaagtctgaagtactaatgtggttatttatttatttatttatttatttatgtagagatggagtttcgctgttttcgcccaggctggagtgaagtggtgcgctgttagctcgctgcaacctccgctcccgggttcaagcaattctcctgcctcagcttccctagtagctgggattacaggttcgtaccaccacacctggctaatttttgtatttttattagagacggggtttcaccaccttgcccaggctggtctccaactcctgacctcaggtgatccgtcccctctcggcttcccaaagtgctgggattacaagcgtgagccaccacgcttggccttgatgtggtcttatctgctgtcaagctacatgagttggaagctacatgagttggggtggagagttgtcaatgctgtttcaggaatcattgctcctaaaggggagccataagtctttaagtatggatagttttccaggtgaagagctcattcgacggaagtgttcatagtgaaagaaggaaatcagttggtggtctcatttgagtagagtaactgtatatcccttacttaaaatatacaattaactgttggtttattccagcaagtgaaatttttgacttccatttattttctgtgcttttttttttttttgagatggagtttcgctgttgtcgcccaggctggagtgcaatggcgtaatctcggctcactgcaacctcagcctcctgggttcaagtgattctcctgcctcagcctcccaagtagctggaattacaggcatgcaccaccacgcccagctaattttgtatttttagtagagacggggtttctccatgttagtcaggctggtctcgaactcccgacctcaggtgatctgcctgccttggcctcccaaagtgctgggattacaggtgtgagccaccacacccagctctgtgcttttgttccatcaatgttttgttgttgttgattgattctctctctgtcacccagtctggagtgcagtggtgtgatctcagctcattgcaacctccacttcctgggttaaagcaattcttgtgcctcagtctcccatcgtagctgggattacaggcgtgtgtcaccacgcccggctaatttttgtatttttagtagagacggggtttcaccatattggccaggctggtcttgaactcctgacctcaagaaatccgcccaccttggcttcccaaagtgctgggattacaggtgtgagtcacttctcctggcctgttccatcaacttttaaaaatcttctatcactattaagtttaattcttgatttttttttcctttttctcttcttgccctccctgccctttttttttctgcttacgtaaaattcttgattttaaatgatggtccacagctgctgtagtctgacttgtgtcccataagggctgatgactcaaacatcagaattgttgttcagttttaattttcaagatcacttttgagtttgattgcttccctggtttttttttttttttaagttgacaaaattttttccaagctttgtaatgctcagtgtgtgaagcaaatacacaaccatttatgaagtctttaataactaataaaactggaatctacacattgtcatataaattggaaaattagaatatcttgtttgtggagagcattttcaggttatttgacttaacaatgatgttatgagactacatggaagaataattggatcttgagctgtttaaacatgtgctaaatagaaagaaacaaagcttcagaggacctcaggtgacacctggtcctgtcttctgatttttgacagatgagagttttagggatttagataattggcttagtaattgaatcagtgaaacagctactccaggctctttctgctgaattgtaaggggaaatcagtgtctcttgaaatgtttgctgtaaaaaaaaggaagacactattttctgatcagttgtacatttcaaattctaaacatttttttgagcattgttaaacactgtcaagccgtgtggatgtgaaggtgaataagacagaatagtgaataagatagcctttgttgtcacaggagtttgcaagattatctaacatttaggaagtgagacaaatgggcttatgctgtcccctgcaccccagcaaatgtgtgaaatgtccccttgcttgtcactccacttcatcgtccttctgcacgtttaatgctgtccatacatgctgacttcctcctgcttctttctgctagtcataccttttaccatctcagggttcctatattattctgttccctctgcctgaaatacttctgaatattcttcatctccaccccatccccctttttaacctgatctacttctcctctgtcaaatttcatttcatcagagattatgtctatatagcacaccccttaactctagtccctgctgtgaagctcatagttctggtttttttctttatagcacttagtatatattattatgtttgtttgtatgataattacattacttttctcaatagactgtaagctccctgagagcagagactatttttctttactgtgtctcctgcacttagtgtaacctcagtaggtgtttgagtattagaacttttttttgtaaagctacgttgttgctataaatcagagtttagtttatgttttttgttttagagggagtttcactctgttacccaggcgggagtgcaatggtgcacagtcttggctcactgcagcctccacctcccgggttcaagcagttctcctgtctcagcctcccgagtagctgggactacaggtgcacgccactacgcctggctaattttttgtgtgtatttttagtagagacatggtttcaccatattggtcaggctggtctcgaactcctgacctcaagtaatctaccagcctcagcctcccaaagtgctgggattacaggcgtgagccaccatgcccagccagagtttagttttttgtaaagggtcatatagtgaccgtttttggctttgtgggccacacgatctctgtcccaaccctgctaatgcggcaggaaagcagccatagatagacaatatgtaaaggaatgggcatggtccttttccagtgaaactttgtttactaaaacgctaagcaggctataagtttgctgacttctactataaatcatcatcccctgatcttgttggacttgaaagcccttgttatgcaatcttgcaaatcccctcttagggttttttgaaaaatgattttatttttgtatggtagatgttaaagaggtgatttttaaaaagtctgatcttaaagtaatgtaaaatacaatcttaaatatattaattatatatttttagtttctccagtttactagtaggcatatgcttttgttaactttacatttgtatttaagtaaaacatgattcttgatattgatgttaaaataaaaagattggtttggttttgggatagattaaaatgtagattgaaattttacaatgcgtttcattttcaaaaaagactatttttgcaacctgatgcttgaaataccatataatattattttgttcttaagtgacagatgaagaaacattccaggttgctgtttgcagaacttctgtgcaagtaaggagttattacaatgaaaagcaaattcactataagcaccagtgtttatttttcttacttttttctttttttttttttttttcagacagtgttgctctgtcacccaagctggagtgcagaggcatgatctcagctcactgcagccttcgcctcctgggttcaagtgattctcctgcctcagtctcctgagtgggattacaggcttgtgccacctggcccagctaggttttgtatttttagtagagacggggtttcaccatgttgaccaggctgttctcgaactcctgacctcaagtgatctgcccacctcagcctcctaaattgctggggttacaggggtgagccactgcgcccggcctatttttcttttttcttttcttttcttttctttccttttcctttttcttttctttttttttttttttttttttttgagatggagtttcgcttttgttgtccaggttggagtgcagtggagtgatctcagcctcccaaattgctggggttacaggtgtgagccactgcgcctggctgtttttcttttttaacgttgtttgaaagtctagaatcatttttatgtgctagatgagagatttgatctgataaatcaaactcagatgtctgcatctcaagtgtatttgtagaattatttttctgttttctattaatttagattgaatgtcagagtacccattataggtattaaaatgaatattacataagaaaaaataacaacttaaaaatgttcagaattgtttaaataaaaactttagacagacatttagcagaatttaggtgagcattaaaggattcaggcagcattcaaaactggaagaagttcagagagctctgctttagaagcaggcttttataggctgaacgctgtagcaaagtaaaggaattacttgattggctgtagctaggcacttgccttatttggatatgatccagtggaaagtccctagttagaggtttgtttttgattggttaagcttaagtttcattttatgtttacattgggcttcagtttgcttactaggcactggagccagctgtctcagcctaatggctgcccaatttaaaaaaaaaaaaacattaaaatggcatgtagttgtcatcatcagagtaagaaaccaaagaagagaccgtcatgaatgggatcattagatcatggactgacacacatgttcacttaatacccacaagagtgtcttcacacttttttgtcatggatgggacttgttttctgttttttgttttgttttgtttttgatacagtaaaatacttaggagttcttgcaactttctataagttgtttacattttactccaattgctttatcattgtgtgtattttggaggtacagtttttttcctgaaccactctgaaagtggaaatatgcccttttatccctaaatacttaaatgcatatttcctgaaatcaaaggcattttcttacataaccacacataaccacagtacaattatcaaaatcagaaaatgtaataatgataccatactattaacctgattcacagactatattcaggttttataaattatttcaataatgtcttttatagctcttatacctcaatccaattcagtctgtcatcacacactgaatttaactggcatgtctctttcttccttgcctttcccctttcctctttccttttttcttctttcttagagacagggtctcattctggtgcccaggctagggtgcagtggtgcaataatggctcactgcagccttgacctcctggactcaggcaatcccccaacctcagcctcctgaatacttgggaatataggcacatgccattatgcctggctaattttttttactttttgtagagatggagtctcactacgttgctccggctggtctcgaactccttaccttaagtaagccaccttccttggcctcccaaagttttgggattacaaatgtgagccactgcggctctttaatttttcttattctaaaacagttcttcagcctgcctgcctcctcttctcccctcctggtacttttcttttcttgaccattccaattttgaatacagaccagttgttctgtacttagtttgggtttcgttgccgttaccttatgattacattaatgttacgaatttcaggctggaatactatagaagggatgtattctccttaatgcctcatttaaggaggcacataatcagtgtgtctcaatattagtgattggttaatcattgtattaaggtcatgtctgccaggttactccactgcaaaaattactatcctctttgtgattaataagtaatttgttgggtatatttagagatgatgaagttgtcctgtttttcattagttttctattcactagtagtctcagcatctagtggtgattttcttttttctaatttttaatttttttttgtagagacaaggtctcactatgttgcccaagcagattttgaactcctggcctaaagtgattgttccaccttgacctcccagagtgctgacattataagcatgagcagctgcaccctactagtggtaattttctaattccatcattgtttctgcatttacatattggcattctaatgaaggaatgctttcctttcttccttgttgattggttaaaaaaattaaatatggattatgctctaatccattactatcattatttattttgatgcttaaattgttgcacaattccagtggtagtcccttctaactggctttagtgttcttttgacatacccctgtcatttttgagcagtctcttactttcttgcccaaggtgttgcatgcttatcttttttttttttttttttttttttttttgagacagagcctcactctgttgccccggctggagtgcaatggcatggtcttggctcactgcaacctccgcctcctgggttcaagggattcttctgcctcagcctcccaagtagcttggattacaggtgcctaccaccacgcctggctaatttttgtatttttagtagagacgggttttcaccatgttggccaggctggtctcgaactgctgaccttgtgatccgcctgccttggcctcccaaagtgctgggattacaggcgtgagccactgcgcccagctgtgtgcttatcttttactttccctgccctaccagagatcagctatttctccaaggatccttggttttagtagaaaatgtagtttagaaatcaagatctgggtgttcatttatagaaggggtcattgcttctagaacctctcagcaaacagctaggaagtgtatgtatgaaagtgtgtttgcgtgtgtatttctatgtctatatattttttgagagacagggtctcactctgtcacccagggtgaagtgcagtggtgggatcatagttcactgcagcctcaaactcctggtgtcaagcaatactcccacctcagcctctcaggtagctaggactgcgggcatgccccaacacgcctggctaattttgtaattttttgtagaaatgggatcttggtatgttgcccaagctggtctcaaactcctggcctcaagtgatccttccaccttggcctctcaaagtgttgggattacaggcgtgaaccactgtgcccagccacatttaggtcttttatttctctctctttttttttttttctgttttgagacaaaaatcttgctctgtcgcccaagctaaagtgcagtggcgcgatctcggctcaccgcaacctccgcctactgggttcaagtgattcttctgcctaagcctcccaagtagctgggatttcaggtgccagccactacgcctggctaaatttttagtagagacggggtttcaccatgttggccaggctggtcttgagttcttgacctcgtgatccactcgtctcggccttccaaagtgctgggattacaggtgtgagccactgcgcctgggcgcgctctctctttttttttttttttgagactctgtctcactctcgctcaggctggagtgcagtggtgcgatcatggctcactgcaacctccgcctcccaaattcaagcgattctcctgcctcggccaccagagtagctgggattacaggagtgcgccatcttgcccagctaatttttgtggttttagtagagatgaggcttcaccatgttggccaggctggtctcaaaactcctggcctcaagtgagacatcttcctcaatctcccaaggcgctgggactataggtgtgagctgctgtgccaggcccttatttctcttttaatgtataggttctgctcctaactccctccatctccctttttttccttaagaatctggattgcttggactataaagttttccacattctcgactttgctaattgcatcatcatcttgccattaacatgttcctgtgtcccctcaatgttttataaatttgctcaatcgtattgttttactttttttttgggtaaagcatgattcattaggaggcatattaatttccaggtgtctctcgttttataatagtggcaattggtgatcattagattcattttttcattagggatttgcaaaatgatgatattccagatatattattttgtcatttactagttggattatttcaatagagatcaatttttcgccaactgtttgggggggcggcgattcttgaatctttattttagattcgggtacatgtgcagctttgttacatggatgtattgcatagtggtgaggtttgtgctcctagttagcctatcatcgaaataatgaacattgaacccaacacttttctccaactatttgtttaactagatgtacagttcatataggaaagacagatgaaatgcttgattcatcagattttagaatgagtttggttctctagtattctctgaaagataagtaatcaattagtttttttaaataggtattattatgaactcatgatttaaacattttattgtgtttcaatcaattgcagcttctttttttcctttctttttttttttttttttttttctgagatggagtgtcactctgtcacccaggctggagtacaatggggcaatcttggctccaacctctgccttcctggttcaagcgattctcctgcctcagactcctgagtagctggaactataggcatgtgccagcatgcctggctaatttttgtatttttagtagagagagagtttcactatcttggccaggctggtctggaactcctgacctgaggcgatctgcccacttcagcctcccaaggtgctgggattacaggtgtgatccaccactcctggcccaattgtgatttttgttgttgttgttgttgttgagacagggtcttcctctgtcaccagcctggagtgcagtggcatgatcttggctcactgtaacctctgcatcctgggttcaagccattctcctggctcagcctcccaagtagcttggattacaggcgcccaccaccacacccagctaatttttgtattttttagtagaggcggggtttcaccgtgttggctaggatggtcttgatctcctgaccttgtgatccacccaccttggcctcctaaagtgctgggattacaggcgtgagccattgcgcctggccaattgtggtcattttttattgctcctcaaattaccccatctttgttagtgggagcctcttcacattaactctctctgagtccttgggacataactccagaagtgattgatggcctgattgctttctgttatgacaagttttgtacattttctgccctatacctggagttgactattttcctgaagagctctgcttccttttattggaaaatgctatttaggatccataatctgagtgctagaagtgaaagacccaccttgttttcctttttaaataacagtatttatcacctcacatggtttgtatgggtcataattctgaggtgccttagttcgatggtagtggcttggtgtctgctgtcaagatggcttacttacattgtaggcaatttgataccggctattggcaagatgtctcagtctctccccatgtggaaggctcttaggactgcttgagtgtcttcacaacatggtagctggcttccttgagaacaagtgatccaagacagccagcagcatctttggattcattttcttgtcagcagtggggtgtagtgctctagctgtgaattcagacaacctgatgctgacactagctatgtggcattaacttgtttgaacattactttccttagctataactttgagacaataatacctaccttataggccctttaacataggacctttgtagcaatgcagggaactagaatagtctctgacacttagtgagtacacatgacaaacactgaacctgctggtgttactattattaccaccatcactggtatgaaatgaagccctaaaacctagtaattaagttgcccttgacagaaatagccttccttcctatttgtcaaaaattgccatgacagaaatattgtttacagattgcagatatatcccaagtatggtagaaggttaagggttagagaattataaccacacctgtttgactatatatatatatatgcaggggatctttcatgccgaatctgtattcatgtagattttagtataggatatgtgtcatgtaatgtgacccaggaagaagccaagacccccgccttcccctggccatctttttttgcttttgcttttgctttttttttgagacggagtctcgctctgtcaccaggctggagtgcagtggcatgatctcagctcactgcaacctccacctcccgggttcaagcaattctcctgcctcagcctcccgagtagctgggattacaggtgcgtaccaacacgcccagctaatttttgtgtttttagtagagacagggtttcaccatgttggccaggatggtcttgatctcttgagcttgtgatccgcttgcctcggcctccaaaagtgctgggattactggtgtgagccacagtgcctggcctttctttttcttttcttttttaaagatggggtctcactgtgttgcccaggctgatctcaaacgcctgagctcaagcgacctgaccaccttggcctcccaaaattgcccaggctgatctcaaacgcctgagctcaagcgacctgaccaccttggcctcccaaagtgttgggattacaggtgtgagtcactgcacctggctaccaccacccacaatcttttaactttttattttaaaatgtagattcacaggaagttataatgaaaaatgtacagggaggtccgttggacccttcactcaatttgccccagtggtaccattttgtgtaactatagtatggtatcagttgtcaaccttcgatttttatttagcagaaattgactgagcagctattatatgctagctctttgaggtataaaggattaaactctgaccttatgggtttctgtcatctctctggattttcattgttattgttcttaaaatattttttattttggcgactcattgttgacacttatattagcagttattttaatgttaaatattatgttatttctgacatttatatttgctctgttttaaaacaattttgcattgtgtccccatcttccatttataatctttacagcatcagaaccatgttgcctgcattgtcttattttaatcacgtgccagttttgcagtgctaccaagtctggatctgagaggcagcttgtgtgaatcatttacatacatttctgtttatattccccaaattaatttgcaactttatatttttcatccaattatatgttcaaaacatatttttaataattgattttaagaaggaatttgttatattaggatttaaaaactggctcaaaaaacagaagctattaaacaatagcagaaaccagacagtatataggactttaaatggtaattgctaaacatttgaatgttcccaaaaatgtgagtctgtgtgtctctgtgtgtctctacgtgttattccactagggatttgcacagataggttttgcacaatatccttgctgttattgtcagccataaacaaattacacgtatttaacaagttaatgtcagattggccaggagccactgggaggtgtgtacttagtgacatcagctggcaaagagccctggtaacagggagggttggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttggggtaagtacattttaatatagttttgggggttaaagtgcacaattctctgcctttcaaagctttttacttctttcaaattacgatgatatgaatgtttcttggtatttgatacaagagttcagcctttctactcagttttattttaatgcttcattttatttatgtttctatttttctgttgccaaccttatatttgaatgtcatgcttttttgaatgcaaggtttacttaataattagatgtagtatatgaattctacagctagaaaagtagtcccacaaatatttctgtaaggttttccacgttggattgttctgtgatgtttagagggaatttttttcccctttagtatgcataatacaaataggccatattaaaaagatggctcataaaacgctcttttctattgtcagattttatttcagtatatgcaggcaaattataactaaaagaggttgaagcaaaactaacagcatctcttcgttttagatatatctaacagtttttcatttacattttgctcctatgctgttttcttctgttttcttgctacatataaaataaataacatcaatgaatctgacttgaattgtgagtttggggtagttttgtgatgcaataaattcatgtgcatataactacgtactgtgttctgtagtcctggttagtttgtgatgcctattttagatttttgctatttcttatatataagaaatagagatgggtctcactgtgttgcccagactagtctcttaaacttctaggctcaagtgatccttctgcctcagcttcccaaagtgttgggattgcaggcatgagccactgcacctggccactttttactgtttccatacattgtattcatgtttttgaggccttcgaatctaggcttcctttccatgttctatggaaagaacatgagtttgggagttacacaaactgtgtacccattatttactagttctgtaatctcaagcaagccactgttctctttgaatctctattttgtgtaattcctgactgatgttgttattggggaaatttgtctggcacatagaaagcatacaagttggtttcaagagttctagatgttcactttttttgctgcgatagattcctaaaccccttgcatttttaacttcagctcctgggcaagaatgggtctggcctgtagttctagttttcagggcgcccttcctcttgctgtactcgtctcagattgtctgcatctattctaaatgttctatgctatatttgccaaactataccagaacagaagaactttgaaaaagtcaacaagcaggagtgaggtactgaattgtactgctttgtgacgacactgttgaaattgttccccccactccgcgacctcccgctggaaaattgtttttcccccgtgtattacaagtcacgcaaaaattctaccatttctcaaatagaaactttaaaaaatatttttattccttaaagttcttcagcctttatttatattaattgggtaattaagtggacagtatagtactcttcaatttcttccttcaattttatagtcagatttcttgaggtggaggggacttttttctttttctttcttttttttttttttccgagatggagtctcactctgtcgcgcaggtggagtgcagtggcgcggtctcggctcactgcaacctccacctcccgggttcaagctattctgcctcagcctcccaagtagctgggagtataggcgtgccaccatgcctggctaatttttgtatttttagtagagacgggttttaccatgttggtcaggctggtcttgaactcctgaacttgtgatccgcctgcctcagcctcccaaagtgctgggattaaaggagtgagccaccgcgcctggccctctttttttcttttctcttttcttttctttcttttttttgggacatggtctcaaactctgttgatcaggctagcatgcagaagcatgatcatggctcactacagccttcactcttccggacttcagtgatcctcccaccctggcctcctgagtagctgggaccacaggcacgcaccaccacgcccagctaattttggtagtttttatacaggtggggttttgccatgttgcccaggcttgtctcaaactcctgacctcaagcaatagagccacctcgacctcccaaagtggtgggattgcaggcatgagccaccacgctgacttgaaggagacttttaaaatggaacttttcccaagttttcttttcttttcttttctttttgagacggagtctcgctctgtcacccaggctggagtgcagcggcgcgatctcgactgactgcaagctccacctccccggttcatgctattctcctgcctcagcctccagagtagctgggactacaggcacccgccaccacacccggctaattttttgtatttttagtagagacggtgtttcaccgtgttagccaggatggtctcgatctcctgacctcatgatctgcccgccttggcctcccaaagtgctgggattgtaggtgtgagccactgcgcccggctccaagttttcttttataccaaattgactaaaatgattttgtaaaaatttgggggcatctcttttgataggtgcattgttcaacaagcatctttgggacttttctgaatacttgagaggatatagtgtttatactgaattcacatggtactccttcagtgagaaaacactttccattgtagcctaggagacatgagtggggagaaaaggacttaatgcttttctgtaggatagggcctactatagagggcctgaaaaggggatttcatatgactatgtccatgctaggaatactttggatgctagagtttcaggaaacataataaataagaaaaaatatgcattttaggatgtgaagattcactcactgtaaataaagttgggtgattaaaagtcttgctaggaccagacatttcaggagagtattgcttgctactgaggttataaccaagatacatttgagttgaatactggagaaaatcatgattctttctgaagattatggaagcatcatgagaatcttactactaggaggaaattctcctaaattggcttccagtaatgacccaagcatattttcatagcgagggtccttgttggactggaggcacataatgcaataatgccaataaactggagatgaggataatgacatttaagtggctttgcgggaacatcaaaaaatacatttgagtgaacgaatgtatttaatacacaactggaaaaattcagttggatccgaaagattggttgggtcagttcattgatggttattctaaggctactcagtgctcataagttcccagagatgacctatggacaatattagggttggaaaggatcctttggataatctagtcaaacacattattttatagataaaataggaaagttgagggaaagataatgggatggcaaatagtctccccagcccagagttcaatatcctcctggttgctggctgagcttagactagaattatgttgagtttccaggacacccattttacgaatgttattttgaattgcctgttgtatgtgataatatggtaagggattttttttaaaaggtgaaatctcatagaggagataaagtgtacaaaaagtggctgggcgccagtagctcacacctgtaatcccagcactttgggagaccgaagtgagcggattacttgaagtcaggagttcgagacaagcctggccaacgtggcgaaaccccatctctactaaaaatacaaaaattagccgggcgtggtgacatgtgcctgtaatcccagctactcaggaggctgaggcaggagaatcaattgaacctgggaggcggaagttgcagggagctgagatcatgccactgtactccagcttgggcaacagagcaagactcagtctcaaaaaaaaaaaaagtacaaaagtagtaagtcctgaaaattagcaccaactgtaggaatcagagaaccttcctaaaggaggtcgcgtttgatcagaatttagaaggacaggaaggatttggacttctcatgtttggaaggagcatagtggcaggatggaaaggttccctttcttctagagccttaaattaaactttattaaatgcataattacatagtattcatttctaccatgttttgaagtatgtctagctgttgctgtctttccaaatccaagatcagttgtttacttctgagatacttacctttatgcatgcatagccgtcttttatatgtgtgatttatataccaggaagctgtgatttaaaagattgctaccatgatggactctgtggattgtttaattttccctccaagttcaagtcagtaaataaaggaattagtggtggttgtatcttgcagaaaaacaacatattataactggtgtttgtattttcactggctgatggactttccaaacagcatttgacttttgagaactatatgatgacacagattgatactggggaatttaaaatgcatatggatttaattttcctaaagcatgccaaaacctgaaaaagcaactctttgtgttttgtttaaagcaacagctcgtggaaatcctgttatcgttcaatcctcagcagtttgttatagatgcctggcaaggtgggatgcagttctgtatatgtatacatattatctgcagttgtctctcgtagctggagctctgcagtaaatggagtgtgtacagtagtctccccttagtcgaagtttcgctttccagggtttcagttacctgtggtacagtacgctaagacattctgagagagagaccacattcacataacttttattacagtatattgttataattgttataatgttttattcttgttaatctcttactgtgcctactttgtaaattaaactttttttttttttttttaatttgagacggagcttcactcttgttgcccaggctggagtgcagtggcgtgatctcggctcactgcaacctccgcctctcaggttcaagcaattctcctgtctcagcctcccaagtagctgggattacaggcatgtgccaccacgcccagttaattttttgtatttttagtagagatggggtttcaccatgttggccaggcaggtttcgaacgcctgacctcaggtgatctacccgcttcggcctcccaaagtgctgggattacaggcatgagccaccacgcccagcctgtaaattaaactttatcgtaggtatgtatgtataggagaaaacatagtatatatagggtttggtactgtctggggtttcaggcatccgctgggggtcttggaacgcatctccttcagacaaggcggggactattgtattttcatttgattgtggtagtttggacagatggagagaagacggtgaaagattgtgtgtgggttttgacattaggctgtgtaaccataagctgatttaaccttcacctctaagcctcagttttctcagctgtaaaatgggaataaaaatgagttctaaggatttaattagaaagaaattagcatgatacttcctgcatcagcactcaataagatttctctttccatgtgatttttcccagtcccccaaaaacattgaagtcacaataactaaaagatttacttaaaatgggagtcttggatatttttactgtctcacttgagactgacagggaacccagttccctaactaattctaagtcatgggagaagggtgcgtgtagagaatgctgtagagaatgcggcagtctttaaaaactcaaacctgttgctgtgtggcaagctgttaacatttagggaccttgcaccacttactctgctggaagagctgggggatgggctgctttgagggtgacagatgtgtcctctgctgccggcgggcgcgtgcctgctctgtccctctgctcccagcaccaggtgcagccattgttctggctggtctctcttcatccggcctcgtctgttactctgctctttctagctcattgtttctgtaggaaattagcattaaaaacccatctgaaacccccatgtccctcaactgcaggtgactgttattggccccagctgccacccttgcgcttgattacttccatatgggtctatgcaaagaagtagtagccatttattgatttccaccacaaccccaacctctattactcaaactataataccctgaaatctattagacccccagtaggctgtatagctcagttggcgctacaactgtgatgaacattttacaagcaaaactaattacacccttttccccacccccatcacctcctccctaaatattaaatgtagaaacaccagagtgtcataagtggaatagtaaatcttttaaatgtctggaaatgaatctgtttctgagtagtaaagcttttagactttggatgggattttatggaaaattttagtcactgctttaatatttcatgccacacccataatattcaagcaaatcgtggcccagtgcccctagggtgggggtagggcacacaaaaattttcatcacttgctttttggtttgttaaatttaatccagtgggcagtatgttaggaaaggggcctagtttaaaaggataatatgttttgtgggagaaaacaacatgcagtcattgttaaatgctttaattttgcattattttgttgtttgttctctgtgtttacacaaataattgttctagtttactcattagaataaataccacaatgagaaggtcgatgttttagacttctttcttccttcatcagtaaacaaacttaagtgttccactttggttattgttctaaatcaagattgtaatctcaaacaggtaataagttctcagcttcaaactctagatagaatttcaaggacaatccaaagttgttattgactcctgatgaattgtattgtgaccttgacaaagtcactgccctgtcagtgaagggtattctggtagcctttacaagtcaatagcccaggaaatcaagggggaggtcattgacttttgcctgttgagagtttagcagtgtaacccagttttaaagtaaaatcttgagtttacagcattttaaattaaattatttaataatttggaaaatttaaagtaacaatttcaatgttttaagcttagctgcatagagcttttatcataaggaacatagggccatttctgttggaagaaatgtctttttggctttctttctttatattctatttattttggagtttaaaaaggtactaaagccaggccctatggtgtgtgcctcttgtctcaggtactcagaagcctgaggcaagaggattacttgagcccagtcattcaagacaagcctgggcaacatggccagacctgtaatcccagcagtttgggaggccaaggcgggcgatcacctgaagtcaggagttggagactagcctatccaaaatggtgaagccccatctttactaaaaatacaaagaaactagccaggtgtggtggcacatgcctgtaatcccagctactggggaggctgaggcaggagaatcacttgaacccaggaggcagagtttgcagggagccgagatcatgccactgcactccagcctgggtgacaagagcgagactccatctcaaaaacaaacaaacaaaaaaagatactagaatttgaaaagcccctggcagccaacattttacgtgacagctcctatgaaggcaagcctctaggtagagcaatgtgattatatttagaataggttaggagttgtagtatttgaagagtttttttcagagctttttaatctgctccttcgttttaagcagtggagaaattgaaaggtagggaagtcagtaaaggggaagagttgagatttgaaacagagccttctctgactccaaattaagtgtactttgatttgaagtttggagctagtacatgttgggaatgttgatcagtattgctatagatattgtcgtcttgaggtgagtacatgtgctgttaacccttctttctggtacttaggaagaatgggggtttccttctgtggccttactgattctttcattctgtcattgtacatactgagaaacaaagttaaatagtaaaaggagtttgcagtctaatgtgagactcattttcttttcatctgttttaattttattaagttgtcctctctcattcctagggctaatgccacaatgaaactggaaataagttttcttgcactgtgaatgtgaactgaggtttccacaagcaaactgtgcttctgtctccccaagtagagaagcatggcaaataaccacaagtgctttgtcggggccccaggcttctcacttacctttccccagtcctggctctgttcttcatgtctaaagtaagggaggacaacagacttggtgtgtgtgtgactgaccttctagaaatgttaacttccatctttatcttggagaatgaattgaagtgtttccctgcctttccatccaagggaaccatctctaacaacaaatctttttaagtgggtctggaggggggacagagaattggtgatttgtcttggtaattatgttgttttttggagtcagtttcaaacacttcagtaaaaatgtttaaggctcttcaacttttttggtttgtttcattttaatgtactactttattctattttctcacattttgtacgcacaaatcaatagatactcttaattgaataagtgaaaatagtgggtgagtttaaagatagatgtttcgttttccttattttgatgattacttttaaaattttaatgtgtacttgacataaaatctaatgtcaattcatatatccatttttttctttaagtacagaagtcttagaacacttcaaattcagtaactttttcaatatattaccgctgtctaggattttgtttccattttgtttgttacactcccagccaaaataatagttaccattatttttaaagctattaatttcgatttaccaatatatttattgaattatctggtcactttgcatatttatcacaattttccttctaggttaataattcattcctgccaagtgtatctgttaataattcttggagaatctgtaagtagtacactctttttgctgatctgaagatatctttatttcacctttacttgaatgatagttaaatgtggttagagtgtaaaggttgacagttattttccattagcacttgggagtggtgatttcttttcttgtgttttgtttgtttgtttggtttgtttggtttttgagatggagtctcgctctgtcgcccaggctggagtgcagtggcacaatcccggctcaccataacctccgcctcccaggttcaaacgattctgctgcctcagcctccagagtagctgggactacaggcgcctgccaccacgggcctggctaatttttgcattgttactagagacggggttttgccatgttggccaggctggtcttgaactcctgacttcaggtgatctgccaaccttgtttatatgaggaagtccctcataaattttagaataatatctgtaaagatggtggtagggtattaatgttaataattttggtaattatactgggcttataagtaaacatcctaactcttagcatttacacactgaaatatttaagcataagggagtgtaatgtttccagcttgctctcaagtggtttagataaaaatataggtagatagagaaaaagaaagtgatttttataaatggatgaattaattggtgaatttagctaaatgatattaacagaattatttgaatagtcttgcaaataaaaatgtttctaaatttgaataaaagaaagtactgagcccattaacaaaaaaatatgtatatgaaattaagtgttaatttaggactctctgaagaagtaaattgagctgtgtgctgaataacaataatgaaatagtcggtggatgtcagtgataagaatattccagtgcaaaggctcaatgatgggaatgaactcagtatgttcaaagaatagaaaaatggccgatgtagatataatgtagtggacgaagagaagagggtagagagacaggagacagaagttcatgtagagcttttaaagccagcataaagctttgtaatccaatgaatttggatttcattctgagtgatgggtaaccattgaatagttggggcagtaatgtgatctgatttatattgtataaagatcattcttcctgtcatatagagaaagaattttatagggcatggctggaagcagcaagaccagaagtgaaaagtgacaagtttggcccagctttatggcagtgaatatagtagaggacagatgatttgttatattttagaggaagttaagttttctgaacttgttgatagattgaatgttgagagggagaggggtgttttcaaataattgtcaaatctgtcttccttattattcatccattcatttgaatatttaggtgcctactgtgtgctaggcattattctaggtattggagttacatcaatgagtaaagcaaagcccctgccctcatggagattaaattctagtagaagagacaggcagtaaagatgattaataagtaatatatatgtagcctaaaatgtatgtttatgtatatttaggatgttttttaatgttacaaaaaatgaaagcgctaaggagaaagggaaagggtttaaggagatccaggttagtttgaggagggtagtcaaggaggatcctcactgaaaggtgattattttaagaatgcaaagagatgatggatgtaagtgttcagtactgtatgtgacacattgtttctcagtttttgagtactacttcttcttcttcttctttttttttttcttttgagatggagtctcgctctatcgcccaggctgaagtgcagtggcgtgatcttagctcactgcaacctctgcctcctgggttcaagcaattctactgcctcagcctcccaagtggctgggactacaggcgtgcactaccatgcctggctaatttttatatttttaatagagatagggttttaccatatttgccaggctggcctcgaactcctgacctcgtgatccgcccacctcagcctcccaaagtgctaggattacaggcttgagccaccacacccggccctattattattattattttgacacagggtcttaactcttcacccaggctggagtgcagtggtgccatcatggctcactgcagccttgacttcatgggctcaggtagttgtcccacctcagcctcccgaatagctaggactagaggcatttgccaccatacctggctaatttttcttatttttttttttttgtagaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaaggtatgtgtgaaacattcatttctaatagaggactaatttaataacagaaatatactcttccctagaaacaatttgctttaaaggccaggcatggtggctcacgcctgtaatcccagcactttgggaggccaaggcgggtggatcacctgaggttgggagttccagaccagcctgaccaacatggagaaaccccgtctctactaaaaatacagaattagccaggcgtggtggcacatgcctgtaatcccagctactcgggtggctgaggcaggagaatggcttgaacccgggaggcagaggttgcagtgagccgagattgtgccattgcactccagcctgggaaacgagtgaaactccatctcaaaaaaacaaacaaacaaaaactcttataaaaagttgttttctttttaagcagggaagcctgacttcattggcattttgagatggaggcttctgggcaaaagaagaatttcatgggggtattttgagatgagtatgatcaatctagtcaagagatggggaaggtctaagctttgtctcttgtaggtggaatggagaagggcaaagggtttgaattttggttgtgtggtgtgaagaatgattggtcttaaaacagatttaaaatgaaaagattaaactgatcaatgttttttatgcttttaaaaaatgtggctgataaagcgtttttgtgcttttaaagggagcctggatgaataggctttggtactgtatgtattgtattaaacatttggagtggcaaaataatttctaaaatatttctagcaacttcattttcattttatctgcaggatgaaaaagtaaatttggggattgttgattaaattagcaaaccatatggttgtttgcgcagactgactgctatgcgaggtagctgtgttatttttctttcaggatatgctgttgtatctgatgccagtgttctgaaacacttattttctagtcaacagtaggtgaagcaattatttctagtcattatggtttttcttgatgccttaattaatgtcacaatttgtgaatgctttaccctgctgtttaaaattagtttaatattttaaaagattaaatcttcacatttatgtaatgcttcccaacctcttttcacatcatagcatacatagaaagtattaagttctgattggctgtcccaggctgaggaaatcattatctcagtaaactgataatcattcttcataactctctggcgttggtccctggcacacagcttgggaagttctgtcttaatagaaaagatatagaaacctttctgtactgtattgcagttagttaagaggaattaggaaagagttatagagtctttcttaatagggttttttttttcctttttcgctagaagcctaaatctcaccaaattatcgggtgttatactaggaactatggttataagagtgaagagctcaaggaactcacagacagacaggcacagaaacaaatcacctgtggcacaatatgacaaatgacatcacagaggtgtttatttttatttttattttttgagacagagtctcagtctgtcgcccaggctggagtgcagtggcgcgatctcagctcactgcaagctccacctcccgggttcacaccactctcctgcctcagcctcccgagtagctgggactacaggcgccagccaccacgcctggctaatttttttttttttaatgtatttttagtagagacggggtttcaccatgttagccaggatggcctcgatctcctgatctcgtgatccgcccaccttggcctcccaaagtgttgggattacaggcgtgagccaccgcgcctggcctaagaggtgtttataagaagctgtaagagtccaaatgtgggaggttttatttctgtcaaggtgcacttgagtctaccagggaggacttggagttagaccttaaagtaggagtttctaaagtgccagagacagggaaagcagggcattgcaggtggagagcacaacctgttttataggctttctgcctccttaatatctagcagaggtctcatcttaatataaaagtagatactggaacttaggagtttgctctgatggcagacatggatacttgccctgccagagtgcccatctaccttccatttatgttgtttggattcagtctccactatactatagccttatatttgcatggtgcttttaattttcaaagctttttatccaaataacagcccctcagggataggaaataaaagccagctggtagtgtttttatttttatagaggagaaaactgagacatcaccatcatatcagcatttcatttcccagataagaaggtctttttttcatctcttgattgcaaagggtgctgcccaacaggaataacctctcccaattttctgggcacagcccagagtgctgactgaggcagccaccaggagggcgccagcaaggcagacagcatggctgctgatcacagagctaacagctcgacatctgcaggctgcagctgtacatttttgctacagcacatccgtatttctgctcacacttgtgaagaatcacagagtttggaagaatatgagttaaaccgttccaagtgtataagtgtgctccatctctgggagttttattctgtactgggtggagtggtctatgagatcttatagctgctacttttctctgtttatttattgccatatttagtccatcttccctgtcctaattttagttcaatgccaaaaaaagatggagcactccataatagatgaattgagagggtgctgattgtgtcactgaaatgtttgccaaagaaattgtttttctagctgattttgttctgcctccatctttcagtctatttggaaaacacagtagagtacctggttatctttcagagtgtcattgttaaataatcatttcagtaagcagtgatggctgttgatcattttagacttgtgcctatactaagtatttatccatttttctaatatacctggatttttaaaaatattgatggataaaaactttctggattgttgattttgaggaggtataccaagaagagaagggtgatcttggtgtggagccaacatctttgaaatcttggcttatttgttcttactccttaaggcaccccattgccactccttaagcccatgtatttgacagtggggctttttgtcagaagcctctctgattgtcatttggggacttaaatgggctcctacataacagcttctatgcttcaattttctaacttgtccagggtgtgcttcagctgtagactgtgtatttacgttcatatatttgtgaagaaagacaggaactatatagtagaatgtgaagtctctctgaactgtaatcaatgtgttttattaaattcttggtcacaatgtgcaaacttcattgagtcctacaataattaattctttttgcattatttattttgctatagtatggtctctggagctcagcagagctgccatttcttagccatatgacttgggacataatttttgacttctctgagccttagcttctggttaaataaagtggtattggagatggtaccttctactgtcttagtgtcatttaaataagaaaatattttagcaccattctttgcgtgtaataaatattttgttatttctaaatgaatatatgaagatggagagtaatggtagctattactattatagttatttcctgacttgtatttatccttcccagcaagaaagtcttgtcctactcaaatcttgggtaaatatgaaacttgcttcattatcagtgtggattgagaaggtgtgtacggtgttcctgggcatctgaagaaaggcttttaaatcagctttcctttgtggtcagttggtcacaaataacatcaaaatatcaattgttaatattcatatttattttttcctttacagctgactactttagtattggtacacctaattaaaatttttccacctctaaaattttttctagggcaatttatatatgattgaattaatttacattgagtattagtttccttggtttttaaaaatagatccccccaaaatggtaaggagttgagaagttaaggctgtgagcaaatagagaatttgggcctaaagtttaatgtggaaatgagaagatgatttcaattgatttgtagaaagaaccataatgaagggaattttcttaagtaaacttatgtttgtacccatttgctactatttttctcttagagcttttagcactttctccctgtcataaggttgtagagttgccatactctgaggtgtcccacaaggctagcacaacagccctctgcttgtggtgcatacagctatcatccaaaggggccaaccacatgacatggcagtgtatttccagatgtcattctctctgtttggatgacttgggagcttaagaagggtattttctcttgaataggagaaaaattgttactttggcataaggcccactctggcaccattcccacatctgttattgattagaagtgaatgctggtcagtcaggatgcaagagtgctggtccgattatcaagctcagccttcaggatgaaatactgcaggaaatctgaaggatggcataaactggctctacacagtctttaaaaagaccctttcataagctattgtacaaagacctggtgtaaagaaatagcctgagtgatgtctacatgttaagaagatgccgtaacatgtacatgtaggatctattcttagaggggagcagtggaatgggtggtggaatccttatgcaatgatttttaaaatatataataaacatgcacagatactaagtgttcaacccaatgagtgcctttttggtttttttgggggtttttttttgtttttttttttttttaaggaaagcgtctccttctgtcgcccaggctggagtgctgtgattacagacataaaccaccatgcctggtctattcatgtttttaatttttaaatttttattcaattttttttaaaatttagcgatggggtctcactgtattgcccaggctggtctcaaacttctgggctcaagcagtcctccagtctcagcctcccaaagcattgggaatacatacgtaagccactgcacccagcctgttcattttcttaatggtgtcttttgatgggcagaaaactttaattttcgtgaagtctaacttagcagtcttaaaaattttatggtttgtgcttttttgcttaccaccaggtcataaggatattctcctattctttttgtagaaattttatggtccggggtattattttacaacccatcacgaatctttttttttttttttttgtatggagtgagagaggattgaggttaatttgtatctatttggacatcgagttccagcaatatttgctaaatagacttttctttccccattgagttgagttgacacctttattgaaactcactttgtgtttggtggttcgtcctccaaccctgtccttcttttttgagattgctttagctctttggtgtcctgaacatattatacagacatcttggtacatcttggtgtctctctctctctctctcttttttttttttttgagacggagtttctctcttgttgcccaggctggagtgcaatggcacggtctcggctcaccgcaacctctgcctcccatgttcaagcaattctcctgcctcagcttcctgcatagctgggattagaggcatgcaccaccatgtctgactaattttgtattttttttagtagagacggggtttctccatgttggtcaggctggtctcgaactcctgaccttaggtgatccatccgcctcggcctcccaaagtgctaggattatgggtgtgagccactgcgcctggcctcttttttctttttttaatctaatgcagagatattcttgaattttaaaaacttttacaaaattgggaatatacattttaggcgtgtaaatttttaaattttaagtcctaactgtattttaacgttggtagcctattattatcaaaacatagtcattctgtgtaacgcagtaagaaatatctaatagttggttttacttaataaactttactaaataaagccagtatgtactatgtactatgttctggccactggacttggcacttggaatatggtggtgatcaagatgaacgtggccccaactctccagaggcttacaacctaagaggccgaaattggcctcttctgaaacaaaaatagacaaatgatgcatttcaggccttgtgatgtgaacagaaatttttttatattcttcattacgcagcagctgatagcagcatcacaatttgataggggccaggcacggtggttcatgcctataattcagcactttgggaggcccaggtgggcagatcacttgggtccagcaattcgagaccagcctgtgcagtgtggcaataccctgtctctacaaaatacacaaaaaattagccaggcgtggtggtatgtgcctgtagtcccaggctacctaggaggccaaggtgggagaatcaccctgagcccaagaggttgagactgcagtgagcagagatcacaccactgtattccagcctgggtaatggaatgagcccctgtcttttatttatttatttatttttaaaaaggcagactccatttgggtaggatgtatgtgcagtatacagataacattgctgtttgtttttgaatgaaaatgtttcctgaagccatagcatgagtattggaatgagtatatatgtctgccctcccttcccctcccttgccctcccctccccgtcctgtccatccatcccgtccctccttctttccttctttctttcctgtcttgagacagagtttcactctgtcacccaggctggagtgcagtggcgtgatctcggtgcactgaaacctccacctcccatgttcaagtgattctcctgcctcagcctcctgctgggattacaggcacacgccaccacacctggctaatttttgtatttttagtagagatggggtttcaccatgttgatcaggtgggtctcaaactcatgatcttgtgatccacctgccttggcctcccaaagtgctggaatgacaggcatgagccaccaggcccagccatgtctgtcattttctttgttaacctaatttctaaagattactcatcttttaaacttctttgaaacaagttgtttcatacctgtgatttgtactgtaactcaaggttttttgttttttgttctttgtgtgtgtgtgtgtgtgtgtctgtgtgtttgtcgtctttgttgttgttttgttttgtttgaatcctggggaaccagaggtgttagcctatgttttaaaactcacatttggcaatggtatcaacagctgtcacactgaataattgtcatgtcattataagggtttctgttgctcactaatctgtaggtataaatctggattttaaccacatgtgattggtaaaaattagttcttgtgagagattctatgctgtgtaggccatctgttccctattctcaaacccagaatgaaaagttagccttagaatttgcaaatcagtgaactaagaggtatgttataataggaagatgggctgactgaagtctctggagctaagctgggacctgtatgtgggcactgctggcagaaacataagtgtgtgtggataaactcttcattagtggaaaggaatcttagttttcggctgattttcagtggtgggcatgaccccaaacagaatctgagatgatgtaataatcatctgtgatttgattgtacttataagattcagctaaatcttcccttttttgtcccagtctacttgagatgtaccttccttgaacccttattgcccagctacatcatgaactccttgaaggttggaatatcagcttcaagtttgtgtcccaaacacttagtacagtgcttgggtcatgttagccttttgatgatgttgatcaaatgaatcagcagccgggcgcggtggctcacgcctgtaatctcagcactttgggaggctgaggtgggtggatcgtctgaggtcaggcgagaccagcctggccaacatggtgagaccccatctctactaaaaatacaaaattagctgggtgtggtggcacattcctgtaatcccagctacttgggaggctgaggcaggataatcacttgaacctgggaggcagaggttgcagtgagccgagaccacgccattgcactccagcctgggcaacaagagcgaaactctatctcaaaaaaaatgaatcagcaaggtaacttcttgcattaggaatgacagcacaggccgggcgcggtggcgtacacctgtaatcccagcactttgggaggctgaggcaggaagatcacttgaggccaggagttcaagaccagcttggccagcatggcaaaaccccatctctactatgccgggtgcggtgactcacacctgtaatcccagcattttgggaagccaaggcaggcggatcacttgaggtcaggaattcgagactagcctggccaacatggcaaaaccccatctctactaaaaatacaaacattagccaggtgtggtagcacgtgcctgtaatcccagctactcaggagcctgaggcaggagaatcacttgaacccaggaggtggatgttgcagtgaacgaagatcgcaccactgcactccagcctggatgacagagcaagacagtctaaaaaaaaaaaaagaggaaagacagcactaccttttattaaacaacttctttctttccccatattcccttctagttttttcttatacatgtgcatactctttccattttattttcgtgagtatacattatatccagctctttccttttacattatatcaagaccttttctgtgttgctatatatttatctgtcattatttcagtggagaagtagacccagaatgtgcattgtttttattaatatcacatgccattgtttccattagattgtgttaccatctaactatcctttgtacaagaacactattgtatcgatttgaaaaatcaactgaaaaatcagttgttttagtagtcattactacaaagttgtaggtacatgataattgaccttttcccagggccaaaggccaagtcccaagccataaccttgcctggatttcattttctttatctgggtagactgagtatatgactttatagtttaaagttctttgactaatcgttaaccttatttggggagatgaaatgatttttatgaaccagtaatttgaatataatgtatgatgaagttttggggctttttttccctttaaattaaataatttagtaaaattttaaaaaattatcttgtttccaaaaacggataattacatataattgaaaatgaattatttgttgaattggatatatttaagttcttaagtcaacttgtttggatttagatggtgacccaagtctaccagcactgcatttagtaaccatttcattagacagatgctgtctacagggtgtgctgttatattatgcattcatcctcagtacttgactgtcctctgggaggccaagtgtctcaaaatcctgtaagcactttcctgtaccccttctcataccaaccatgccacactgtgaacttgctgtgtatttttccttcttgattgcataccttcaccattgtcatttggtttaagtgattttatttatttatttatttatttgtttgtttgtttgtttgtttatttatttatttgagacagaatcttgctttgttccctaggctggagtgcggtggtatgatcttggctcactgagacctctgcctcccaggttcaagtgattctccttcctcagcctcctgagtagctgggactacaggtgcctgccactacactcagctaactttttgtatttttagtagagatgaggttttgccatgttgtccaggctggtcttgaactcctgacctcaggtgatccacttgcctcagcctcccaaagtgctgggattacaggcgtgagccaccatgctggccagattaagtgacttttttttttctttttttttttttgagacagagtctcactctgtcgcccaggctggaatacagtgatgcgatcttggctcactgcaagctccacctcccaggttcacaccattctcctacctcagcctcccaagtaggtgggactacaggcgcctggctaatttttttggtatttttagtagagacggggtttcaccatgtgtttgccaggatggtctcaatctcctgacctcctgaactgcccgtctcggcctcccaaagtgctgagattacaggcgtgagccaccgcgcccggccttaagtgacatttttaagagtttaagatttttccctcagcccatcaggtaagctctagtcagcttctttagctggcttcttagtagaagtaatagcaataataatatagatgatggtggtcatgatggcaattataaccataatatattttgtaaaatggtgtgcagtttagaacaggattactagcatcatttcctgattacagaacaggttggagacagaggcagacttaattgcttattttatagagcttgagccactgttttggtgtgtttaagcatttactatataccaaaacatgatatcctttaaactaccagtgggattttgacagggtaacttagatgccttttatcatattaccaagttgctgagattgtaacccagggcatttggtctaatttgggagcatgtttccattcatctctgcagctcagatggagaagggctggggtttagggcttctgacctcaaaccttgttttttttctgtcatgcttgcagggtattttaaataccctgtcctgttgttccctcaacccaaactacctgttaaaattttggttttgaaaatgaggtccctatagctagatcatgctgcctgtgtgtgaagaaagactaacatgttaggaatgcgtggcattcaagtaggtgtctaataattcttctggagaaaagcaaatttagtcaaaaagcaaatgaaaatattttataagcaatgtttcaaaatgattcaaggaaattggtatttacctcttatccccatcgtgtcatcagttccattgtcatgttctttgaataccgtgagcatgtgtctattttttaataaataattgtaatcatactacatatatataggaaggtccccccatacagcgttgtattatatgcatttcgccaagtgttgaatgaatgatccttcataattacaatttttaatgcctttacagttcacattgacatgctgttccaccgtttaattaaccattctcttgtggtataaattgctttttcccttgagctgttttcttaaggacagatttccaggagtgaggtcacacagtcaaacattatgaacatttttctagcagagaaattattttttaacctcactaattgaatgttggtaccttgaaatacatttatttctgtgctttttgtacctagtacattagtaattggatactggaactaatggaagcgaacaagcatgtagataatctagaaagcattatagtcttaactggaaatacataattattttctctcaaaattcaccatcccattttgttatgctttggcagagcaatctagaactatggcagagtgatggttgaggaaatgtggggaaatttatattaaaaccttagccgtggtaaattgaaagttaacttttgaagcaaagcttaactgtagaagaaaaatagtgattatttctcatgtttgttgctgaattctaggttttattcttctaccttctttgcatatatctgtctctaaaaaggtagctaattaatgtgttatggtaatttacagtatgcaaaaggactgccagtgcagatgtgatctgatcaatattgtgattattatcattattatcactgggttttcttgtttgtttttttgtttgttttgttttttgagacggagtcttcctctgtcacccaggctggagtgcagtggcacaatatcagctcattgcaacctctgcctcccaggttcaagtgattcttgtgcctcagcctcctgagtagctgggactacagggacggggtttcactgtgttgttcaggctggtcttaactcctgacctcatgatccgctcgcctcagcctcccaaagtgctgggattacaggggtgagccaccgcgcccagcctattatcattgttatctcggttatagacataggaaaactgaggttcctgttgatattattgccaaaacaatgctcttgatctcattctatctttctctgaggttttaagcagaacctggttgtatgtgagccatttatattctatagcagatttttgcattggctgtgagttcaaaatagataaaaattttaagattgcttcaaagtcaagagattctatataatcaaaaatacttcttggttaaagcataaagggccaaggtgacgtgtttggaaagtatagatagaaggctctgaattagggaaaagtcctgtaattccacagaggtatgtattttgacccttaatttctcttttccttgaaggttcataattaaagcacagaaattcagaattgtcatagtttggaagctatgaacttgagtgatagctttctcaaaatatattggagagtttcatagaattgtctctacctaactctgaacttcactatttattttattttatcttatttaattttatttttgagttagggtcttactctgtcacccaggctggagtgcaatagtgtgatcacggctcactgcagccacaaccacccaggctccagtgattctgcaacctaaacttcccgagtagctgggactacaggcaccccccaccatgcctggcgaattcgatggcatcttttttagagacgaggtctccctatgttgtccaggctgttctcaaactcctgagctcaggcaatcctcctgccttggcctcccaaagtgctgggattacaggcgtgagccacggcacccaggtttgttttttatttttttgttttgttttgttttgttttgttttgagatggagtcctgctctgtcgccaggctggagtgcagtggcacgatctcggctcactgcaacctgtgcctcctgggttcaagtgattctcctgcctcagcctcccgagtagctgggactacaggcgcctgccacaacgcccggctaatttttcatgtttttggtagagacaggctttcaccgtgttagccaggatggtcttgatcttctgacctcgtgatccgccccccttggcctcccaaagggctgggattacaggcgtgagccaccgcgtctggccaatttttgtacttttagtagagacagggtttcaccatgttggccaggatggtctcaatctcctgacctcatgatccgcctgcctcagcctcccaaagtgctgggattacaggcatgagccactgcgtccagccccgtacccagttttaattatattttcttaactggacctatgtggaaaagaggttgtatgcttccaagacaaaaattgaattatttcacatgtatttccttttaacttgttatgtctgggctgttttggcatttaaagccattaatctcaactcatgatttctgtcccaaggaaaatgagagtcagatgttcacatctggaccatttgtttcattcaagtagttgaaattgcattagaaaattttgatagtgataaagtcaagaatttagaatgaatcattgaatcctcccattgaaagggaagatcaaaacctccaactttatgtagaactatagactgagagaactattactttttgttgatttttcttaaataacattactgaggtatgattgacatgttaaaaagctgtacatatttaacatatacacctccatgcatttgggaataagtacacccctgtgaagccatcaacacaaaagtttcctcttgacccctttattattattttttgtgtatggtatgtagctattttaaagtattgttagtctttgttttaactttgttgaagtgttaattaaaatgatgaacttgcagaagaaaaagtgaacattttaaactattttttataaatagaatagaaacaggtgcaaatgaagaaatatatatatataaatatatatagatcaacaaatgaataatgaacaaatatatatgttaatgtagcatatattaatataatatatatgttaaccacaaaagtaccatggccattcagctcgtgatatgtatttctttcttttacctttatttttggcctgtttgaaagatttatgctacattatattttcctttattccttagattactttaaagaacaacactataattaagagcagtacaccctaaccaagtaaggttgatcacacaatggcaaggatagttcaacattaagaagctgaaaagggctgggcatggtggctcacgcctgtaatcccagcactttgggaagctgagccaggtgtatcacttgaggtcaagagttcgagaccagcttgaccaacatgatgaaaccccgtctctagtaaaaatgcaaaaattagccaggcatggtggcaagtgcctgtaatgccagttactctctgaggcaggagaatcacttgaatccaggaggcagaggttgcagtgagccatgatcgcgccactgcactccagcctggaggacagagtgagacttcccctcaaaaataaaaataaaaataaaaacaagaagctgaaaggaggaaaaaaaacccatttccataaatacatcccttcccctaaaaaaatgcatttgattaagctgaagacctatttctaataaaaacaagtaaaaagcaagtttgtggtaagtagaaacttcaaggttatacatgcaaaatgtggcttaaactagagctgcaacataaaagtggtgaagaacagcagaggacagttggagctgtgggagatgcacaaatgaatgcctctggcatggagcttcagggttgaaaatcaaacactagaagtccagccaggcacagagagcagccagttgcagaggggacatctccctttgtctttatctgttgtggagatgtttggtagtcccttacccccaatgcattgtaataaagcactccatttgtatatgcatcttaatagtcctcaatgatttaggcccacaaaatgatcagttaagagagttacctttattttgtttactttcaaaaaaataagaataaacccaaactcaattcttaatttctcagcctgaacagtgtgaggtcatagttgtccagatttctctggaaacgagtaaagatgaattcgtttctttgtcatgggtctgtactataggttgttctctttttatttcatttgattgtaaacagcaactctggcagctgggcaatattgaatgattgctgtaaacaaggaaacagactttgaggaggaaatatccccactatcagagagctaacagagcctcaatttcaatcctgatctgtctgaatccagccactgcctcatacccacaccagagctgttcaattgaaatataatgtaagcaacaaatagaggccacatatgtaattttaaatattcttgtaaccttattttttaaaaaagaaacaggtgacattccttttgataatatgtttaatatactaagaaatttcaatatataatcattataaaattattaatgagcttgtttacattcctttccttagtactgtttgaaccttggggtctggcatggtggctcacgcctgtaatctcagtgctttgtgaggccaaggtggcaggatcacttgaggccaggagtttgagaccagctagtgagaccctgtctctaaaaaaaaaaatagaaaaattagctggacatgttggcatgcacctatagttccagctacttgggaggctgaggtgggaggatctcttgaacccaggaggttcaggctgcagtgagcctaggttatgtgactgctcttccagcttggacgatgctgtctcatctttttttacaaaaaaaaaaaaaaaatctgcaatccttttttcctgtgcacaaacagcttccagaaaatagttaaaagaaaccatcaaaccctaaggtaattttttttaagtacctgttggcccaaacagagggcttaattagcggcaactcttagaaaccagattgcgttaaacacatctagctttgtttttttttcttggcccccacaaaggctatgcgcatgccccaggaatatacttcttctttgattgggcacaataagattgttttcttcaaatatttgagagtggtaggaccccagaagaactcttaccaactgatggtgagtgccaagatcttctcatttatctggcagtggcatattccatctctgcagcaaggtaaagccctgggtgctagaagttccttcacagaacctaggtgtcagccagtcatggatattgtcctgtggcttcccataaagaaagctaaatctttgcttcgtgctactcctgagcatgcagttttgatttttgtggttctccatctcaaaacaaaagctgatgggctgactgggcctttctttgcgctgggggaatattaaaaactcggtttttcaaatattaaggtacatggagccaggtggaacccaggctcttttaaagattgatgagggcaggtgcagtggctctcgcttgtaatccgagcactttgggaggccgaggcaggcagatcacttgagaccagaagtttgagaccagcctggccaacatggtgaaaccccatctctactaaaaagaaaataaaaatttgccgggtgtggtggcaggcatctgttaattccagctacttgggaggctgaggcaggagaatcacttgaacccgggaggcagaagttgcagtgagccgagatcacaccattgcactccagcctgggcaacaagagtgaaactccctctcaaaaaaaaaagtactgatgaatagctgggcatggtggctcacacctataattccagtgctttgggagcccaagacaggtggatcacttgaggccggaagttcgagaccagcctggccaacatggtgaaaacccatttctacttaaaatagaaaaaagtagtagtccctgctgtagtcccagctactggggaggctgagacacaagaattgcttgaacccgggaggccgaggttgaagtgagccgagatcccactactgcactccagcctgagcaacagagtaaatctcaaaaaaaaaaaaaaaaaagaaaaaaatgatgaataaatatgtacaaaaagaaaagaaaaatatttgtcacatccaagttaactgaggatggcaatgtaattaaaaagaatggtttgaactcacaattggctttgtggttaccttactacttgaaagacgggactgggcacatataccatttcattggacaaacttatttttacttaatagaatataattaaaatgcaaaagttaatagcacattaaagtttaatagttttctttgagacagagacattctctgctctcttttgctcctcagactggtcttcgtagtcttcaggttgctaaaatctgatactttcccaagtccattctcatgaacaattctacatcccaattgtggcggggtgggaggggggggcctcctgtaagtcatggtcattctgtgttcatgctgtctccatttccaaaaacgctccagaatctctagatatatttaaatcttccccaacacacttggtccaacatgttgcttctgttttcattgtctgtcaccatgcctagggcacagcaaacaagagtagtggattgataacaagtgttagttgatgaacatgaaaaaaacgacataggccgggcccagtggctcatgcctgttatctcagcactttgggaggctgaggtgggcggatcacgtgatatcaggagtttgagaccagcctgaccaacatggggaaaccccatctctactgaaaatacaaaaattagccaggcatcgtggcacgcgtctgtaatcccagctactgtggaggctgaggcaggagaattgctggaacctgggaggcggaggttgcagtgagccaagatcatgtcactgcactccagcctgggtgacaagaacaaaactctgtctcaaaaaaaattttatatatatatatatataattatgtaaaaattatatatataattatgtaaaaattatatataattatgtaaatatatatataaaattatgctatgtagttctgttaatgcatgatattataaaagcacagttgtaaaaaggttacatttactctaattctaggccacagactattcagttagtcctaaaaattcatgcaacatcgccaggcattgtagcacatccctgtagtcccagttacttgggaggctgaggatcacttgagcccaagagtttgaggtcagccttggtaacaaagccagacctagtgtcttcgagaaaaaaaatacaaaattcatgcaacattacttgacactagggagactaagtaagtatgaagatggagttatatgaatgggtcactgccacttaaaaaaacccctcaaaaatacatgaactattaatgagttgtagtgcatataaggaagacagaataatgtcttatatatcatgactccattaacctctataaagaagctgaatatctacatcttaaaattgtagactaatggagacattattttgtttatattaactctctacctaggcttttccattgtaaagaagctatatttatctagatccatcctcccccatacacacagagctgtttttctttcacattgaaaaattatgaccaggcaccctggctcatgcctgtaatcctaatagttgtgggaggccaaggcaggcagatcacttgaggccaggagttggagaccagcctggccaacaaggtgaaaccccatcactactaaaaatgcaaaaattagctgagcttggtggcatgtgcctgtaatcccagctactcaggaggctgaggcaggagaattgcttgaacccaggaggcaaaggttgcagtgagccgagattgtgccactgcaccccaacctgggcgacagtgagattccgtctcaaaaacaaaaaacaaaaaaaacctattacataataaactgatttgcaaatctcttgactggattttttttttttttttttttttgagacagagtctcactgtgtttcccaggctgtgcagtgacatggtctcagctcactgcaaccttcgcctcctgggttcaagtgattctccagtgtcagcctcccgagtagctgggattacaggcacctgccaccacgcctggctaatttttgtattttcactagagacggggttttgccatgttggccaggctggtctcgagctcctgacatcaggtgatctgcctgcctccgcctcccaaagtgctggtattacaggcatgagccaacacgcccaaccttctgactggtttttaatacaagatagctagatttttatatctgcttctgcattaatcatgtaatctctgtaaaaagctaccattcactcatgaaagagtaaaaaggataaatgacctcttcttgctacgattatgaaaattgttttgacctttccccttctgtccacacatatcccaaagggtctccagggcccccaacggtcccaggaccatattttgagaactgctgagtagatcatggcattcaagccaaggtaagtttatgttttattgtaagagcaataggaagccattagaagagttcaggtctgtgggaagatctgttttaggttttaaatcagcactttggatactacgtgatgaatggactgaaggggttaaaagcagaagcagaaagaatagttaggaggcagatgaagcagtccaggtgagagatgacagtggctaaattctagcaatagagatgggagacatgacatactgtgacatatttaagagctggactgtcagaatttactgctatatttctttcttttctttttttttgagacggagtctcactctgttgcccaggctggagtgcagtggcgcaacctcggctcactgcaacctctgcctcctgggttggagcaattctcttgcctcagcctcccgagtagctgggactacaggcgtctgccaccacacctgtctaatttttatgtttttagtagagacagggtttcactgtgttagccggaatggtctcgatctcttgacctcgtgatcctcctgcctcggcctcccaaagtgctgggattacaggtgtgagccaccgagcccggcctactgctagatttcctctagaaggttctgtgttccgcagacatttagcacagatgtatcaaatgctggaacccaagagacctggctttttgaatcgtaggaaagccattaactagctgtgtgagaaattgatagcgtttttccctgtctcccgaaaaaaaagtgaggtttatttttggccaagaagactaaagttagctgattctccatcagtctcagattctctgagttctctgactttggctgcgtatgtgtggcccaggcagtaatgtgacacacctttaagtggttgggattcagtcgattttgattgtggtaggggtggcttccatacaaaggcaagatgctaatcaaatttaatttaagtcttttctgttcatgtgagaaatactaagctggtggagacctgaaacagatggtgtgcagttggagtagataactatattattctaaataaatatttgctggagctgggaagcaacaatccatatttcattttttccctatttacattttcaggtcagctgtgttgctactgtttttaacttgcattaaggttatcaacagacttggcaattacaatatatctttaaatgttgaaataattagcattggaagagaccctcagcacgtagtgctgtaatgattcttaatgcatttctggtggatagctgtctaataatatcttacacttgaaaaaattttttttttgagtcggagtctcactttgttgcccaggctggagtgcagtggcccaatcccggctcactgcaacctctgcctcctgggttcatgtgattctccagtctcagcctcctgagtagctgggactacaggcgcacaccaccatgcccagctgatttttctatttttagtagagacggggtttcaccacgttggccaggatggtctcgatctcttgaccttgtgatccgcccacctcggcctcccaaagtgctgggattacaggcatgagccactgtgcctagcttaaaaatcttatacggtacttgttttttaattttcattttttttttaatttattttttttgagagcgggccttgctctgtcacccaggctgaagtgcagtggcacaatctcggctcactacaacctctgcctcccaggctcaggcaatcctcccaaggagctgggactataggtgtacgccaccactcccagctaaatttttgtatgttttgtagagatcaggttttgccatgttggccaggctggtcttgtacttctgagctgactcgatccacctgcctcagcctcccaaagtgctgggattacagacgtgaaccaccatgcctggcctacagcactttttaatctgttactttatttgccttttaacacctcccttcctctgttttacaaatgaagaaaccaaggctctggcatgacttgtccagggttccacagtagctgataaattggcagaaaaatcaggattcacagtcacagtttcatgcccagttttctttcttccacaatagcctacctttgactattcaagaatataaatctctagctggtctggaatttggctgttttgccaaactgaccttttcatctcatcttttgctgcatacagctttttatatttactgtatattctgtttcagctaagagatggtcttaaattgagggagtaatgaaaattttatattaactctttcctggcttaaggtgctgtagccactgtatctgtctcagttaagttctggggcgagatctgtgtgcagtctcttaaatgttaatatattctttgttacacataatatacttgttctcaccttcattgtacctgtattcttaatgatactttgatgaaagcaggttttcaaataagtaggtttaaaaaggcattttattaatcactggtctaatcattataataacctaaacagctagcatgtattcctatgctctttgtatatttattcttgaaattcacagtgcttacagcccggtagattatactctttacttggcttctggtttttccccttatttccttggcttttctttttcagtctctttttttagtttcttgtctttcatgatctctaagagtggaaatacctgcagatctgtacccacttccagtaagatacctgttctcaggctttccgtagaatctatatgccattatttgaaaatatttcatcacaacttcagactttcccaccccaggcctcagctccacacttttatatccagctgcttatccagcatttctgttagaatatctactgagcattttaaaggtaatcctgatcttcagttgctctttccccattttcctttaccagttcctccttcttagtaaatggtaacttcatccttccagttgcttaggctaaaaacctcaaaattgtttcttgacctctgttttttttttttttttttctttctttttttcagtctcatctgtcaaccaggctagagtacagtggcacaatcacagctcactgcagcctgaaactccagggctgaaggaatcctcctgtctgagcctccaaagcagctggaattataggcaagcactctcacacctggctaatttttttttggttttaattttgtggagccggggtcttgccatcttgtccaggctggtctcaaactctggactcaagccatcctcccaccctcagcctcacaaagtgctgggattagagatatgagccactgtacccggccttttgacctctattttgtatttattttttatttatttactgctgtcacctcagtagtagaagacttagtagttactcgaataattttgaataaatagatgagaaaattctaagattcaatttaggaaaagttactcaaattccttatttaactgcattccactacctgggggttatgttaagacaggggtctccaatcctcaggctgcataccggtatggatctgtgacctgttaggaaccgtgtggcacagcaagtggtgagccagtgcattaccgcctgacctctgcctcctgccagatcagccatggcattagattctcattaggagggcaatccctgttgttaactggacatgtgagggatctaggttgtgcactccttatgagaatctaatgcctgatgatctgaggtggaacagtttcatcctgaaaccactccctaccccacccccagttagtggagtgcaatggcacgatctcagctcactgcaacctccttttgtagttcttcggtaggtacatggcctcccaagtagctgggaccacaggtgcatgccactgtgcccagctaattcttttattttttgaaaagacagggtctcatatcggggaatctgccccaatattcacgtaggttcttttctattttcctttagcatcggccagcttgagaaataaagggacagagtacaaaagagagaaattttaaagctgggcgtccaggggagacatcatatgtcggtaggttccatgatgccccacaagccgcaaaaaccagcaagtttttattagggagtttcaaaaggggagggagtgtgcgaatacgtgtgggtcacagacatcaagtactttacaaggtaatagaatatcacaaggcaagtggaggcagggcaagatcacaggaccacaggaccaggcaaaattaaaattgctgatgaagttagcaccattgtcattgataacatcttatcagaagacagggttttgagataaaccggtctgaccaaaatttattaggcgggaatttcctcttcctaataagcctgggagcactatgggagactggggtctatttcacccctgcagtctcgaccataagagacaggcgcacctaggggggccgtttataagcctatacatccaggcgcgtattctctttcccagggatgttccatgctgagaaaaagaattcagtgatatttctcccatttgcttttgaaaggagagaaatatggctctgttctgcctggctcatcagcggtcagagtttaaggttatctctcttattccctgaacaattgctgttatcctgttcttttttcaaggtgcccacatttcgtattgctcaaacacacctgctgtacaatttgtgcagttaatgcaattattacagagtcctgaggcgatatacatcctcctcagctgacaggattaagagattaaagtaaagacaggcataggaaatcacaagagtattgattggggaagtgataagtgtccataaaatctttacaatttatgtttagagattgcagtaaagacaggcataagaaataaaagtattaatttggggaactaataaatgtccatgaaatcttcacaatccaccttcttctgccatggcttcagccggtccctccgtttggggtccctgacttcccgcagcagtctcacttcattgcccaggctggttttccagctttttaatcagttatagcagaagtcagtaaactgtggcccactgtcggccaggcatggtggcttacgcctgtaatcccagcactttgggaggccgaggcaggtggattgcctgagctcaggagttcgagaccagcctgggcagcagggtgaaactccatctctactaaaatacaaaaaaattagctgggctcagtggcatgtgcctgtagtcccagctacttgggaagctgaggcaggagaattgcttgaacccaggaggcggaggttgcagtgaacagagatggcgccactgcaatacagcctgggcgacagtgagactctgtctcaagagaaaaaaaaaacctgtggcccactgtccatttttgtgaataaagattgattacaacacagccaagcccatttatttgtatattgtctatagtgtgctacaatagagcaaaaaaatatttactgtcttgcctttggcaggaaaagtttcctgattcctgagctataataatgataaattaattttccagtatatgtataaacatggaatgtaaaaaatttattttttctatcagtgttggtacatgttaaagtattgattttgttttaattgtgctccatcttctatcttcaaaggtccttgtaaaatactttctggtaatttcccttttttttttttttgagacggagccttactctgttgcccaggctgtagtgcaatgaatggcatgatcttggctcaccgcaacctccacctcccaggttcaagtgattcttctgccagccatagcctcctgagtagctgggtttacaggtgcccaccaccatgcctggctaattttttgtatttttagtagaaacggggtttcaccatgttggccaggctggtcttgaactcctgacctcaggtgatccacccacctcaacctcccaaagtgctgggattacaggcgtgagccactgtgcccagcctctggtaatttctttgagtccttatgtctccatttttgttgaatgataaattgtttgtcattataaacagttgtttctggccatctcggcatatgaagcctgcgtgttattaggaagttggatgtgttgtcagatttgtggcagagttacaaagatggtaaatgctcatccttaagcatgtactatgtccataatcagtttagccaactttataaggctataaatgtaacagtaattttgatgtttcttcctccatctttagcaagttagaattatcacttttggaaagtttttttttttttttttttttttttttttgtgatggagtcttgctgttttccaggctggagtgcagtggcaccatctcaactaactgcaacctccacctcctgggttcaagcagttcttctgcctcagcctcctgagcagctgggattacagacgcctgccaccatgcccagctaatttttgtttagtagagatggggtttcaccatgttggccaggctcgtcttgaactcctgacctcaggtgatctgcctgcattggcctcccaacgtgctgggattacaggtatgagccactgcacccggcctggaaattcttaccatatgacaattacacattcagaacatttacctatgcttggcagtgattgaagagaggctatggtccaggaaatcttttccctgatttttccttcagctgtgataccacctcttgggggcactattcaaactatatcccatgtgctacctggagagcccatgtagcctttccagcaaacaccttaacattgtgttaagacttgcctggccgtcgtacatggtaatgtttctatttctttattttcccagtactgtatgtctgtctttcccataagtgaggtccctccctaccttcatctctgaacttccctaaggcctggcaaatccaggacagtcaagtagattgggatctggatcctcaaaatccaggaccaaattattggaaataatccaattgttcattgacaagggattgtttaaatgaactatggtacctcctcaaagtgtattatcatattgttttttaaaattgtggaattaagaattccaggacatattgtgatattataaaacacaataatagaaccaaaaaaaaaaaggaacattataatttgtatgtggtgtagattagttgtctattcctgcataacaaaccatgtcagaacttcatggcctaaaatgataagcctccccgctcccttctgttagtctaatccgcccacctcagtctcccaaagtcttgggattacaggcaggagccacccacgcccagcctgagagtctgatttttgttttttttgtgggttttttattgttgttgttgttttttgtttgtttgtttttagacagagtctcgctctgtcgcccagactggagtgcagtggtgcggtcttggcttattgcagcctctgcctctcgtgttcaagcggttctcctgcctcagcctcctgagtagctgggattacaggtgtgtgccaccacgcccaactcatttttgtatttttagtagagacagggtttcaccctgttggccaggctgatcttgaactcctggcctcaggtgatccgcccgcctcagcttcccaaagcgctgggattacaggcatgagccaccgtgctcagcctggagtctgatttttttataaagcaatggatttaatggcttccttggccagcttctttggaatgatcagtgttcctgtcattataggaaagatctctatatggatctttatagatagatctaatatagaaagatctatattctgcatattttctcagtcatgataaacaggaacacttgaccagatcttctaccccacacagcatagataacatctcaaactcggtaaactgttattctaatagatttttttttttttgagacagggtctcaccctgtcactcaggctggagcacagtggtgtgatcacagctcactgcagcctcgacctcctggactcaggtgatcctcccaccccagcctaatgagtagccgggaccacaggcatgcgccaccacatccagctaattttttttgttgtttttggagagatgaggtctccctgtgttgcccagcctgttctcaaactctgggcttatcctcgtgtctagcaattctcccgtctcaaggtggtttggattacaggcatgtgccatcatgcccaaccataattctaatatattttaaaatatgattcaagtaaaccatgtgagagtatctgctgtatacccaccattgttatgtccattatggtacccttcatataaccctgtgttgaaatatccccagggacagataaagaaaaccactgtcacacaactagggagtgatggagcattcttcacatcaggctcaccttttgcctcaacatgctttctccttgagacctaaatttttcttctttccaattgcttgggagtagcctttccctttagataacctcattattttcttatctcgtatttacacctctgctctctgccagtctctgattaaaaaaaaaaaaaaaactcaaaagcaatttataatgatttgtaaatgcccttgattgtgggcagtttatcatggaagattcttctcaagtagcacatttctgggatgtcagtcagtaatacagtggttcccccttacccacgtggaatatgttccaagacctccggtggatgcctgaaaccatgggaagtattgaaccctacatacattccttttggactgtaactgagcctatgagatgcaacagcaaaatgagcacaaacgtctttttccttcttacagtagatgtcagcaacctcagcataggaattttttctttccttacgaagtcaagaacttctgccttttcacttagtactttacagcttcactttggtgtgtccgaattgccagcatcactcctcttttactttggggccattattaactaataatcagggttacttgaccacaagcactgcaaaaccatgacagttcatctgatggtaaccgagatggctactaagtgacttatggtcgggtagtgtatactctggacaaagggatgattcacatcccaggtgggatggtgtgagatttcatcacactattcagtacggtgctcaatttaaaacttatgaattgtttatttctgaaattttccatttgatatttttggactttgggtgactgtaggtaactgaaaccgtggaaactgaaactgcagataagaggaagactgctgggtgttcagtgttactttcctgtggagctacaggatagttctactctttagtttcatctttgattctttaaattcctatgtaggaaaaaatatcactgctatcacacagagaactgtttattactttattctttcatctgttttctgttttcaggatatccttagcaaattgcacacagtgaagaaattattcagacatacttttccattttgactcatcaagttctttggcttcccatggtttaggtgttgaaccataagtcattttggaaatgcatgctgtcatatctgggttttattttttaatatatacatacatatatatgcacacatgcatttatttttaatacacgtatacaaatatattcagaataatcaaaacacaaactcatagggtgactaaattgtcagttactttgaatttgaaattgagttggacccttatgacaaaaccaagggttattttgacttcctgggactaaatctttatggctgtttgatatgctaagcaatggtgtttatggacttaagccacaattgagggaaaagaatttcttcttcaactctatttaaggttctccaagatagaagagagttcaatatatggttgattctttaatgggatccagctagaatatagcacataactatcattttcataaaaattcaaaaaggaagtcaccataactaggatgacataaaggcatgtcatagccttcttcctacagggacttactataatcctgtgaccccaggcagagggttaaaatgcctactttggaacataccctttcccatcatctgagcaactgctgaatttgtcaccttgtaaaccacttggatagatctcactccatgaagggcattcatgccacccagcttccatcaaaaatgccactttacattgtgcttggtgattttgcagctattaattcttggatcattccatacattatctctgagtttccatggataaattgttgatagtatacctattttccacagaaaacagatgttaatattaacttggtcaaggtcacatacctagttaatagtatgtccagaatttgacaccaggatttctatcttctaatcatcattcctgttaattaagcaccttctgtataccttgcagtgatttaggcatcatctttaatcattacatgtttcctgacaggtaggtcttactgtcactcattttacatatgttgaaaatgaggcctagaaaggtgaaatgaattggtgaaattcacttgcattgtaacagaatgagaattcacacggaatctctcagtcttcatacctgtgctttttctgcttcattcacttgaaacatgaagaaacactagtgttgtaggttttgggtggtgaaatgaaaagtatcaatctgtaaacagttctctagtggctgggtttggcccactatcaaagcttttggttggtaagagcacagagttcagcgttctgcatttgggctgctctaacttttttattctgccaagtgctgactgttaaaactcatctcactgctaagccttcctcaagtctttggcacccttgctatagagccaggtggtctgaagaaaagctccctctaggttgttgcacactgtacacaacacattacagtgcgagacaactgtcagttccttcctttccttctcccctacccttccagaaagctgggccccagatggaagagctggaaatgtgtcaactgttctctgaagggcattgagaaaatactgtcaggaagaaaaggcaagcgcaacagctcattagtccactaatcagacaggacgaccatcaatttcacaaagaaaatgtcctgaacagagaaatgggaagggctggcagagtgttgcccacatggttctgagaactgcacatttttgtcaggggatttgtaacttgggggcattgctttcttgattgactttattatatccctttcccaagtgtggccactgcaaactgaagcataaaaatggtatttggagatacttttctacaaataccattgtgtcccatcaatgcacaaaaatgttccttgttgccaggatcgtgaacactcttgtatgtattgtctttatagctgtgctctcacagaaggaaaacttggactttaccttcttatttgagcctttgctccccattttttacactttaatttgaattcagcagttattggagaatgaatggctggtacttaagtgaaaagcttagaattactgtgaggaacatagctcaatttaaaggtgattatggtaaccctggtcgtattattaactaagtatgtaacaagttctctttgatagggaaaaataacttgttagatatattagaatattactcattggtatcaagtctgattcctgttagctcagacctacctaattgcagcatcatgaagtttatctaatttatctttctggaattttgttgccatttagtattatcaaacaactgcctattattaattgttcccatagatgaagtagcctctgcttcatgtagactcagctctacttttcatctttttgaacaatgtatagcatgaatgacatttacatgtttgaggtcagagaggttgactccctcttttttcctacttgatgtagttgatatgtatatatataatttagtacatcattattaatggtgatttttttttttttaagacagagtcgctctgtcacccaggctagagtgcagtggcatgatcttggctcactgcaacctccgcctcccaggttcaagcgattctcttgcctcagcctcctgagtaactgggactacaggtgcccaccaccacacccagctaatttttatatttttagtagagacagggtttcaccatgttggccaggctgatctcaaactcctgaccttaggtgatccacccgcctcagcctcccaaagtgctaggtttacaggcatgagccaccgtgcccagcctattaatattgatttatatataactgattgattttcttttcatgtcttgcagttgaggcctaagtctagatagttcccatgttagctttttcacccctaataatttgattcatttataaggagaagttaaagaaaatgcatttgaggtaagctatatttgtaacctggtttcttcctttctcagccactatctaaagactgctaactttcagttcacatcacctcttgaccttgtttcctcattttagttcctagggttgaagtaacaaagtaccactaactgagtggcttaagacaatagaaattcattctctcacagttcagaaagccagaggcccaaaattgaggtatcagcaaggttgattccttcccggggtttcagaggacaaatgtgtccccttctccctcctggcttgctggttgctggcactccttggcattcctcggtgtatagatgtgtcactctagtccctgcctctgtcgccacttggtgtgactgtcctctctttggcttccctctgtgtatgtctctgtgtctgtgtctcatcccttctttaaggacaccattcagattggatttagagcccacccagacaatctaggatgatctcatcctctcaagatttttaacttaatgatatcttcaaagacccttttgccaaatcaggtaacattcacagttccagatgttgggatgtggacatatcttttagggggtcactattcagcctattataccaagcagtcctctagggaagtatgttggtatttcaaattgttgtctgtttttgcaaacttttagaaaaccctaacctccatttctctgattctctgcagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcatgtgagacctcttagttacttatgtttgtagttcagagtgacatttggatctaagtgactgacttgtatgaagcgttccacatatattattcagtgttttcaaagtactattgaaaatatagacacagatatatatttctggttgtttcttttataaattacttttaccctctgagaataatacttagcttatttggatatttagttgtttaaatattttgttttcatattctttggctggtaactatttttatttctttgactctaacaataatgaatttaaattattatattgccttatgggattccaagtaagttttctaaaattatagaattctaaaaatgttccagtgctgtcatggtaagactttttacaaaagagaatattgttgtatttgtttactagggctgccataatgaaataccacagactggatggtttaaacaatttatttttattcactttttcacagttctggaggcaagaatgtaaagatcaaggtattggcaggtttggttttacctgggccttgtagatggttgccttcttgccatatcctcacatggtctttcctccattttgcgtccctggtgtctcttcccctgcctttaaggataataatcatattggattagggactactcataatacctcttttaaccttaatgaactcttcaaagtatctccaaatatagtcctattctgaggtacaaggggtaagacttcaatgtatgaatttggccaaggctcgggcagaattcagtccataaccattatgttagctaataatatatgtaacaatatattcaacttcactaaccatcaaggaaatgcaaactaacacccaatacagtaccattatacacccaccaggatgttcaaaatgataccaagttttggtgaggatgtatggagcaacttgaacactcatacaatgctggttggagtgtaatttagtacatcttttggaaattggcagtttgcactaatgctgaatttccacgtgccctgtaactcaacaatttcagtcctatatatctataatcaccaaaagaaccccagataaactagtatacatacatgcacacaagtgtcttgatcttcatttgagttctacctttccatgcacatgctgccgtccccagttcactttgacactctgcagatcttttgcctgtaaaccaaaatgtactgctatttttggaatgcccaaaaagtgtcagagcactgagctagatgctgtatgtattgtttcatttaaatgccattacacaagcttgcacactgtccttgctcaaaattttttgttttttgtgtttattattttaaaaggcaagagaagagaatgtaagatgtacagctttaattggaagtttattattttccaaaacatttgaaatggagtagctggtaactgtagcattcagtttgagccagagtgaatgaaaagaagtgtgatatcccttttcttaaattctaatttctatctcaaagttgaacagccctagacatatatactatcttgaaaagaaacagatttaaacctcagccatcaatcagatttcaagatacaccaataggtatatgtatatacaaattcagccctttttacttccatatttggctgcttggcggtggttgtgtttcatttcagaaaatgtgatcatacatttttttctaaagagactacgaaaaagcctttctatacatcagagaagctaaaagcatggtaatgtgttatttttattggttccttcaaaatggagcaactttccaatggcaattgacctttctgtgaaaacaaagaaatggcagactattgcaactaattttctggattgctgaggttgagtgttcaactttcctttcattagctttactaattttctttagtggaagacacaagaaaactcaccccttttctcagcccgttagtctgttatgcagtgaatcattcagcagcattttcctaaacaccctttgctgaacaaagcaaaaatatacactgtatacacaacttataaaacttaattaaagtatgcacatatgtattgtgtattgtattattaataagtgaacatctattaaggcaacacaaatatagaaataaacaagcataggccaggcgcagtggctcacacctataatcctaacactttgggaggccgaggaggacagatcacttgaggtcaggagttcgagaccagcctggccaacatggtgaaaccctgtctctactaaaaatacaaaaaattagctggatgtggtggtgcgtgcctgtaatcccagctactcgggaggctgaggaaggagaattccttgaactcaggagacggaggttgcagtaagctgagattaaaccactgcactccagcctgggaaacagagcaagactcggtctctaaaaaaaaaagtgaaatagtggaagcatgcacataggcagcacagagatgtagtgaatccactaaggttaccttcaagcggagcaacagcagtatgtgtcaaagaatgctccttaacagagatgatacctgaaccgtatgggatgaagaagagcttgccaggtcaaatttgagtaaggttcagtgtaagaagagggaacagagatggttaactgactgtgactggcttagaggaagtagaagggaagtggaagattttttatgattaataagttggtttttggcaaaatatgactaaatgtcttttttctaagctaggtaaagattaaatgattggctctttaaacattgcttatgtcttaaattgtttcttatgtttttagataaagtttcacttttttagttttttaaggctggatatgattaagtgaaaacagaatgatacttaggtactagataatttagatttttacttgatgccaacaagaacgtagctcagtgccaggcacggtggctcatgcctgtaatcccagcctttgggaggccaaggcaggaggatcacttgagcccaggagtttgagaccagcctgggcaatatagtgagactccctgatctacaaaaaattttaaaaaaagaaattagctgtgcatggtggcatgtgcctgtagtcccagctactcaggaggctgaggtgggaggacacctgagtccaggaggtcgaggctgcaccaggaggtcaaggctgcaatgggccaagatggtgctgctgcactccagcttggatgacagaatgagaccctgcctcaaaaaaacaaacaagcaaaaccatagctctagggttgttttcgaaattaaaattttcaagaaatgactattaagaactaaataggaaaactgtaattaatcacatgtattataatttgagcaaaaatgtaggatgggagtgtcctgcatggaatcaggaagatgctttattgaatgaccaagggtttggcagtattaatctagcactgttaaggcagagagtaactggctctaatggacatgagtattctggatggccaaagagataggtaccttattgtaggaataagtcattaaatcagtaggcctaaaaaatatccctcatattatcataactcttttttctggtgtcttgctcacatgctaccttctgattgactgcctagtgttttggggaccttgaaattgggaaggagatgcaatgtaaaagatgggcatgagtatcccatcactggaaagatctattggcccagacccatctcaagcactacctgttgcaggaagtctttcttaaaactacccacccctgcccatggcacctgtagagttagatttcccttcttattgctctgggagcactctgctttctttttaacgctccagtgttactctgttaccatttttatctgacagcagtctcactgaggacagaaccagttttgcatacctttataacatgtgctttacaaaattcaaatgaacaaacgaaaatacaaacaagaaaaaatgaacaaaggttcccttgttttacacgtaacctgagtctttcattttggctttcttttagtaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtggtaagtacagcctcactgttgttctcagctgcctgagtatgtggctcaggtccaaagcgagcaaagttctagatatttctgctcattttcaaacccatggtcatatggcaaatgctacagactagactagttattgaataacttgtgtaaaactgtttaaatgtaggtttcttttcttttcttttcttctttctttttttttgagggtcttactgtgtcacccagcctggagtatgatggtgcgaacacagctcacttcagccttgaccttccaggtttaagcagttctcttgctgcatcctcctgagtagttgggactacatgtgcatgccgccatgcccagctaatttttttattttggtagagatgggatctctctatcttgttcaggctgctttcaaactcctagcctcaagcagtctgcctgtctcggcttcccaaagtgctgggattataagcatgatgtttaattgtagattttatgtcagtgcttatcaaagaaacaatcgataatgtttacttgttatttaaggtggtgatttaattccaataagcaactttggattttttttaaaactgctctcaacaggcccactggtgtccaaccaagttaatgcaaggttttgtaatttaatatattcagtgcttagtgcattgtttccaaaccaaggagagtagagaggtagcaagtttaattttcaaaacaatgatttctaaaattacaagttacgtggcctaaataaatactatcaaaataaacagtatcaaagggattgcattgttcagctcctcgtgcatataaacttgcttaagaatttgcaaggtacacataatttttctttctttctatactgcacgtggtgaacctgtggcataaaggagtgattttctgacttcgacacctgggtggggttttattctcagtgtttataagggaagtactgccagttcccaatgtttctaattgaatttacctccaataaaagcattctgtgctcctttgtgtatgttaacccctttatatgggataaaaagatgaatcacagcactaatccttgaagctgcagctctccgagtgtaaatctagggaccctgaagattctccaggatcctttctggagatccagaaggtgaaaactattttcataatataacagtagactaaatgcaaaagtagagagaatacaactggcttctagtatgctagatattaaagagactttctattatgctagatattaaagagacttgcaaaatgataaaacagtgctgctcttcttactgcatttattttggaaaatacagattttaaaaatcacacctcagtctgaaccaatatagttattttttattttaattaaattctcagctttaatttctgatatagtaatgtcaataaatgtaatccatataaattagaggaattctgagaccaaacagtttaagaattattgccttaaaaaatttctcagtctaaggccagatgtggtggctcacgcctgtaatttgggaagccaaggtgggaggattgcttggatgcaggagttcaagaccagcctgggtacatagtgagactgcctctacaaaatgattttttaaaagttagctgagtgtggtggcatatgcctgtggtcctagatactcagtaggttgaggtgggaggattccttgggcccaggaaagctatgtttgcaccactgcacttccagcctaggtgacagagtgagaccctatctcaaaacataaatttaaaaaatttctcagtctattatgaaaggaacaactttcatacaaggcaaaatgcaatatatgactttttcatcatttgtgaggtttagtccttgttacgtatgactgtaggttattttcattgctatatagtgtcatattgtaggaatataccacaatttatacctttgggttatctgacatttaagtcatttgtaatttggggcagttttggggtctccagcatctcccccatgtttggagatttgccagaaggagtcacaggacttgacatacagttgtgctcacagctaagatctattacagaggcatagtaaggagacatagtgagagagacacagtctggaggaacccatctgcaggtttccttatgctctctgcctctcctgaatggtaacacagagctccctttccttagcaacaaaaataacagcaacatatatgcagtgtttctgtcaagggaagcctattacagactcaatgccaaggtttttgttggggcctggtcacatagtcagtctttgcctagcacctgccaaattttaccctcttagaaggaaaacccgtgtttagcatgaaccatactgttcgcagaaccactctacacacggccacccttatcggttagggagaagtttagttcttttttattttaaacctgtttattcctcaaattttagactactacagaaaaatcttactggatccagagtaaggttattggagttaaatgtcaaaatgagcttgaacataattggaaacaaagcagacatcaaaatgttatgttgattccagcagcaaattaagtattatctattcttaaaaataatttcaagactaaaagtaaaaatgtcaaaaattcatttgcggcgggcggatcatgaggtcaggagatcgagatcatcctggctcacacagtgaaaccccatctctactaaaaatacaaaaaattagccgggcgtggagcttgcagtgagccaagatcgtgccactgcactccagcctgggcaacagagcaagactccgtctcaaaaaaaaaaaaaaaattcatttgtaaaaaatttgaatctttttttagttatgaaaagtatatgtaggtgtgtccaattatttcttttaaatggccacatttgggttaccttttttttccatagtaaaatatacattatagaatataccattttaacctcttttaagtagacagttcagtggtcttaagtacattcatattgtttgtgctgttcaccatgtgtccctgtttgccattgtgtatttagagcctatgagcaccacagggttaaggaatttatacaattgctttttttgaattgtgatgaaatttactatattaactatttttaggtttacagtttagtgacaataagtatattcatattatcatacaaccatcatcaccatccatctccaaaactcttttcatcttgcaaaactgcaccaattaaacaataataccccattcccccctctccctagaccctggcaattaccattctactttctgtccctatggatttaactactctaggtacctcatacaagtagaatcatacagtatttgtctttttgtgactagcctatttcacttagcttaatgtccttagggtttatgcatgttatagcatatgtcagactttcctactttttaaggctaatatttcattttatgtctatatcacattttattgatctgttaattccccaatggacacatgggttgctgccacctcttcagttaagaaaagttttatatcaatgtaggaaactgtttgccatccagggtcctagatgccagccagtggcccaaccttacaagcaggcctttctaaggctagcagttttaggcctactatgttaactcttttttgtacagaaccattacaaataatgttcctatgaacattcttttacacgtgtggaaacactgcacgcaacagtggaattgtggtttcatatgtgtggtgtgtacctgtagtcacagctactcaggagactgaggcaggaggatcactttggtccaggagtttgaggccagcctgggtaacatagacagacccccatctctaaaaataaaggccacataatttagtagctggagttatccatctgcattctgtgtccatggtgtataagaagtaaggtactgagagtccctaactataccagaaagcaagcatgggcattttgcacttcaaggtaatggtaaatgttttgtgcttcacttacttattattatttggagaatgtactttctggaggatagtttggcaatgtttctggtaccattcatcctaagaaaataataaacataaacaatatacaccaagataatcagttcaacattaagtaccccctcccccattgaagctaactgaaaggtctgtaaaaccctgaggaaagtacaatttatctgttgtcgttaaaaatcaagtctcattctggttcagaggcaaggtagaaagacagacttctccctattccccccaataagtagcaaaaagccgtggactttacctataaaacaaaaataattagagtcttcaccaggtgtggtggagtgtgtctgtagtcccacctatgtagtcccagctgaggcaggtggattgtgagcctgggggacagagcaagaccccatcactttaaaaaaaaaagagagagagactcttaaaggtagagagaagacagcagattcactcatgggacccaagggactacataagcagtgagttccctaggttttgtgtttttctgatatatcccacaccaggttatgcagaaaatgttgagtttaagagtaaaaatataggtaagtaaataaactttccttagctggcatagtggagtatgcctatagtcccagatactcaggaagttgaggcaggaggatcacttaagcccaggagttcgaggctgccatgagccatgatcacaccactgcactcctgcctgggtgacaaagcaatactctgtagatagagatagatagatagatagatagatagatagatagatagatagatagatagatagatgacagagcaatactctgtagatagatatagatatagatacatacatacatatacatacatatatatatacataggtaactagctaactaactttccctctcctgagttttctaaattatgtttcttgttggcagcaaaaattactttgcctgatatggttgtcactatatgtagaggaaataattgccaatttttattataaaccaggaggataaagatagacaaggtttctgtatttctgtattttggtcagtggtggttacatgaaaatacacatatggcaaaatggtatagaactataagtatgttgtaccaatgttagtttcctagttttgagattgtaaccctttgggaagccaagttggaaggatcacttgaggtcaagagttggagatcagcctggtcaacatggcaaaatcccatctgtactaaaaatacaaaaattagccaggagtgccagtgcacacctgtaatcccagctacttggaaggctgaggcacaagaatcacttgaacctgggaggctgaggttgcagtgagctgagatcacaccactgcactccagcatgggtgacaaaacaagactgtgtctcaaaaaaaaaaaaaagatgtaagcattggagaaagctgaatagaggatacattggagtataagtgttgcccttgaaatccagagaccagattccctcagcatcttacctctcaacgttcttctctctgctctgacacatctttcccaaagctgcatttcagtttcctcaaggacaacactgatgtacagaaatccttgtccccctaagtttgattcaaatatatcttctctggccaggtaacacccataatcccagaatttggaaggcccaggccgacttgaggccaggagcttaagaccagcctggggaatgtagcatgactccttcctctacaaaaaaaaaaatttaaattagctgggcatggccaggcacggtggctcacgcctgtaatcccaccactttgggaggccaaggtgggcggatcacgaggtcaggagttcaaggttgcagtgagctataatcatgctactgcactccagcctaagtgacagagctagaccctatctctgaaaaaaaaaaatttttaagcaaatacgtcttctctgtgagtcagtagtgtcctgtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccatacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttttctgccttaatgcgtacaaatctgctctaccccctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatacaaatattgtgtgaactttgaagaaaatatttttatttgttcattccccttagcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtttgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcagctgagcacggtggctcacccctgtaatcccaacactttggaaggctgagggaggaagatagcttgagctcaggagttcaggaccagcctagacaacatagcgagactgcatctctactaaacatttaaaaaacaaaataaaaagaccgggcgcggtggctctcccttgtaatcccaccactttaggaggccgaggcgggtggatcacaaagtcaggagttcaccgtcaggagatcacaggaggtggaggttacagtgagccgagaccgcgccactgcgctctggcctgggcaacagagcaagactccatctcaaataaataaataaataaataacattaaaaaaaaaaaaaaagaagagtttggcactataagttttggaagtccagttttggaagttgaacaaggttatttatcttttcagaactcaacagtgacaattgaggaattccactgtaagctccaagaagccacaaactttccccttcgtccttttgtgattccatttctcaaggtaatttgataattactgaatataatttatcttgaatatttcctcaaattctgctaatccctgttacgtgatttaaatcagagccgcttgccacgtttttagatctttattttgggctggtagagaggtctgagtgcagttaacagataaacgtcaggtttaatgagatgagaattgcaaaagccttaagttgtggtctgtgtgcagacactgctgctaacacatagaagtagctagcataggagagaataggaggtgcttgggctggaagtgtgaaagtggaagggaggctgaggtcctagcagaagaaataactggtcactaatcctttgggtatagtcagagtgtgaagagtgttgtctgagaggctgtcagacaaaaggcaaggtctttgcagtttagacttactctaaggtcaggagacgatgtaggaagacagtgtttgtgtctccccgaaccccagatagtctagtttctaaagatgtcttctgcaataatgttctctggagcataacttttggagagattgttctgcattatcatgcttacatgataaatgaaatgaggccatgttatatatgttatatttacatggaataaaatcttctaaacagcttttggccagtcacggtggttcacacctataatcccagcactttgggaggccaaggcaggtggattgcatgagctcaggagttcaagaccagactggccaacatggcaaaacccccgtctctgccaaaaaaaaatagaaaaaaaaaatagccaggcgcttgtagtcccagctagttgggaggctgaggcaggagaatcacttgaacctgggaggcagaggaagcaggtgagctgacattgtgccactgcaccccagcctgggtgacagagtgagacattctcaaaaataaaataaaataaagaataaaaaaagaaatatttaagagtaagccgcaaggccgggtgtggtggctcacgcctataatccatgcacgttgggaggccgaggcaggcagattacctgaggtcaggagttagagaccagcctgactaatgtggtgaaaccctgtcttcactaaaaatagaaaaaattagcacatgcctgtagtcccagctactcacgaggctgaggcaggagaattgcttgaacctgggaggtgcaggttgcagtgagccaagattgtgccactgcactccagcctgggtgacagaacaagactctgtctcaaaaaagaaaagtaagctgcagacattatacatctaaatacttaaatacaggtatcaaatcaggaaagtaacattcatacaacactgttacctatagaccttattcatatttcaccacatgtcccactaatgtcttttacaacaaagaaaaacttgggagggagcatagttctggatctgactcaggatcacccattgcattttgttgtcacgtctctttagtccactttaatctggcacagttactcagctctttgtgatcttgacgtttttacagaatacaagatagttattctatctgcgcacctggatttggttttctctggtgttgatttgattagaatcatttaacagaaaaactgtattcaattgttactgtattttgaattttgtcaatatttatggaaatttgttttctctcttttatgagtatctctataatacctttaattttactgccttttttttttttttttttttttttttggggagacaaaatctcgccctgttgcccaggctggagtgcagtggcgcgatctcggctctacaacctctgcctcccgagttcaagcgattcttctgcctcagcctccagtgtagctgggactacaggcacgcgccaccacacccggctaatttttgtatttatagtagagactattaatagtagcgaccatattgtccaggctggtctcaaactcctgaccttgtgatccaccctccttggcctcccaaagtgctgggattacacgtgtgagccaccgtgcccagcgtctaattttgcctcttaacaaagcctaaaatatttactgtctggtcaaataaatatgccccttttactttcttttaccttattttcatttcctaagaaaatgtaacagcatcatacagatgggttatcttactaaagtactaataccagttttttaaaaccttctattggagcacagcagatacacaggaaaatgcatcggtctaaggtgcacagcctgtatcatggctcggttctaatggcattgaagcctcggctgctctgagcagcctgtggtgcctttttgagccctgaaacagctgtgctggttctatcttggtctcctttatgtatgtcagagctggtagacaattatttccccaagactctagaatcaagaaagatttgtgaaatttgtgttaataggaaataattagcatgttttttattcatcatgggacacatgtcagccgtgtaaagatctgacatggtgtttttttcaattaagtttttacagttgcaacaagattgaggttatagaacagactttaaaagagttttatatagtcaaattccttattcttaactctgttattttggaaaacagcatgaggtaggttgttatggcagctttttggctagcatttggggttttgtcaatttatttctgctttaaaacagtcactaattatggtgcctgctaaattaaccctcagtgaagggatggctacttgcatgtattaaaactctcctttcacttgctcatctgtcccttgggattaagcctttgcttatgagcccagcctgcattgcttttaaatttggtgagaaaaatataatttctactttatgttttttttaataaaaatgggaaaagtaaattctgtatatgaaagagatcgagttctgagcttttaaagatgtatagggttttaaaatgtgatttgttcctattgcaggttttctaagtatgagagacagaaaaatacctacttaatgaattatctttttacattttacatcactcccagtgctccttttcaaactcccatgtttcagaataatcacagtttccagaattctgttgcagcttttatacagagctggaaggaaggttgagtagtgctatcagagatgagttggggtccagaagagagaaaccagggcttggaatgactcccacataggcagtagtaattctctcactgactaaagtcttcagaagcgtatgttttaaaattattatgttcaacaaccctttattgagctttgactgtatactaggctgcaaaggtaaataaggtacaatctcttccttaagcatatttacatctggttggggcaagagacaattgaaccagtaattcaagtgcagtataagagatatcattgactcacagaagaagcatttgaaaatcagactgccaaggagagaaaggcttttatcttgtatcatctgctttgtgaaagccctttgaggtgctgagccttcttgtgtagggcctaacactggaaaaactgcctcttcctttcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggtgagcagatgagctttgctgtccttgccttcctggaaccgcactggtcctcccctttgcttataaaagagagagaatttgattgctgtggttgtaatgtctcaaactttttttgagacaaggcctggctctgtcgcccagactggagcgcagtggtgcaatctttgctccctgcagcctccatctcctgggctcaagcgatcctctcacctcagcctcctgagtatctgggattacaggcacgtgccaccatgaccagctaatgtttgtttgtttgtttgtttgtttgtttgtttgtttgtttttggagagatgaggttttaccatgttgcccaggctggtctcaaacttgtgagctcaagagatctgcccgcctcaacctcccaaagtgctgggattatatggatgtgagccaccatgcccagcccaatgtctcagactttctgtggttatttttgctttattccaatacctagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattggaaaaaaaaaaaaaagaaaagaaaagaaaaaacaaaaaaaaagaaatacaatctgccaaatgccttttatgtcaaacgcatttttttctgatctgagaagttttgaaaaagtatagcaattaattattaatatttgccaatgactcacctttactgagattaaaattaatatgaatttattttagaaaactccctatgagtggctatcaaaatattctatgggttatcaaagaaggcaatatcaacaatagtggataggctttaatgacatttttttaaaagtaaaaaaaaaaaaaaaaaaagaaaatttattacagttgaatctgagtgactgaaaaccctgctactacacaattggacccactgttaatttgactggctttaaaaaaaaaaaaaagacacaattggatttgttatatgagcctttttcctcccatgtagtttctttccagtaactcatctccacagtaacaaatttgaccttaatactttcctaagtatggttgaacccgtaactcagaaaaacggtgtcatctccttagtctctcctttgctttataagggttaatgtttctgtctggttatggatggatttgacctcttttttcatgctggtataagtcagcaatttacatgaggtgcctggcccttgaagacaattcagctcatgcctcatgtcacacctttccttagaggcttcctgtttatgccagcatgtagcaaaatacctaatacatagtaggttctcaggaaatgtctgcatgaacacttgttgacaggatcagatacgcacttctgcttcttctacaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtaagcaaccgaagcagcatggtaaattcagactggattcttggatttctttccaactcaatgataaagtcaaataatatgattgctttttcccactgattggataaaacaatattatacatagactattagaatcatagttgatcttatttgatatcaatctcatttgataccttgttgctatgatatgatagaagtacagctaggtgtggtgactggtgtctgtaatcccagctcttagagaggctgaggtggaaggatcacttgaagccagtctgggcaacatagtgagatcccatctctacaaaaaattttaaaaactagccaggcttggtggcatgcgcctgtggtcccagctactagggaggctgaggagggaggatcagttgagtccaggaagtcaaaactacattgagccatgatcttgccactgcattcagcctgggtgacagagtgagacctgtctaaaaaagaataaaggggtatcgcctattctcagatggttcagaagaagagaatgaaaaagcaaaggaggtaaaatgttaacatttgagaactctgtttgaagatatgtgagaattctttgtgctccttttgcagctcttctataaatctgagtttattgcagaataaaagtttttaaaattaggccaagctcagtggctcatgcctataatcccagcactttggaaggccaaggcaggaggatcacttgaggccagaagtttgataccagcatgggcaacatagagagacctcatctctacaacaacaacaacaaaaattaaaaatgaggcaggaggggctgggcgtggtggctcacgcctgtaatcccagcactttgggaggctgaggtgggtggatcatgaggtcaggagatggagaccaatctggctaatacagtgaaaccctgtctctactaaaaatacaaaaacttagctgggcgtggtggtgggcacctgtagtcccagctactcaggaggctgaggcaggagaatggcgtgaacccagaaggcggagcttgcagtgagccgagatcacgccccagcactccagcctgggcaacagagcaagactccgtctccaaaaaaacaaaaccaaacaaaaaacaaacaaaaaaaatgaggcaggaggactgcttgagcccaagaggtcaagactgcaatgagccatgatggtgccactgcactcccctcctgggcaacatggtgagaccctgcctcaacacaataaaaaatgtttttaaaattaagcaggaaagatgcaagatttcaccttggaggagaaagtgcatggacatttaggtcaggaggtgaggcatatcgaaatcttggctctgcatcctaactagctgtgtgatctcaggcaagttgcttgggctctctgagcctcagaagagtaatttctaaatgattgtaacgccaccccctgtgctaggttgttgttccatttggaatgcctggtatataggtgctcagaaacctttaaatttaggaagaaacagaaaagaaaccttaacaaacctcttctagttttggacagagcggtttgtcatgtactcttacacgttttcagcataaggttttttggagtaaaactgctgagcagagaaccaaagggctatcagcttccagggtttccctaaatttccatgtataccttgttgagtaaaaaactgcaatacatttgccctcacttcctcttacttaggctcactagcatctttcagacgcttggccacagtggggcccctggcatcatgtagtgggatagtagctgaatagggaaggctgtagcagccatggtgttctcagagccaacatttactgagtcgtagctaccacttagattgtgttgtaagtacattgtcttattttatcctcacaggagtcccagacaattgttatcccctttttacagatgaaggagctatggccaaaaatcacttagctaataattggcagagacaaaattcagaccccaattgtcttatgcccaaggtttagatgtactggcagtatgttatgatacttatcctagtgttcaacccctgttactcctatgcctctcttttatctattaaaaactgcttgcgggcggtctggcgtggtggttcatgcctgtaatcccagcactttgggaggcctaggtgggcgaatcgtgaggtcaggagatcgagaccatcctggctaacatggtaaaaccccgtctctactaaaaatacaaaaaattagctgggcgtggttacaggcacctgtagtcccagctacttgggaggctgaggcaggagtagggcgtgaacctgggaggtgggggttgcagtgagccaagatcacaccgctgcactccatcctggcaacagagtgagactccgtcaaggggggggaaaaaaactggcttgctttgattggaaatagcacagtgggggaaaaaactggcttgctaattaatggtttcttctggaccttttttgccagtttgacttgagaaagaagtatgctaaaaactaggtatggggtctcactatattgcccaagctggacccctgggctcaagtgatctacctgtgtcagcctcctgagtggctgggactataggcccaccccaccacacctggcttttattactacattttttgacagattttacaaatcatgaggaactcaatatatactgaaataaacagattatcacactaatacatagtcactatgaatattatgactataaattcagactggtaacaggggtgttgtgttaatgactcaaagactaagcactgttactgtatgtgacttaggtttaaaatagtagacaattcttactggtatacccttaattcacacagttgttccattcctggaagtttcagtatatatcaaaactatccccccaccaaaaaaatttttttaagttactgataatattaagctgtttccaagtggttataccagtacacacgctagttttggtggttaattattcgcattgcaccacatccttgtcaacacttagtattatctgacattttaattttttccagtatgttagatgtgaaatgctatgtatgacatacctgtttatttcttttacctctttttctttagggctatttcgtgttttacaattgatttgttggagttttttatataatgtgaatcgtgatcctttgttggttatattgtcattttgtgggtcccccaccccattgtgaatcattgccttagtagtgtgatcaaagttattatgaatatgtgtgtatttacttggtagaatttgcttctattgtgtttttcctgctatctttgaatttaatctgtaatttctaataggtctaaatggaggctatcaagatgagttggtagatcatcgtttgacagaaagggaatgggctgatgaatggaaacatcttgaccatgtaagaatcttgtagtgtgtaatgtccctaactctttattacttttttttgaaacaggagtctcgctctgtcacccaggatggagtgcagtggtatgatctcagttcactgcaacttctgcttcccaggttcaagcaattctcctgcctctgtcttcggagtagctgggattacaggtgtacgccaccgtgcctggctaatttttgtatttttagtagagacagggttttgccatgttggccaggctggtctcaaacccctgacctcaagtgatctccccacctcagcctctcagagtgctgtgattacaggtgtgagccaccgcactcagcctacttaatgctaccaataattaatggaacatgtatgcttgaagtgaacataaccacagccatgacatcctttgcttttaataaaagctggtttagctactactccctcagctgaggaattacagagtcactccctaatctttgtgatgggatgatcacttcaggtcagaaaccaaataaagtcatgtagtataatggttaacaacaaaggtttgtagccaggtgcagtggcacatgcctgtagtcccagctactcgggaagctaaggcaggaggatctcttaagcccaggagccaagacttcaagtctagtctgggcaacatagcaagatggaattcatttgtatttgttaaatttttatcaaaagaaactttctttttatttttttcaattctgctccttctgtagtaaagagattgctttttagcccacatactcatgtttcgtagttttagaacacaggtcagtaacaaacttctaggtaattcaaccccccaaaattgtttatattccaaaattattttgcactctgaaagatagcagccttcctcatctcatcaaaattcataatttctgttagaaatgtgtgtgtgccttattttatggttcagccacagcaaatttacagtgctgcagaccctagggatacaacaaatgctgctgcaacatgaaatagtagactgttggccagaaggccatgcatctgaggttttgtccaaacactggaagccctggtagttattgtcctctttaggtatgtcagcctcaacaccaatgtccttcctagctgatggagaaacagacagcaataaaggttttaaatgtaaacttgatattcctaaatctgtactttaaggaacctgaattcctcatattgcgttggcctgatttacagtgttggttgtttgaatgttcttatctcatctctgcctggccccctctgtgactcaggcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatggtaaggggagagtctacgggaaacccaaaataaatgtcagcctttagagcccaccaatctgtcacagaaggcgttttctacttgactttaaagaaaggtggtactcaattgtggatttagggaaactcaggtgattatgaaaagtaaatgagaaaatatatgaagcccctggcatgttttggtgggtggcgcaggaagggggtttttttgttttggatagacaggatctcactgtgttgcccaggctggccttggactcctggcctcaagcaatcctcctgcctcaccctcccaaagcaccaggattacaggcctgagccactgtgcccagcctcgtacttggcgtgttcaaaaaatgttaattcttcgtggagaatgagaatatttgtgattttgttctgtctttaactctttacatatatgtgtgctaggtgttggtcagagtgtttggttgtcaaattcagcctggctggatgtatgtactaggcactcttgtgtcatcactttcatttctcacagtagccctgaaagtgtttaccttaccttccctcctcctgtccccagcccaccattcaggaaaataccactcaatccaccatggcctggtggcctcctacaaaaggttttaccataccacgctgggttgtttccccttgcctttcagagtctgaagcagcagcaatccagagtacatccagcaaacctcagttattcccctcaaaatgttccagcacattcacccagtaactgagaaagtgccctatccaaaggcatagctgagtgacaggccatctgtgataagactcttcccacgcactctgagttcccaaatgttcaccacgaagaacaagtctcttacgacagacctagtatgttccattgaaggcagctattagtctctaaaagactgtaaggaaaacttgaggcaaagccagaattaatacagtatgtacagacagtgggagttaaaggctcacctttccccaccccacccacagcagcagctctggagccaaccatggaattacaaccattaggtggaatatctagcacaacaaggcgtcaacacatatgtagagttatatagtatgattcctttcgtaaaaactcgaaaaacaggccgggcgtggtggctcatgcctgtgatcccagcactttcggaggctgaggtgggcagatcacagggtcaggagatcgagaccatcctggctaacacggtgaaaccccgtctctactaaaaatacaaaaaattagccaggcgtggtggcggacgcctgtactcccagctactggggaggttgaggcaggagaatggcgtgaaccccggaggcggagcttgcagtgagccgagatcgcgccattgcactctagcctgggtgacagagcaagactccatctcaaaaaaacaaacaaaaaactccaaaaacagacaaagctaatcttctggtctccctcactttctgaacatttgcagatccctgtgcgactttcggacagggagaaaggcttttggagacgtagctaaagtttacacccaagccatacctcattcatcagtgagtccacatgtgtgcaggtgagaagcatagagtacagagggagctgcagtcgtgagccagtggttgctgagccaagatacagctcttgctggagtcattcaggtcttgctggagtcatttaaacatggctatgcatgaccactactcacctttctcaccttttgcatcaaggattagctctggggagcatgttttctgatttgcctgagacagtccagtttatacctgtgtcctgttaatagttattactagcatttccctcattctcaacaatgaaggcaatctggatgataagttatattgtcattctaggtttggtttctgacagcactatcaacctgatttagatagtatattttagtgtcatttatatgtttatctcatgtttattacttgtccattttagtatagtatgacagtataattcatatcctaaataaatgtactatgcaaaatgtgaaccaaaatgactccaaaaagtgccactggtctgattacatgaggagcttgggcacggttggcttcatcaagaaagtcttactgtgaaattagttctttttgtttgtttgtttgttcgtttttgtttgtttgttttgaaatggagtcttgctctgttgtccaggctggaatgcagtgcacattcttggctcattgcaacctcctgggttcaagccattctcttgcctcatcctcctgagtagctgggattacaggcacctgccaccatgcctggctacgttttgtatttttagtagagatggggtttcaccatgttggccaggctgggctcgaactcctgaccttgtatgatccacccaccttggcctcccaaagtgctgggattacagacataagccaccatgcccagcctgaaatgagttcttagacacatagttgttttacattctggcatatgttataccaataatcatagtttgagtagcattgtcctatattgggcagtattcttagacatttcaaagaatttcaccaatgactttttttttttttttttaacagagtctagctctgttgcccaggctggagtgcagtggcatgatctcggctcactgcaacctctgcgtcctggattcaagggattctcctgcctcagcttcctgagtagctgggattacaagcgcctgccaccacacccggctgagttttttttttttcagtagagacggctggtcttcaattcctaaccttgtgatccacccgcctcgtcctcccgaagtgctgggattacaagcatgagccaccgtgcccggcctcaccagtgacttttaaataagtaattagtgtttttgtttgagacggagtcttgtctgtcacccaggctggaatgcagtggcacgatcttgcctcactgctccccaggttcgagcagttctcctgccttagcctcccaagtagctgagattacaggtgtgccctaccacagccagctaatttttgtatttttagtagagatgaggtttcaccatgtttgccaggctggtctcgaactcccagcctcaagtaatctgcccgccttggcctcccaaagtgctgggattacagacataagctaccatgcctggccaagtaattagtgtttttaaagtcttgggttagctgggtgcagtgtctcacgcctgtaatccccgcactttgggaggctgaacgaggtggatcacgtgaagccaggagttcgagaccagcctggccaacatgtcaaaacactgtctctactaaaaacaaaaaaagttagccaggcatggtagcacatgcctgtactcccacctacttgggaggctgaggcacgagaatcactcaaacctgggaggcggaggttgtggtaagccgagatcacacactgcactccagcctgagcaacacagtgagactctgtcgcaaaaaaaaaataaataaataaataaataaataaaagtcttgggttatgcagaaatccatggtgtggatagttattgaagtaaagtggtttggtgatttggagagaaattgactagaggctttagatggcattattacttttcccatttaaattaatgcaatgtaggtttccttacctgaaaatttatgattcacaatgttttcacaaatagattttgttcagacagcaagcagtgtatttaggtgtcattaaaggatgcataaataagtgcaaaaaccataaggaaaagaagaaaatgcttatcacagagatcaggagactggtttcctctggctgtgtgggtggagggtgcagagttagtgagttctaactacgtctattcttgggacaggattgtcagtctggctagcattatttaaatactactatggcttgccatgacttacctcttagggatttggggttgctggtactgttctgtttcctgaactcaggcttatgatgttaaattgtatattaatatttttattatattgtatgttaatattttatgaactggtcagccatctaactttgcaagtaaaatttttttttgtttgtttgtttgtttttgtttgaaacggagtctcgctctgtcacctaggctggagtacagtggtgcagtctcggctcactgcaacctccgccttttggcttcaagtgattctcctgcctcagcctcccaagtagctggaattacaggtgcttgccaccatgcacagctaatttttgtatttttagtaaagacggggtttcaccatgttagtcaggtcggtctcgaactcctgacctcgtgatccacccgccttggcctcccaaagtgctgagattacacacatgagccactgcatctggccaaatttttaaacaaagaaaaagaatacttaatcagctatcagtttttcctcagaatgacagtcaagctcacattccgggcccttctggatgttatgattctgagacccaaaaatctgaatatagtccacctgtggtggctgacgccagtaatcccagcactttgagaggcagaggctggcaaatcgcttaaactcaggagttcaagaccagcctgggcaacatggtgaaaccctgtctctacaaaaaatatgaaaattagctgattgtggtggtatgtgcctatagtccggctacttgggaagctgaggtaggaggatggcttgagcccaggaggcagaacttgcagtgagctgagttcgtgccaatgcactccacctgggcaacagagcaagaccctatgtccaaaaaaaaaaaaaaaaaaaaaaaaaagaatctgaatatatgtgtttaatgagttcaataagcaggcaagtttgggaaaactgcctctagttaagtccatagcagatggacctcattcagtgtcacagggcttccaggcaactttttagtgacatgtgtgcacaattaagggtgaccactctctagaggtaagcctctaatattggagactgaaataaacagaaatgggaattaatagtagctcttcagggaaaagaaaactaccaataatgtagcattgttaatatctctggtgagaaaaagagaacaacattagaaatctacccaacttatatatccaaatcatgaatttcaaaaagaatgagcagaacaagtagagaggatagaatagttattgaaataattccaaaaaattaccaagacctgcaagacagttccaggttgaatcagtctaccaagtagacaacacaggaaaataaatagacttagtcgtttagcatcattgaaagttagaagacaattctgaaggaaaattattttaatttagaattctatacttaaccaaaacaattaagtgttagattagtaacctacaatttttcaaaaaatgcacctcctgcctaccctttctccacagtatctactgtaggatatgcctcaatatgtgaaagtaaaccagaaaatgggagacactgaattcctgaaagaggatccaacacaagaaaggaaggaaaggaatccctaggctggtgaaggagagccccaagcattagtggcaaagcaggcctagaaagcgcccagtccacgctggaacagcccagaaccttgctagagatttccttaagtaaatgaaatttataaaagatttacacaacaggaggataatttgagattgaattggaagtaattacatagcagcctggcacaatggcttacaactgtaatcctagctctttgggagactgagacaggaaaattgcttgaggccaggaatccaagacctgtctggaaaccctgagatagtgaaaccctgtctgtgcaaaaaatttagaagggaaattaggcggtcatggtggtacatgcctaaagtcctagctactcaagaggctgaggcaggatgacctgagcccaggagttcaagggtgcagtgagccagtgatcagctgtgtatcactgcactctagcctgggtgacagaacaagaccctgtcacacacaaaaaagtaatttgtaaaaatgctgcctttcctccccctacatttttccataggctcaatggttaacaattaatgtattcttgtagaattttctatgtacatatttaaagataatgtttcctaatgttttattttgaaatttccgaaacacgtagaaattttgaaagagaccaccctggccaacatggtgaaaccccatctctactaaaaatacaaaaagaatagccaggcagggtggcgcacacctgtactcccagctacctctcgggaggctgaggtaggagaatcacttgaacccgggaggcagaggttgcagtgagccaagatcgcaccactgcactccagcctgggtgacagagtgagactccgtctcaaaaaaaaaaaaaaaaaaaaatctgtgtgcatttatgttttatacatttatattttagggggtactgtaccttaaaaaccgatgtttataggggaaaaaattaggacataataggtaagtaaaaagaagaaagtgaagatcacttttaatctcactactttgaaatactgttaatttgttcatttgatgggggtgtgtgttttaaaactaaatatttactgtactattttataatctggtttttagcccttatatgagaatttttttatactaaatgaaatatatgtttgagtctaagtggtgaatgagaaatctgatcaaaaataaaactgctgatcatagacagcttctgaccctatgctttttatgtctcttctgcagattctcagagagagttcaacagcaggccaggtacaggatacgtacctgtggagttttggaaaaaaacaggtatgtgtctgactgcttgtaggtcatacatactcactaatttgtgggagcagagaacagataactgggtgaatggttggtaactgggtcctttggttgtataataacttgctcctcatagagctctaggctcctgcctctcctgctctggcttgtcctgcatgtctcctgatacctgtcttgttaatttgcaggtcaggagtttggaatagctccctccagtccctttcacactcttccactgggtcacgctgaggcaataagtacctgttgacatgtcctgtttctgggcttgcaacagagttcattttgcctgatctcttcactggtggctacagtatactgtgttcacactactgccacatttgtgcccaaattctgctctgggcacagctctgtaatccccctgtgctttctttcaccttctctgtgcctaccatagtgaagactgttcttggtaggcctcctcttttacaagaataaaggagggtggggactgcctattttgtaagttcaaggatgaacctcacatcactaatgtcagccttatccaaatattggcattctttcacttcttgcctccccatcccagtttcattttttaagtccaatacaacttttggttttcttactaagataaaatttatttctacaaaaatgtaatacctacattcataaagactcttttaagagcatctagacagtagtaaacaaataaaagatatgaacagacacattatgctatgagaaatacaaataaacatattgcaaaatatttttccttactagtagtcaggataatgtaagataaagcatatctgataaattaaccccttgtctttaaccgtccgttattgacaattttaaaagaccttgttgatgacactcaataattgatcagaggcttatataagaaattaagtgagtacctgcagattcttggaatcattcctcacttttccttttttttttttttgagatggagtttcgcgcttgttgcccaggctggagtgcaacggtgtgatctcggctcactgcaacttccgcctccccggttcaagctattctcctgcctcagcctcccaagtagctgggattacaggcatgcaccaccacgcctggctaattttgtatttgtagtagagatgaggtttctccatgttggtcaggctggtctcgaactcctgatctcaggtgatctgcctgccttggcctcccaaagtgctgggattacagacgtgagccactgcacccggccttttttttttttttttttttttttttgagatggattcttgctctgttgctcaggctggagtgcagtggcacaatctcagctcactgcaacctccacctcccaggttcaagcaactcttctgccttagccttccaagtacctgggattacaggcacccccgaccatgcccggctaatttttgtatttttagtagagatggggtttcaccatattggccaggctggtttcgaactcttgacttcaggtgatccacccgccttggcctcccaaagtgctaggattaggattacaggcatgagcctgtaatgtgcccagccacaagatctcttttaaactagtgagtttgattatttgggagatacctttggttaactatggttaagagcccaactttggtgttgggccagctaggtttgagtccttgctctgctacagtgccatctgtgaccttagacgacctccagtaagatagctagccaaaccgagatgattattaattcatgcttaagctgaggggataaaatgtacctaagagcattgttacactggctcaataagaggcatctgataagagacttatgaaaagttcttggcctctggggtgaagattttcttaaggccagagccataagatggaaagttgtttcatggtagcctagaactctgtgtttgaacctcccttgagcctgtgccatgtgcaagaggtaaaccgtgagggagtgtccttaggcttctggattgtctagtcctgtggacttacgtagggagctacgtattttgggacttcacattcacattctcattgggctgaggctcaaacatatggaatgtgttattttgcagcgtctacattagggaaatcaagcagggcattggtgatgggaggaagtgaacaggaaccaggtaggatgatggtaagtggacagggtttaaaaacccagggcttttggcagtctgcccaaatctatgtctttagcccttgtttgtgcacctagtcttatttatttaattgcctcctggccatttacacctggatgccccagaggcacctccaccttctcacttgcctccacactagctttgtgtggactgtccatttcattgcctagctttagcattcttctctttcacctccacttccaggcccttcggtgctcccaacctttttctgcctcatcccttcctcagtgccacttattcctgcctaaattcagcctcttctatcagttcaatcattgcaccagcctcccggttgctatctctgtctttaatcttccccttgcatagaatcctttatggagtttcctttgaaaataaagtcaagccgactgggcacggtggctcatgcctgtaatcccagcactttgggaggccaaggtgggcggatcacgaggtcaagagatcgagaccatcctggctaacatggtgaaaccctgtctctattaaaaatacaaaaaattagccaggtgtggtggcgggcacctgtagtcccagctactcaggaggctgaggcaggagaatggcgtgaacccgggaggcggagcttgcagtgagcagagattacgccactgcactccagcctgggcaacagagcgggactccgtcgcaaaaaaaaaaaaagaaaataagttcaagccgggggtggtgcctcacccctataacactttaacaccaacgctttgggaggctgaggtaggaggatcacttgagcgcaggagttcgagacaagccttagcaacatagtgagacatcgtctctacaaaaaaatttaaaaattagccgagtatggtgggacacgcctgtagtcctagctactcagaaggctgaggtgggaggatcatgattcagagaggtcaagtccgcagtgtgctgtgatcgcaacagtgcactccagcctgggcaacagagcaaggccctgtctcaaaaaaaaagaaaaagaaggtcaaatttcttagtctggcatgcaagactttttgcaaaatctcatttccatctaccatctcaagcaaaacacatgtcttgattctcccctgcccactgaagagctgatcacttttctccttggaactctagtctcttacgatgacatacacgatggcacctgaaacactttcatacttggtcacaagcagtcaggagagtgtggcctgtgtctagtcacttgcgtccacagccctagctcggtgcccacctccatctccgtacccagccagcacctgcatggatggacacatgagtgtgaagatcatgtgttcctccctgtggagttttagaaaagatcactttgtgtcagctctctccttacttagaattgccgtgggatgggagggaaaagatttctcggccagttgattttactgtcactttcttctagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggaggtcagagctctgcgccctgggggctggggtgagcagctggagtgaccacgcccgctgccttcctctcatacgctgggcaggaagacacaggcagtccactcttgagctcaatgaggataatttttatccagtgccaggagagttttggttctcatgctaagactcttttacatgccaagatagtgaattattacattgtatttttacatacatacatatatatatagagagagagagagaggctcagtgtattggtgtaaattttgagaattcaccctaaagacagagtttgtgtgattgcacgatgatgatgatgaccagcattgacggagtgggcttactgtgtgccagacacccagcaaagttgtatattttctttttgagtctcacaatggccctaatttgcagatgaggagactgtggctcagggaatgcaactaatatacccctttggtgctgaagtcaggatacaggagtaagaaagtgcagggtcctatagcacctaggctttttttttttgagacggagtctctctctgtcccccaggctggagtgcagtggtgcaatcttggctcactgcaagctccacctcctgggttcacgccattctcctgcctcagcctcccgagcagctgggactacaggtgcctgccaccacacccggctaattttttgtatttttagtagagacggggtttcaccgtgttagccaggatggtctcgatctcctgaccagcacctaggctttttacaaataggatagctggtttgtggactgaagtaacaggttgggtgtatctgcctgattgtccaggacccaggatccagggcccaggacttggtgatggttctatacaggacgcttgagtactacagtgaggagaaaaatcaacaaactgaaaaagaatctgtgacaacatgagaacagcccttttgaatttaatgcagtttttctgtaaatttcattttagtcatttttcagctttaaaacaagaaaccagtttctttctgtaagtaggtagatctcatctactggatgggagaccggctgtctttgggacattctcttgaagttcagcactcactctgtcaccgaggctggagtgcaatggtgcggtctcggctcaccgcaacctctacctccgggttcaagcgattctcccacctcagcctcccaagtagcttggagtacaggtgcacaccaccgtgcctggctaattttcatatttttaatagagatgggctttcgccatgttggccaggctaatcttgaactcctagcctcaagtgatccacccaaccttggcctcccaaagtgctgggattacagatgggctttttttttttttttaacaaacaatagaaatgttattttcttgtaatttaaatggtccatttcagtattgtactgtcacacatggcaatgtgcagatgaaaatgcctaaataccacgtggctatcacagaggatgtggtgaaattccttattacagctcttcaatacagatactatggattgtgagaaaatagtttctttaatccccctcccttttcgttctctcctcctcctttgtcttttttttttttgtgtgtgtgtgtgtgtgtgtgtgtgtgtgtgtgtgtgtgtgtgtgtggataacagggtctcactatattgcccaggcaggtcttgaactcctgggctcaagctatatatactcttgcttctgcctccctaagagctgggattacaggcatgagccaccacgcccagcttctcctcctcctttttctttagaattgtttttgaggctgggcacagtggccaatgcttgtaatctcagcactttgggaggccaaggtagtgtgaacacttgagctcaggagttcaagaccagccttggctagatggtgagaccccatttctgccaaaaaaaaaatttaaaaattagccaggcatggtgtcatgcacctgtagtccaggtactttggaggctggggcaggaggatcgcttgagcccaggaggtgcaagcctgaccatgatcgtaacactgcattccagcctgggtgggagagcaagaccccatctctttaaaaaaaaaaagaaaaaagaaaaaaggtgatgacgatggcaagatgagggggaaagaaaagagaattgtttttgagagtgagatatctgtttctcttctctatgtttaactgtgtatgtatagccatccatatcagtatctgtatttgtccttatttatctacttttatctctgtttatctttaactatgtctatctccaaagaaagagtatagcttttggcttagagcatagatcctggatctggactgcgtaggtttaaatcccagctctccattttgagcattgtgcttttaaggaattgtaattttaaataagccacaaagtagcctccaggtgaggtgcacacctggacctatccctgcaaaatcactttcaaaagcagggaagggatagagggcctgtcctttggatgagtttgcattggaccaaaacggctgattctcgtccatcaagaatgttcagctagaatatccttgttgaaatttggcaggtattcctggagtttcttgttcatcttgtgaaaggtggtctggtgtgggggaggaaggaggccaggactggaggttaggagccctgacttctagccgagttccctctcatactggcagtatacccttaaaggagtcagtctccatctctgttcaatgagtatagcagctcctatcctattggtctgatagttattagggaacaggcacagtggcccatgcctgtaattccagctctttaggaggtcaaggtgggagggtcctttgaggccaggaggtcaagaccagcctgggcaatataaggagactctgtctctacaagaaattaaagaatcagccaggcatggtggcacatgcctgtagtcccagctactcaggaggctaaggtgggagtgtgggaggatccctggagcctaggaggtcaagtccagcttgggcaacatagcaagaccctgtctccaaaagaaaaaacaaaacagcagcagcagccttcgttgagtcagattatcagtaaaaacaatgaagattattctctaatgagggaagcaatatcagctgggcgcttataatcctgacactttgggaggctgagacaggcagatcacttgagcccaggagttcaagcgtagcctggccaacatggcaaaacctcatctctactatatatatatatatatatatatatatatatatatatatatatatatatatatatatatatatagtatataatgtgtgtgtgtgtgtgtgtgtgtgtgtgtgtgtgtatataatgtataattacaaaaattagccaggcatggtggcacatgcagaaaggagtaggataaatgttcgtcttaacacatgtggtcttaggatagatggctcttgggggagaccctggcacagagtttggtttggtttctgactattaaaatgagccaaaagatgagtccatgccttaggcaggagagatggccacctgccctaggctggtgctgtgtaaggtattttcacacacacatctcatttcactgttcctgtcatcttgcagggaagtagttttcttgttttacagatgaaggaaactcagaaaggcagtgtgtatttctcatagttaaacagcagtagagggcggagttgaccacaggtgtatgtagttccaaagctggggttctctacatacagccccttgctttactgtgcagggaatgaatggcaagcctgcccctcaatcccagcaaccactaactgatgcctgtgtcttgcagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctgcctcaagctggaatgggaccgggaggaaaggtggtccctacactaggaggtgtcccctcaccctaattcccaaatccttgaggaagagggagagaggggcctcaactggttctagtcgtggcctgaagagcatccaagggcatgaagcagggggtgtctgcaccccatgtgcctggaactggcctctctggaaagccagctgcaccaactggtcagtgccctgtggggaccaggcccaaccaggctggctgctggagcccaccagtgggcctgcggtcaagggccaacaacagcttccagacactccccgttatttcttttaagtggtgtttcgttttgttttgtggggagggggcagggtctctgttgcccaggctggaatgcagtggcacgatcacagctcagtgcagcctccacctcccagactcaggcaatcctcccacctcagcctcctaagtaactggaactacaggcatgggctaccacgcctggctgattttttgtattttctatagagacagggtttcaccatgttgcccaggctggcctcaaactcccgggctcaagcgatctgcctgcctcgcccccgccaaagtcctgggactacaagcatgagccactgcacccggccaaattatcttgtaataaggaaaaatgaaccacagagaatctgaccatctgtcctgcctgaacagggtggtggacttgtggatatattttctagtaacatgtattttcttgtaaaattttaacacaaatgttaacaaacatacctggacttgtcaaatattcacttatgtccttatgacactgatgttaaatcacaggtaattttactgttgccttccaatttaatttatttgctaaatggttgcatcatttaattgaggccataattttttttaacccttcaccttctgttgggcaattggatcgctttcgcgttttccagtgtggcatacatcttctatgcatactctttcttcgcattatttatttccctaggataattttccaaagtgggggtttttgatactgaacatttcttggatccttgaaatctgtacaaactactctccctaaaagcccaacagcttgtgttgcctccagcagcccctgggtggtactttccgtggccctaaggctggtgcaggcacacctgtgtgtggaatttcaggctgccagtccggtttaccagctggtgagctgaggcctcacttctgtcactcagatacccatctgtgctctctccctgagacccgcctctcctgaacagccttgcccaagaggctcgttgggaccactagcttcacaatcccctagaatgcaaggggagagggactggttactagatctggagacgaggagaagggctagcctatggcgtaggggttggctgtatgatctttggtgcaggtggtgccaactgcaaacctttctgggctgcactgcaatctgcccacctagaacaatgacaagatctcagtcatgggactgtcagccctccacaagagcactatgttggtggaaacggaatgtgccatagaaatggcaggctgaaaatcttttcgtgaccacaaaacacccagatgccagataaattataatgaatgtacttttaactgtattgctgaggtcacagataggacatttccaagaactcaagagttggagggagattgcctctaggcgcaatgtgaggcttggttttgagcatatacaaagtacggaaacaaaaccggggcctttccacaatggcaggtagctcagcacctttggcaccgtgaaaaggcggcagggaaaatctgcccatctgcaatggaaactgaattggaaacagctctgtccctgcttgagaaaaagaaagaaaaactgggccgggcgtggcggctcacacctgtaatcccagcactttcggaggctgagatcacttgattccaggagtttgagaccaacctgggcaacatagtgagacgcccgtctcaaaaattaaaaacttagctgtacatgtcaggtatatactgaaggaaggtcagggaatcctggtgctgagaaattaagataattaaggaccttcagggtcaatattgtgtgtcaaccaattataagctgtccggaaacactactgaaccttcaagaaaatgagccattgttagcaaagtcaacaggaacaataattgatttaacccctgggacttcagatattacaatcaccagatacaggcagggcacagcagttcgcgcctgtaatcccagcactttgggaggccgaggagggcagatcatgaagtccggagtttgagaccagcctgagcaacatggtgaaaccgtctccactaaaaatacaaaaattagccgaatgtggtggcaggcgcctgtaatcccagctactcaggaggctgaggcaggagaatcgcttgaatctgggaagcagaggttgcagtgagccgagatcacgccactgcactccagcctgggcgacagagagactccatctcaaaaaaaaaaaaaaaaaaaaaaaaaaaaaagcacaccagatacagaatacaaaatatgaaacctctgaagatggcactgaaaaacaatgagcaaaaagagtctgaaaatgactaggcagatttgaaaatagaattctggaaatgacaatcattgaaataatgtgttattcaccaatagattacatcaacctgaaaaagaaaaaattagtggtgcgttacctttgtcagaaagagagcaaagaggccgggcgcagtggctcatgcctgtaatcccagcactttgggaggctgaggcaggtggatcacgaggtcaggagatcgagaccatcctggctaacatggtgaaaccccacctctactaaaaatacaaataattagcccggtgtggtggcaggagcctgtagtcccagctactcaggaaagtgaggcaggagaatcgcttgaacccaggaggcagaagttgcagtgggccgagatcatgccactgcactccagcactccagcctgggtaacagagcaagacctcatctcaaaaaaaaaaagaaaaaaaagagacaaataattgggaactgtgaaagatctgttcctctggaaggttaggaagggaaagccttttcatgtgttaccaagagcagcatccaagagcctgctaatgtgtttctcagcagaaagggcactgtcctgaggtggggataggatcttgggaagcaaacatgtctcttgcccgtctctgcttgtttctgactgctggtatttcagggtcagggtcacgattaggcatgtctccttcttagccttccttccaagaggcttgggggaaccagcgacagtccccactccactcctcaggtgggcttcattgcctgctgccaggagccctcttgtggacagagctggactttccccctgggttgccaccatccctaagccagattcctttccagagtacacaccagcagcttttccttccccttcgcatcagcattttctcaggctgcctttccaccccatgagttaatatttgctaggttcctcctagagttccagaagtgatcggggatcagtctccccaccttctgagggctggctcacccaggccctcgcactgggctcgtccttgctgccccgtctgccattttgcaggccccgaggcctggcattgttccttcttttggtgtagctgcctctacctcctccagctggggcgggtttctgctaccggagggtgtcctctcccagcgctgtttactcctgatggctagcagctgttggtgccagggagtggatccctcctgcgtgactcggagcaaggcacttattcactgagctttttcctccgtaagctggggatgctaacgatgcctatacctctggggtgttgcgagggtaaaatgcaatcaacaacatgggtatagcccctagcacagggcctggcacccaaggcacccctgtaaactggttgctgctataacctgtttctctccccaccaatctgtggtttctttgaggattgatctttgtgtccagcactctatgtggagcctggtgtcctgctgaagtagtatgtttcgagaataattttttgaagaccacctaattctcagtccctttcggctcataagagactgtgttaaggggacttgttaggagagctgtagggcattggccaccatctagactgttgctatctccagcctggcctggcactgagccaatccctgggacaggtttgaatatttacaggtgagtcacaggtgcaggtgtgaggaaggggagaggacaggtgcagggagtgggtggaagggtgggggcggcagctggccaatgagcccggagctctcctgacttcagggctctgcctgcccttgaccgagtgctgtcaccagcccagaacatttgatcatccccagcacctgccacaaagcaggtgcccagcgcaggattgggaaaggcgccccagcacaatggcactcacctgctccttacagtggaagcgtttctgtggcggacgggtggcttgggacaaaagccacagacagggtgactggggttgtaaatggcccagccttggctgccaggacatgaaattatgaccttgatgctgaaggcagtgggtgccattgaagggtcttggccagaggtgcgtttttcaaaatggcaacatttcgaaagccgcctctggctgtgtctttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcagaggcttgagggcttcctccaggtccccacagccccagcccagctcagacgtctgttctgtggctgcagctccagccatgtctgcgctcagctccacccccacccactccctgtctgggaccctcctgtctccctgtcacctgcaagacaacattccactcccatgcacccggcctcctcagctcgccccagccctcacactccaaggatcccttctgccctcgcacctgcccggagacctctgctctacttccacagctcaaaccaaacactgtcctaagaggccccctgaccctgctggacatccctgcctgcgtgccctcctctgcagctccagctttcaggagggaggacacagcctttcttattaaaaattgtaataaagaggtgtccaccttcagaactgcactgcagggcgaggcaggcagggtgcccagggcacaaaaactaaggagacgcccaccacagataagtcagcctgagggcttgggcatgtctaaagatggcagtgggctgggcacagtggctcatgcctgtaatcccggcactttgggaggccaaggtgtgcagatcacttggggacagcagttcaagaccagcctggccaacatggtgaaaccccatctctactaaaaatacaaaaaaaattagccaggtgtagttgtgtgtgcctgtaattccagctactggggaggctgaggcaggagaatcgcttgaattcaggaggcagagggtcagtgagccaagatcgcaccactgcactccaggctgggcgacagagcaactccgtctcaaaaaataacaataataaataaagatggcagagggaagtttttttagttttgaggatttgttgctacagtttttgtggaggacaaaagaagcctttacaacacaggacgtaaagcagggcgatgtcctcctcagctgtcttctctaacaagacacactgcccagcctgggcaacatggcgaaacccccatctctacaaaaattagctgggcgtggtagtgtgcgcctgtagtccttggctcactgcaacctccgcctcctgggctcaagcgattctcctgcctcagcctcccaagtagctggaattacaggcacacacaactacacccgaacaagcctcaagcctgctcagagccccatgtggttcagatggtggcagcactttctaggagctcccagagatctgggaagcggggtggcgggaggacggcctggcactggactggccagggtgccagcagggacctctgtgcaggtggcccagggagccaggctggtggaagaaactgtctcccacaggggctgccagggagaaaccgcagggaagaccctgcctggagtcccagatgggaatgcccaccctgaactggtgccatctgagttgccttgtagccaggcctcagcccagtaaggacctggcaacaccagggcgttcaggaacatggaaagggcactcaacccaccggccaccccctcaccccgaattaaagcctcccatggcctccttgggatgtagcacctcagaggcccagcctcacccagccctctccccctggcacccccagctcagccccgctactgggtcacccttggttcaaccaggcaagccctccttctcctcagagcccatgtgccgtctcctctgtctggaaaactgacgccaacactcccaggccaggtcaaatgccatcctgtgcttctgtggtgccaggggcctcctcttcagagcagctgcttagatgtccctcttggtcacctcccctccatgcccccagtaatggaggggggcaggaggacacccccaggggctagtaggactgactcagccattgtccaactggaaccactctatgtggggtggcagtgacaagtccagcttggtgaggacaggtcttcccacaggagcgatctgggcccagaggaggctctgtgtgggtgaagccagaacccctataaaacctgcagagacacgtcaccccctccctcaggcaggacccagcaccagggtgtgtcagggccagggaccctgaagtgggaaaacttgcgtcagctcttgtgagcatccactctgcgagcgtgagggcacaaggtgggaacccgggggcttcccaagagaggtgccctgcctggagcttctggcctgggaggcgcacaggccccacagcccagacctgcgagacaggaggcaacactggaagggaccactgcctttattgcctctgtgctggggtcccagcctggggttcagaggcctctgggggcaataggtgaccctggacccaaattattgctacttggccaggtcaccttggggcttcccatactgccctgagaatgggtgggatgagggcatgcaaacgatatgcaaatgacatgcaaaccaacccagaggcctctggcacatccatgggtgctggaagagtcagagcctagtggcctgggagggcgacggggcacccagctcaggcccagcctcggaggcaaggtttgagggttggggggtccctgagcatcagccctgcttctgccgctggctgaggaggagcagaagcctggtcccaagacagcaggaagaaagcaggaccctcgctaggcggccagatggcctgaggcccacccagacagggacgggacctgccctgggtcgctcagccaggcagggacagcagggaccagaatccaggtctcctgagccaggcagaagccaaagtagcttggaggctgaagtgacaaacaataaaatacagggataaataaatcaataataaatagaaagcaagcagcccagtccctgatccctgggctgagagcccttccaccaggcccaagtccaggaggagacaagtcctggtctttgcgctgggctggccagtccagaaggctccagagggaggcaggcagggtcccggggccctcggcgtgtgcaggtctggctcagttgttattcattatccaccaggaggctgggggtcagaggcagggggtcaggagccctcaggagcccactgcccctccagggccacagtgagtgggggtccaccgcatacctgggaagaacacagtggtgagggtgtccggggcccgcaggtggtcgatgaggatgcgctggaaggccttgctgccaggcgactgctggtgcctgcagagacccaggctacagtgacctcgctctccccactcccgccccatcctgctgccaggatcagaccccggcccttctcacactgcctctggagcctcagtcctctcccctgtgacacggggaagctgtgtgggtggaatgaagggcactgcacacggtgcttggcataggcattgtcacatacatggtgacaagtgtgtattcactgagtgcctcctgtgtccctgtgctgtattcagctcttcccagtcacctcctttagcccataggagttggaactgttatcacttccattttggaaaggactcgggggctcgggcaggtggggtcactcatctgaggtcacagagccagtgagcgggagagcagaattagaaccctggcctgactcactccagggccacattccatggtgttagcggccagactggcactcataccttctccaggaggcctcatcctgccagaactcatacagggtgaaggaggcaccgtccagcatcttctgggcggacacactgtagggccaaagagatgggcaggccaggccagggctgccaccacctctgcctccccggcctggggcctcatgggaaccctgacccacccaggatggccagccccagcacccctctctgctcaccccctccccactggccatcccacctgccagctggggactcactgcagacaatggctctgggcccctgtgaagtccacatagcagcgcagggctcggtggaagtcctgcaggccttcctctgccacctggacctgcctctgggccatgaggatgtgctggtgggagaggcagccggtcagctggtgcggggccgggcacaggggagggactggctgtggcctccaggaggttctcagctgtttttctgtttgtttgttttttaagacagggtcttgctctcacccaggctggagtgcagtggtgtgtgggatcacggcttactgcagcttctatctcccaggctcaagtaatcctcccaccttggcctcccaaggtgctggaattacaggcatgagccatcacacctggcccctagccttcttgactgatgccagatccaacctaccctttagctgggttcctgccgccaacctgccccccagcctccctgtctccatcctcttctccctgtctccaagggtgctgcttgatccagccactgttcctcctcctgcagtatgccaccacttccttccaccctccagcttccgtccacactgccccagacctggctttcggaaatgctgatggggaaccaaagcccagagaaaggtggtggttcctgcaggttctcagaacccggcacctgcttgccaggcctgggggcggggcacatgcgcactgcagagggttggtgggcaaccggccccatgaatccccaattcatgagcacccccagacacggccatccagccgcttgcccctctcctgggctcaccaagtcaggccccttggccaggtcctcttcacgcaggggttccagccggggggcctgtgagggcacagagtgtgggccgggcctccagcatgggcctggctctggtggataccaggagggtcctcccttgtggggccctggccccacggccctcaccttgcactcgagctggtcgatgagctcctggaggcggttcacctggagccgccactgcatctcggcctctgagctgcgccctgtgtgtggggcccgtgcagggtcaggcaggggcctctcaggtcccgcaggtgctcagaatgaagtgaggggcagtgaaggagcgggccctgggggaaggggggatgcggtgcctgcctcggccaggcctcccaccccaccccaggcgcacctgtgtcagaagagccgggggaccaggtggatgaccggctgacactcctcagggctcggcgtcctgcccgccggctgccgcagagcctgctctgcgcctccacgctctctgcatctgacctagaggaagtgaggctcacagggccgaggactggggccccaggacgggataagcctgggtggggaagacaagcctcctgggactccgaggcctagccccaaagccagtctcatttcaccccgccatggctaccctgccatggcttccccgcccgaaaatgcaggctccaggatgctgggactgtggggatttggaatgggggtacaatgggcgcttgtgcactagccccacaggttgacagcacccttacataccgccagccatgggcctgggcctccagggtatctgacgccccctccagcgagctctgaagggcttgcagctggctcaccgtctcccgcagcaggaagcgcgtcacaaactggtccactttggaggccctctcgtactcctgtgggccaaggagggacggtcagcatctcccagcccgggcactgatctcttgagtgggtcccctgcctcttgcccatcagagcagcggtggcagtgccaagagcaggggcacgcaaacctggcacaggcaggagggtactgagacctgatgggcagggagggtctggatccctccttgtccgggactggcctccctccccggaggtgtgaggccaactcacagggggcatctgcccagcgaagtgcctggcctctctggacctcatggccccttccctgatggggctaccaccttcagcactgtcatagccagtgagtcccagccacagctaggctgggtgggggctatcacgaggtatccaagggccaatgttgacacaaggcaaaataatggcgtggtgtggccccagactcacaatctacgtattcactcattcattcattcactcatacacacaacactgggtgctttttactaggagctgctgataaaagacaatcaggttgccattctcactcagacacacacgccggcactgaccccaaccgacactgccagcctcctcccagcccctctcagggtggcagagaggcagggaggctgcccaaatgctaggccctgcatggcccagcatgggattctgaggctcctcaacaaccgtcagttcctggagcttccatttcctcatctatcaaacaggaaagatgaaactcagcacatggagctgcaagaacgtcccaggagttaattcctgcataggactcagcccagggtctggcacgtaagctctcgatgccagacctaccagccatctatcgtcaagtgtaatacaataaagggcctgcccacttgtacacccaggagtcacagatgtcctgagaattgcctaacccctaccacacacacacacacgcatcagggtgggagtcctggggagctgcagtccaggtgcctgccctctccgaggagactccagaagccccatccatcagagacttcatctcctgccatgacctgcctcagctcagccatcggatgggacctcctgggccaggcttatgagctaggagacagggacagagaagaggctgggtcttttcattctcagacaggccagggtttctatctccatgaaatcttcccaaaaaattcctttttgggtatttgagatgattagtttctgttgctttcaaccagagaacagacagaagcacccactcagagccaagcactactgcaagaagaatttcatttagtcttttgtttttctgagacagagtctcactgtatcacccaggctggagtgaagcggcatgatcttggctcaccgcaacctctgcctcccagcttcaagcaattctcctgcctcagcctcttgaatagctaggtttacaggcctgtgccaccacacctggctaatgtttgtatttttagtagagacggggtttcactatgttgcccaggctggactcgaactcctgacctcaggtgatccacccgcctcggcctcccaaagtactgagactacaggcattagccaccatgccaggcctcatttaacctttgtaacaatttacaggaaccataattgaccccattttgcagatgagaaaacaggtccagagaggttgattacctgggctaaggtcacatagcaagttagtagcagggccaaaattcatacccaaaccacagaaatccccctctattcaccactaagcaccttacatgcattgcctcatttatgatcattagcccagttttacagctgagaaaccaaggctagaagtgactgagtggagcccagattcacctgtgggccctggaaggcggtgctcagagcctgcaattggtgaggtcagcccgtgaggtcacaatgttgccagggcccagggggcagagcagacggagtgtgggccatcgtccccagtggtgaccagccctgccatgggaaactatagttcccacaaaaggaccaaagcacccaagcaggcccgcaaggagaggccggctgacatggacaaggcctggtggaaatcgttcctcaaccacctcactcggaagaagccggctgtgagggcgggggatggggagcagggctggggaggcagctggggggcagagaaagctggacaagtgggtgggaagggatgctgggagtctaggccttgtatgcagaagtcctagggggtgagggaggaattcgaaaatctctcccaaggatgaggatcccaggagcccatatgggtgtggatgggggtcctttcaaggtggctcacgcctgtaatcccaacacgttggtaggccaaggtgggtggataacttcagcccaggagtttgagattggcctgggcaacatagggaggccccatctctacaaaaattaaaacttagctggttgtggtggtgaatgcccgcagtcccagctactcagaagactgaggtggactacgtgagcccaggaggtcagggatgcagtgagccgttgacagcaccactgctccagcctgtaggacacagcaagaccctgtttgactcagtcttaaacaaaaaaagcccagaagggagggcagagattccagaaccagaaagtggatgagacttgagagccccggggggtgagcatgagtgggattctctcccaaccctggacgaacgggtggagatcccaacacggagaatcagttctagttggtactactggagctagaggcagggggaattccctagtgtcctctcttcagctcctaggctcagaacttccctgtctccctctcaaatgagcagaagccctggaccaggcgggggtgggaggtgctgaaagcccctgacatagggcctggaagggatctcataaacttagacggagctggtctcaggaagtcagcctgggatggatgagggtttccagaaaggaggcggagtccggggcgccacgcagggaagggcgggcttccccgcggcctgaattggacaggggtcccctccagccctgtgcacgagaggatgacaggacccgggtggacgacaggacccgggtggacgagggtcccaggagaagcgcggagcggccccgggtcgtgggctcggccctagcgcgctctcccgcctcacgcccctgttccacccccagaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaaccctggcgcctgcgaaccctgtcggaggcgtctgggcgcggagtcggggtgggcaaagctcagcctaggagccgcagaggggtgaacggggcgtgatgaaggcagagccatcgccacggtctggagccagggctgtcttttgctttctccttccttgtgccaagggtcagaacagaaccccaaaccttgctacagtggcgggaggcagtttccttcccccaacactccaaatccaggtcacatcctgcccagtctgcaggctcaagggaggtgggcttgggcaaacccaggcttggccacgctagtgagagggacctgcttccggtaaagcctgacatccccccagcatccagaaatccctcttaggcatgagggagggttcccggccaacaggcaccatcctgggtaagaacagccaggatggcagtcagctggggcaaggcctgagacgtggattctgcctggggacgcacccaggagaagctggaagccctgggcctctctctggcccctcactcctacacattgtgcttggtaaccccaaagcattcaggccccccagtcttccccaaggcacctgtctcccaacctaccctgtcccatctccttccccacgtgacaaagactaattccaaaccacttacctgtctagggcagctcactcccctgctcataagctttcaacaggtctccattaccaacagggaaaaagcccacagcttcagtctcactccccaaatcacttagaagaagccctgccacactttctgtgggcgggatcctgctgctgcttctcctcactctcccgggtcccaaatccagctccacacccaatgccacccctggcctgccaaacctgcagcccgccttcctgccacactctggtgaccaacctcaggatgccctcttttgggggcagatgcagcaggactgaagtcccagctcactacagccatcagcccagcttctgctgaagatgcacttttgtcaccgccaccaggatgaacatctcctccaccttgcctgcaccaggctggaggctgcaagagctataacatcactcctgctaattgtgagaactgactcttccctaccatccacatggttacaatcagggtaaccatgttcttccatggggctgcacctcctgcccatacagtgattggcccaagctggtcctgtcagcccctccccctaggactgtgattcaggagctgtaagagaccatgttctctacttgaacatgcacaggctaagccagccttcagaataaaaacacaatgcaggccaagcgcagtggatcacgcctgtaaacccagcactttgggaggctgaggcaggcagatcacgaggtcaggagatcgagaccatcctggctaacacggtgaaaccccgtctctactaaaaatacaaaaaactagccaggcatcatggcgggcgcctgtagtcccagctactcgggagactaaggcaggggaattgaacccaggaggcagaggttgcagtgagctgagatcacaccactgcactccagcctgggcaagagagcgagactccatctcaaaaaacaaacaacacaatgcagtgcacatcctgggttccccacagccccgcagtcagattctgttcctgaaacctgatttcacccttgctcttgatatccataacatgtaagatcctttcaataaagtccttattttgggttacattcacctgagtcttctacctgcaaccaaactggtcctcaggaggatgaggctttgcagagacaagaagtgacctctttcctgtgtggggggattattactaccttttggaggagaaaaccgaacccagagaaagatcaagacttgcttaggactgcacagtgagtcagcttcagaactgagtcttgctgggtgcggtggctcacacctgtaatcctagcactttgggagtccaaggcaggtggatcacctgaggtcaggagttcgagaccagcctggccaacgtggcgaaaccctgtctccactaaaaatacaaaaattagccgcgtatggtggtgcatgcctgtagtcccagctactcaggaggctgaggcaggagaatcacttgaactcggaaggcagaggttgcactgagctgagattgcaacgctgcacgcccagcctgggtgaccgagactccgtctcaaaaataataataataaaaaaaagaactgagtctcaaactgaggcccacgtgaatccatccgtggaagcccataaaggtagggccagagcctctcgggggctcttcagggaagctgcagatctgtgatgaaaaagctttttcttcagcactgggaggggtagggggccacacatctggacagagtacatcagataattctaagtggtttgggaaaggaatcagactgtgctgggctgctgaagccagacccctggatgccaaaatcactgcccttggctctgtccagaagagaggatgggtccagggagttgtcataaggtagggagctgcgaagtgcagctgctggggagtgaggtcacaatgagcccaatccaagttcttttctgccttctgaccagcccctcccctctccacaaccaggaacttccgtcaagcccaggtgagaggtgccaggaggctgcctgggtcctcaagggggatatatgtccaaatggccttaccacaaggccccttcgccctcaaagttctgctcctcccgggggcttcttaggatctaaaaggatcagtcctagccatctcgtcagccatctcagcaagggctgacggggcggaacagcaaagcagaggcgggtcctgagagcgtggagcctgaagcccggcgccagagggagaccaagagggtgagatgcggctggaacccagccagagcggagactgaagcctgaactaggggccgggcctcaggcctaggaactagccacgagctgaaaaggaggcggatggcccggacagaagaggcggggctttcagaccagagggcggagccaagagctgaaaagggtggtgatttggtccagaagaggaagaacttaggctccggaggcagagccaaaggctgaaggggactactccctaggacagaggccgggaggtatcgggccgacgaagccgagtggcgcggaggagcggagccttcagccccgcggctgggccgagcccgaaggtggcgtcggtgtcggggagccgccgcgtgcaccggccgtcctccctgggccgcatcgcggtggtggtggaccagggctcgggcttcaccaaggcgggcttcgcgggcgagaaccagccgcgcatagtgctgaagagctctagcttggtgcccagctgggaccggccggtgctgcccggagcgccgggctgcgagctggcgggcggcgtggcgcgggcgcaccccatcaagcacggcgtggtggcggactgggaggcgctggaagggctgtgggagcgcctgctggtgggcggcctgcgggtgtgcccagagcagtggcccgtgctggtgagcgactcgccgttggcgccgcccgcgggccgcgaaagggtggcggagctgctgttcgagaccctggcagtgcccgcgtgccacatggctagcaccgcgttgctggcgctctgctccaccggcgcgttcagcgggctggccgtggaggcgggcgcgggcgtgtgccacgccacgcccatctacgcgggtcactcgtggcaccaggccaccttccgactgaacgtggcaggcagcaccctgtcgcgctacctgcgggatctgctggtggcggcgaaccctgacctcttgcagcaggccctgccccgcaaggccatcacacatctcaagaagcgcagctgctacgtgtccctggacttcgagggcgacctccgcgaccccgcccgccaccatccggccagtttcagcgtgggtaacgggtgctgcgtctgcctcagcagtgagcgcttccgctgccccgaacccatcttccagccgggcctgctgggccaggctgagcaggggctgcccgcgctggccttccgggcgctgcagaagatgcccaaaacgctgcggacacgcctggcagacaccgtggtgctagccggcggctccacactgtttcctggcttcgccgagcgcctggacaaggagctggaggcgcagtgccggcggcacggctacgcggccctgcggccccacctggtggccaagcatgggcgtggcatggctgtgtggaccggcggctccatggtggcctccctgcactccttccagcgccgctggataactcgggccatgtaccaggagtgtggctccaggctgctgtacgatgtgttcaactgagtcaggctggactggggggggtggcactgcgttgggggacagctctctatctaaagagtcaagtgtttggagctggcagggtcctcctggaggttggagctgactggatgggtcacccccataccctttctgggccaggagaaggtatttgggacccatgggaccctcattttgaactgcagtttgaatctccccaaccactgccagttcagagaatgccagtccagctgcctacccacagggccctactttatggcaataaaggtgatgccccacttgtgtccatgccacagatatgggagttcctccaaaccctcgtcatgtaccatttggacatacatccgatgccaggccccaaggggcgatcccttgaaaagctactaaatctcatgtgaaagtcaccaggaggaggagccctgtgcctagccatgtgctcaggtcattgttgactatgagtgcctcagtttccccttctgtaaaaagtggggtcaggcacaatcccgggcctgctcactgctccctcccccttacaagagctatggagcaaagggaggtggagatatttcttgaacacacaaagggaagggcagcttattttttggaagtcaccactcaagggcctcaagccctggctatcagcactgttcgagcttgtgtatacacgtgtccacacaaacgcgtgggtgttcacgtacctgcctactcacgtatgtcctcgggccaggccctgccctgtgaacctgtgagcacagccttccacgcctagcccagccctgaatgatatcccaccacagttgtgatgggccagcaactaaagcaacagcagcccctagtatgaagcacccagtgtatgccagacattattctgggtgctggaaacagaataaaacagacaaaaatccctgccttcgttctcactggtcacagtgatgtatgaagggcagctctattgttatgatggtttacagatgaggaaacaggcccagagaggtcaaggggcacagctacaaagtgggagccaggatttgaacccaagcccctagctctataaccctgagtcaagactgtggaggatcccacagcacagcagatgcccactgcctcacagtggatcccccaccatcagccactccactcaccagcttggtggcatccatggcagcgagcactgcacggttcagcgattccaatgcagccagcaccggccggtagacacccaggtgctctgagaagtagtctgcaggcagaagaggtgctcaagggttcctggacccccacccatctacccaccctgggattctggccccctggaattcctcagcagccaagcaggccttatatcctgagcccagcccaacctgtcccatcaggagaccagcaacagtcccttgccacacgtaccctggggcccaggggccacaggagaaaagagctcccatgggcctactcaccacacagtttttctgtttctaaattgctgcagggaaaagagaaggcgcccttcagacctgggcctggtaaactgggactaatggggccaatgccccacatcccaccccaccaactcccagcttagcctaacaaggccacttctgctccaccccagattaagttgctcctgtggacagagtccttgcagggttggagaatgggttctactgcccccaccaatcactctaagggcaaagattcagacccattcttggctaccaagaggatctcaggccaggggaagatggatgtggacacaggccagtgagaagtggtcagagctgcgaaggggaagccaggtgcaaggcaatgaagtccagggacggcatggggtatttagttgtaggttagggagggtttcctagaggaagagctgcctaagtgaggccctgaaggacaaggaactgggtggggagtctggccaggaggggaggggaagcactgcagatgaaggttccagcccaagtctcaggagcctgagactgaccctcaggaaaggggagaagggaagtagagggagtaacagcggttcatgcgtgtgcacccctgggagcaggcacgggaaggagcgtgcacactcctgccaagacgcgtagatgtgggagcacacaaggggtagatggttgcgtgtttatgcactgcattctcgggtggaagcaggcggggcccagctgtccccaggcatcctctggtccctgtgggaagcgggaatggggagctgagccatgggtggtgactcagacttggctattttggggtcccagctggaagcagtgtagtgggcaaggctgtagctggagagggggtaggcaggcgggtaaagttggaactgagccctggtacctttctccctgccccctcttcctcatcctacaaaaggaaccaaggcagcaggggacacagtggggtaaagacaacctggcctcgcatctacccacggccccctctcatactcactcggtgagatgcccatcaatgccgctgaacagttcctgcagctcccccaggctgagaaccccatcggcaaagtaattctggaattcctcaaatgagagcttcccatcatctggggtggcagggggaggacagggagcagaggaggtatccctgaccctgactgcacccctgccaccaggtccagggtcccaaaggcctcatagcatctgacaaccatctagctaggtgagatgggagtctgaggtcagtggggggcctgactgttggggacaaaaggactggggtccttgaaggtgtccagtgaaggcaacagaacctactttgcaggcaccaaagggacagggcagtatgtacatagcgttgggtaggaactcagtaaatgtttgccaagtgaaaaaacaagcaacaggctgggacacggccacattgtggcagggcctagatgtcacctggaaggacttggggaccagcctcactgcagggcacaaggaacctccattctctggacccaggaccttcacagagaagccacggggaggcagatggaatcctcctactagttggagcctctgtaggcagcagcaggctggctcagaagggaatgagctccccatcacaggggcatgtaagcagaggctgggagtacttatgtgggacaaagacatgggatttggcctgaatgatgtgtgaggtctctgagcagatgggtgcggggagctgacccgggggaggatctgaacctccccagacagaactccctggtccaagtgagagcatgtgtcctgatcaatgggttgggacaaacaatccccatcaatttgaagagacccaaggagaaggggcaaagagtggggacaggaccccgtctctaggaggatgaaacacaagagggcgtgaagacccagatgaaaggagccccaggctgactgcgaagctcagaccctccacgggccacacagggcacagtgggctgctccaagtcatctagggggagcagcctgttgctggatgggtcccctagggctcctgctttagcttccaagtttctcccagaccagggtctgagactgcccaggacccaaggcaggaggagccgactcctttggcactggacccagctttatccttgcccaaggcgtgggtttagttgtgtcctccaagacctccctggtccagatggttggtcacatgacaagttactgagccctctaaaaacctgagtaaaatctccaaaaaggcctcatctccattacctcactcttccaagtgcctcacacaaggagcctgggattaaatgctgcaaagacccaagttcgagcctatcaattaaaggctgtgtgaccttaggcaacttgcttcacctctctggccctctgctcctttatgaaatagggtgaattccaatctagctggtggttgtgaggacaacagagggccacgtacaggaagtgcccatcaccatgccagggtgctgtgtgaaagtcagcccctatctccagtccgtggccaaaccacattctctccactctccatcctgccaaacttggctgagaacagcacttcctctgggaagtgccttgattgattctcctgttttgggcccccaagatttgtctcaactcttgacttcccacccaacctcccaactctccctgggcctcctggatgcctcccaccctgccccactgtgggacccaggggaagccacactcaccattcttgtctgctctgcggaaaacctagaggacaaagggacatagagagaactgtgagtgccacctgggaagccagaggcccccactcaacccgacagggtcccagctggccgacctaccccctgcctcgcctttcctcccgcccagcctggtcccaaaccacctgcccagctcagccctgcaggagcttttcctgcaagcggggcacaggaagagcacgcagcgggtgccacctctgctcacttctcctgcagggcctggcctcgtggggggtgctcctggccagtcccctgcgtccccacctcccacacccagagtgcagcccaagttctatctgatacatcagcccctggcacagttccagcttgaggaaggttgaggagatgggccaggttgtggcccaggaatcttgcacagccgtcctagacctgagccccgagctctgctgtgtggccatggtctaccccagctgccctctctgagctgtttccttgcgtgctgttgaaaaccaacagcaggcagtggctactctgtctctgcaggcgcctgagttacccactagcaaatagatcaggagcagctggggttaactctttcagggctggggcttcctatggggctgactctgaggaccttcggcaggcgtgtgtgtacacacacacgtccaagggggagtgggggtggcagaaggcaagttcggcagatttcatttatggagaagtggagatgaagagcaacagaggcagagaggagcagagtcaagacaggtccccgtctctcttagtgacctgctcccaggtcacccaaagcagcccagcaaaggggagactggcaggcctggcaagcaggggtgggccaagcctgggccgagagcccccatgaactccaggtcctgaacgccagccccctccagggtcctgttttgtcagggtcagtggggctcaggaaagactctaacctctagcctaactcagagaaggtctgccactggctgaggggcacgcagcaagccagggaggcccaggtagggtagatggagatcttgggagtgggcaggggtgctaagctgggaatggggacatctggggtcaccctattgtatccctgcctccatgactgacctgagacatatcccctcaggccttggttttcctacttgggaagaaggagggtcaggtcccttccagccagggctgtggtcaaggtgctgagtcactaggggcagtggggagggggtgggagacagctttgcctccctctggagttggggcatgagggggccaggacagagccgagcacagcggtgaacggtggagaaagggctcagggccgtggctggtgcccatggtggccgcagggccacccatggccccatgggagggtgactctgagcagcccttaccaactgtaggactctgctgccctggagtggggcctgaagaactctgggggcggcactagagtcaggagtgaggggcccttgcgtttccaggctccccttccccagtcagcccagcctggagctgccacagagtggggtgaccgctgctgtgattgtcgccagccccccgccaacaccagacacacaaatggggtgggctgaggggtgggaggcagcaggggcagtgacactggagcagggacaagaggagacatggagagacagaacaggtcacacaagggcagaaaggtcaagagaaaacagcagggccagagagaggggaagagacccagaaacagcggcggggcccgaacaaccccggagggtgagactaacagagactcgggtagggagacaccgcgagcagagcccgcgcccactcacgtcctggaagagcgtgtgtccggcgggccccgggtcgggcgcgagctgggggtgccgcggggtctggggctggggctggggcgcgggcggccggagcaggcacacggtgagcagccccgcgcacgccatggcgccgccacccgctcgggctcggctgcggttgctgccgaccctggacgccgcggcggactcggtgtggctagaggccgccccttggcgccggcgccgacgcgcgggctcaggccccgcccccgccccgcccccgcggacgccgggttccctcgcctcaaggtccaactccagcgccgcgggcctccgcgcttccgcggccacggcggagggggaggcgcccgagggctccggtcccgcgacggcctgtcgggagcagaacctaggggctgcgggcctacccagagggacaggatgaccaagccagtgccgaggtcagggtgacacaagtgggtaaaacccaccaggacttcaccttttggggcgtctgtatcctcatctacaaaaatggtactggcagacaccctatgcaattgttgggactcattcaatgtcaagtgcttacaacgggggctggcgcagaggaagcccacaggtccgtgcggccgaatcccaggcatcccgacgcccgccctctctggcactaagcgcagccctttcccctcccctccgtgactctggccctcccttcaacccgttctccacacagcagccggggggagcttttaagatgcgaaagaggaggtgtcacttcggtctccagtgactccttggcccctgaataaagcttaagactgaacgccccactccaggagcaccactctgaccctcacctcaggaccgcagccacactgctttctctccggtcctctatcccgctccctcctgcccaaggcctttgcccatcgtgtcctctgcttggtgttttcttcctctggttaactcctacttattttacagcgctcagcttaagcaccacccattccagaacgcctttcccgattttctcatttatgcagatctcctctttcagaccctgagagcaccatgaaaggaggtaacacccgtgtccccagaactgttaaatacctgacacagaaccagcccactgtatttgttacatgtttactaatgtccagaaacgtctggaaggaagacagcaaactgagcagagtggcctctggggctggggaaaggagaggccactcattactctgcacttcgggcagcactgaatagcattcttggctttctacaacaaaaacctttactggatctgcttttgagttaggaccaaaacagcgaggaagctgacctttcttcgagttatgaggctcaaatcaaatcgggcacggacagggagaagggaagtggagaatgggcatttccccagcaaccttggcctctcccgccccgaaatgttcccaacagagtcccaaaacccggcccaaacgtcatcaaaatatttattaaaaccaaagcaggagggaacagagctgttaggaagcaaatcaaagtgcagattggagggtggggcagagcagtggggaggcaggcgcttcagacactgcaggagggaccacagggtctgggctgggggaggccttcaccacccctcctgcccacatcagtgaaggtcccccactcacctctcccatctcatatccatcctggggggcagctggggccctgaactggccccctggagagggcccaccccaccatctgaccacccatggctgtcagtcagtctgtctccctccctcactttcccaataaataaatcacccaggcctcagttccttcagtatggggcagaagaacagctcagggacccctgcccttgctcaagggtagagggagttggggtatcaaccccacacccctcctcccctttgctgattccccaggctcaccaaagaggcctcgataaataaataacgctccattaaagcttcaatcagaaaaaacctttaagacagaagtgctctcaccgtcctacacgcccagccagccaaagcctccccacctggcctggtcagagcaccagattctgggagcaggcactgccctgggccttgtgggacccccagagcaaaagggccgaaagtgcagttagagcccccccacgcgcacacatggactcatgcacacacatgtggacacactggggcgtgtctgcagtgcacacacagaggtgtatgttcaccttcattccccggtacatgcacacacacatgctcacacacattcacccccggtacacacgtgtgggtgtaggctgcatgcacatacacaccacacagactccttcccttcctggcttgctcagcctcctagcggtagccagaccccagagctagaagcttctggagacagaggagaggggtataaattaaatgtttccaaacaggctgggaggacggccagggacagggggctccagggctgcagagacaaggtgagcatctctggaaaccctggtccctccaagccctgtcagaaatccaggggggtgaggtccccaaagtcacagtcgaagaggtctctgatgccctcgccctcctcgaggccgaagtggtagtcgagggcctcgtggggtggggaaaggctgatgaactcctcagggaggaggccggagaagtcctcccgcacatgctccaggagcgagtcggccgccaccagcggggacaggcggtcctcgtccacgggagcccgcaggctgcccatccgggacaacagcggttctggggagacggggagcatcacaggccggggatgccccagcagggaggaaggcaggggctgtcgtgcctgcccaccccccagaagaggggccctgccccaccccacccacctacccatcacccaccttgctccaggctgagtagagactggctgggatctgtggtgagggatgaggggggagatgatggtggtggtgacactatggtggcagagtcagtggccctgttctcctcctcagaagtgacctcctgggatggggtcttcccagggctgatcccacctacggtctcctcagggcacaggaaaacatcgatcgggccttgtttgctcttaagggagatctgaaagttctgggtggaagcagcaggcagggtaaactgaggcccaggtgaccaccagcccagcccagcccagcccagttgggcccggagttcccagatctcacctccgaagagtccacggcttggagctgggtctcaggaggggctttgatcaccataaccatctgctctgcagggtctgcaatgctacgaaggtcctgacacgtcacgtaggccagggttggcagagtcaaggaccacatgacctttgacttctagggggtcactcactccaacagctcacaaggcagggctcacacctgcctagtcactcctgtcctcccaacctcctacccactcaaaacctacctcacgcctgagtttcaagttccacatctgtataatgaaatcactctacccattgaatcccaaggtaataatggctaccgggaacgattccatgtaaaatgttcaacacaactccaggcctggtgctgggaatttattttttagaggcagggtctcgctatgtcacccaggctggagtgatgtggctcaaccagagctcactgcagcctcaaactcctgggctcaagtgatcctcccacctcagcctcttgaagcactaggattacaggcatgaaccaccgcacctagccacttttcttttttaatctgtacaatttcagaattggatattattattccccttttatagataaaactgaggccaagaggttaagcaatttatccagtgtcacaacagtgagaaaatgctgagccaggacttgcaaccaaaatcagagctctctcttaaatccaagcctctctagtcccacttgggtggagcccctgcctgctaagcctgccttccacaccctacggccaatccaaggatatcgctggctgtcagtgtcctcggagagcaggcgcagctgcgtagtacagatattcatcaggtggtccagctgctgctcgctctcctgcagctgtcggaggtcctgggtcaacccctcaagccgtccgccgacgcccactgtggtgtggctgcccctgtggggaggcaccagggagggtagggttaacagcgattggcccctctggccaggagccctgggcctcaggacagagtctgctgttgcctctgttctgtgaggcctaggcaagcccttgcttctgtctgggtctggctcctcagctgggctccaaatcagagtgtcatgggcttgaagtctggcccgaatataaacacctacatgtccctcaaccagggcgggataaacaaatgatgggactgacatgccacgaaatattacacatgcacacacacatgcatttccaagacatgctgtcaaatgaaaaaaaaaaaaaggctgggcttggtggcttatacctataatcccagcactttggggggctgaggccagaggattgcttgagcctcaggagtttgagaccagcctgggcaacacagtgagactctgcctctacacaaaatcaaagacattagccagacatggtggcatgtacttgtagtcctagctacaggtacggagcttgagcccaggaggttgaggctgcagtgagctgtatttgtgcctccatactccagcctgggcgacagagcaacaccctgtctcaaaccacccccctccacccaaaaaaccacaaaagatgcagaatggaacgatctaccaaaaaatgaaacggcaggtgtatcaaagaaagggtagtagcatgatgactggcgcgaaggcgagagggggaaaataaaacaagaataaaatatctatgccagacagatctcaccgagggcatgagaagccaggatagtggtgacctggcggtgtgaggggttggcaatgactggaaaggggcacaagagaaccttctagggtgttgaaaatgctcttatcttgatctgaatggtggcaacccagatgaataaatatataaagctgcgcggggcgcagtggctcatgcctgtaatcccagcactttgggaggctgaggcaggcagatcacctgagatcaggagttcgagaccagactggccaacatggtgaaaccccatttctactacaaatacaaaaagtagctgggcatggtggcaggcgcctgtatccccagctattcaggaggctgaggcaggagaagcacctgaacctgggaggtagaggttacagtgagctgagattacaccactgcactccagcctgggtgacagagtgaaactccatctaaaaaagaaaaaagtaaagctgcaactgaggtggatatgtaagatttgtgtgctttttaccatctatcatctcagggaagctacctctcctctctgagcccgtttccccagctataagatggggatgcaggcagccacagtgggtattactaccagctcctccaggctggcatgggcaggtgtgcctgccctcctgtgtggccggtacctacagccactggatgtggttcttggacttcttggcaatgagctggatgccctcaaggacgttggtgatgtcatagatgcgccgcttctgcaccttcagcacctcggcagcccagttcaggtcgacgacaccgtcagccgagtggctcagcagctccaggaagcgcttggtggtcagattcagtgaggtctcatagcgtgacttctcccccggggatttcacacctgtgggggtgtggtcaggcaagacagggcccttcagcatccacccccacctccagccaggcctgccactctggcagtgcagggcagcaggatgatgggggctgggggacagccagctccttccccttggcgaggccaaccacagcattcttcttctggctggggaactcctcacccctcagggcctggagaaaccaagccaggtggccactccaactgcccatcagggtcctcagaggcctggctcaagcccgacaagccagacgttagcttgcaagcatgtttgtctgttcacatccctaacctgggcctggtcacagggggtctgcccagcccaagctccataggtaccttttcctggatggcggcctctgccccgagctggcccactgctctcggccaggtactgatggtcagtttccaggtccagcctccgcttcacctgtggcgaaaacgggaggatgcccagtaaccaggagtgaggccagaagagacctggcttaaggctgggtgcctctgggctaccctcgcctcagtttctctagcaggatgcctgagtgtgtgactgagggagatcagaggggacatagcctgagagtcacagtcctaccacacaggacattccattttcaccacttctctggggtctagcggtggatttaaaacacatccgcaaactttctgatccttctccttcaaaagatatagcctaattctccccttatgagccagacctggtaacttgcttctggggatgaatgaatggaatgtggtggaagggatggcctgtcacttttgagactgggtcagaggcgctggagcttcctccttgctctgtattgggtcacttactctgccatatcatatgggcactcaagtagccctaatgatgggcaagaaaccatggcctcctcccaacagcaacacttagtcacaacttctgttagcagccagaacccaaacactggctgaatctccagagaccccaagccagagctggataagtcttccctgaattcctgacccacaaaaactatataataaatgtttgttgttttaaggcactatttttttttcttttttagacagggtatcgctctgttgactatgctggagtgcagtggtatgatcacaactctctgcagcctagacttcctgggctcaagcaatcctcccacctcagccttccaaacagctgggaccacaggcgcatccctccaagaccagctaacttttctatttctcgtagagatggggtctccctatgttgcccagactggtctcaaactcctaggctcaagcaattctcccatctcagccttcactgtagtcgtgctgggactagtcagccaccatgcccagctaagccactgattacataggtcccttggctaaatcaccttctctctggtttttgactaatctatacgcatggtagcagctggtgctcatcaagttccttgcatccattagttcattccattcaacggactggctgtataaaaatggccccattttccagataaggcaactaaagcccagggaggcccaggaagtggtagagtcaggatttgtacccaagacggtctgaggaagaacccaagctctaagcactctggcttagttcagacactccaggattgggactgtcctggaggtctcacaggctgctcaaaagtacccggaccaaaaccagactgatcttcccctccaccatccacagggtttcctgagctagagttcctgacctgtcaccctcctcacatgcagctaccaagaactgctcatcaccacggcgatcaccaccttcccagtgggctgctgagcagactccacactggtctccctgcctctgctgcagccagtcctcctacaaaccttaccatgccgccgcccctgcttaaggccttcctccagctccccattgcctttgtactctcatctgccactgcttctctagaggaacccgagtcacgttttcccagaaatctagactgcccttgcatccctcccaccctccccacttcacgcctgctccctctacctctgtgggcagaaaccttacgcatcagctaggaggtgtcacctcttctccctctgaactgcctcaaacccaaccttttgccacattctgtctctccctacacatttctgcagatgtatctatctcaccctcagaggtgtctgaatcacttgagaatctatagtgtctgccatggagcctggcatcaacaaatgtttgctgaatgaaccccccccatgctgatgaaccactccctcttgtgcacattcactgacttttgaaggcacccaggggaaagaagagctgttgtgctctaagcactgtgtactcaactgcttcccctgcaaccctccggccaccttttggcaggtgctatgatggcctccacctgagagaggccacacagtgagaggtggacccaggacttgcaccctagttggctggtacagagcccacactcatacccgccacgtgccccacctccccagaacccagccagaatgtatccccctccatactcgcccctggggcccaaaccctagcatgcttctgccatctgcaccccttgccttctccctgggatccccacccttgtccacccctgaaggcaggtcagtgccacgccctaaaacaaaggcttgagtggatgccatttctgccacttctccctagataaacactggcagaggggccccgaaacgcaggggtgaagacattcactgctgaaaaaatctggatgactcgaacacccatccatgaagggggtcacgaaagctgtgctttgtttagccccttgaacaccacgcagctgtcaaggaccgaggcaggttgacaagaatcccctcacacatacagacaagcaaaacactgtcacagggcgatatatttatatgatcccttttggattaaaaagctcatgaaacttttctctggttcagtttatattattatagaatacatttcggggcagcctctggaaggactgtgggagaccagtgccatatctgaatggtgtgaatgatacaggaaaaactacaatttttaaaactttaaaaaacaaaaactgtcacaaccaccacaaacaaaaatagccttagggaaaaaaaggaaaaaaatgaatagggctgggatcctgccgtcaactttctagtttcttaagagttaagtttttggccaggcgcagtggctcacgcctgtaatcctggcactttgggaggccgaggcgggcagatcacttgaggtcaggagttcaagaccagcctgaccaatatggtgaaacctcatctctaccaaaaatacaaaaattagccgggtatggtggtgcacgtctgtagtcccagctactcgggaggctgaggcagaagaatcgcttgaacccaggaggtagaggttgcggtgagccgagatggcgccactgtactccaacctaggtgacagagcgagacttcatctcaaaaaaaaaaaaaaaaaaaagagttaagagttaagttttcagctgggcatggtgactcacacctgtaatcccagcactttgagaggctgagacagtcagattgtctgaactcaggagttcaagaccagcctgggcaacatggcaagaccctctctctactaaaaatacaaaaattggctgggcatggtggtacacgcctgtaatcccagctactcgggaggctgaggcacagaatagcttgaacttgggaggcagaggttgcagtgagccgcaatcacgccactgcactccagcctgggtaacagaatgagaccctgtctccaaaaaaaaaataaataaataaataaaaaagttaagttttctacattaaacatgtattatagttataatacttgagtttgtggaagtggacaggcagggccaagaggaatggctgaattgcagagccttgtatacagaatgcctgctggtatagaagctaagcctgtagcttatttcaaggactgtgccagacaaatgccagtgcagagaggccaaaagccaaacctgtggactttctggacttcagttccagaatggtgccagcctcctggcccttaagtacactgggggccagggctccttgtctctgggcctagtgcctcctgggcattcactaactcaacaactgttgaatgaatggaatgcccaggccaatgagcctgcccctgacaggtggagtggagggcatttttctttgcccctgtccctccctttgatcctagaacccataatcctgttcagatctttgaggacaagaccctcaggttgttagatttccgcagacctgagccttctataatgcttgtcacacagctgaatggaagatgcttgcccaggtcccaagtggtacccacaggaacaggcccctggagtacaggagacaggccacctggcccacccctggtacaaccccctcccacccactcattaagagggagggcccctaaaagcccttcttgccctttcttcaacctgtatcagcatccccagaaagcaaggcatcccagaggtcaacctcagaggaaacgcagactgctctccccactcaagagcagaatgacatgggaagattctaacatctctaggcctcagcttcccaatctgtaaaaagggactgctgctgatggggttaaatgagttaattaagtaaagcgcttggcacagagcctggcacacaagacatcctcaaaacaatggtggctgctattgttattattattagcattgtggtgattccggaaggcagcactgggcatggggccaagggggttgggggagcctcctcaggatgcctcagggaccagctgccacccacacccccatcagcagttaggcagcttctacctccttgtcctgagtcctgcctcacccctcccacttgctccaagttccctgctgagaccccatcctgcctggccagaccccgcctgcacaccagagccccaccttcacccataggctgcgccagtcaaactggtctccacaccctgccctgtgccccacagttcccagctccaggcttctacgcctccaatcccttctcccactggaattcagccgcctcttctgggccctccagtctgaattcgtcttgagctcagcgatcagggagggctttattaaaggatctccctgagacattttctctcctggcactgggggcctcctctccagctcccagaggcccagcccacctagtccttctacagagactcaggggtcggcctgcctgattaatgaggttccatggcaaccagggcctgggagggtggagggtggcagatggaaggacaggcagagggaggggatcagcagctggtccagctgccccgcccctgcagagaaggcctcccagccaggagggctgtccccagaggcctggccggccaggcctgcacctggcagtcagcatcgaggcaggaaggagggtctcctcaatggctcaccaacggttaggccccaggactttcctccgccccgccttcacttcccctagcagctgtgctcactaccgagatgcaaattctgagctgaagccagcaggcctcagttcaaatcccagccccaccacctgcagccgtgtgaccaggggcaagtcactttccctctctgggcctcagttcctcctccgtcagatgggcacagtgacaacacagctcacagcggggttgtgagttttagctggcttgaagtcgcccaaaggcctggcatgcagtaaacgccagttgaatacacgtgggctattattatcactgagtccgacgctggggaggctccggtgaggaagctgaggcgcagagcacagagcagcaaacagggaccggcccgaggtcaccccgcaccccagggcggggcccggaggcccaaccccggctctgcaccgcccagcctgggcgcctcagtcaacccctcccccgccccctgccgcctccaggccaaacacggcgccctcccgggtctgcgcggggggcacaggcggcgctgtcggcgcggcgtccctggggtccgtaccggcgggcggccgagcgcgggccgcggcgcactgggtgtgggccggggcgcctgcggtgtggcgaagagcagcaggtcagggtcgcaggggccggcggcgggcgccgcggggccggtgggagccggcggggcgctggcgtcctgcgcggcggagatgatgacgatctgcgaggagtcgagcagccgcagcgcgccggccccgagcagggcctccagcgccggcgcgcatgggccgcccgcaggggccccggccaaggccatgacgctcacggcccgcgcggcccgggtgacaggcggcggcggcggcgcgggcccatggcggcaggcctcggcgagggctcgatcccgctccgcccccggccgccgctgcctgcaaagtcccggccacttttacgcgccaaatcctttttgccgcgaaagagccacgagccgccgagcgccgccacaattggctgccccggccgtgacgggaacaacggcggcggttcctattggctttaacgcgccggacccggcggcgaggggcgggatggggcggcggcgcggggcggtacggccaatggcggggcggggcgcgcgcaggctttgtccggatggtaccaggcgcggtgtgactccccgcccccagcccgggcgtcccctgctggaggcgtggggacaccggaacataggccccgccccgccccgacgctcccgcatcccactgacctttctatagtgcaggttcagaacagagcctctcttctgcacgtgaccctcaacctgtagcccccaacagcctcagcttagatttccagagactgtcccctcttcttttcaggatcatcagttccacagcccagccatcagccacctcttccatcctcaacttgcctcacccatgacattatcctaatcctgcacccagccctatcccgctcacccagagcccaagctgaagagcggtgcctggaaatggcgagggggacgtcgggctttcctgcaagtcccattttagccaaaatctccaacagccaacgtatagcatctgcttgaactcattcattccctcactcattcaacaaacgtttggagagcttgctctgtgccccatcctcaattcgtggccctaaggagctcacagtccagtagacaggggaacagaaaggtaacagacgtttacaatacgatgaagtggcgtctgggcgcggtggctcaccaccggaatccctgtaatcagctggcggggtggatcgcatgagcccaggagttcgagaccagcctgatcaacatggtgaagacccatctctacaaaaaatacaaaaattagccaggcatggtggcgtgtgcccgtagtcccagctacttgggaggctgaggtgggaggattgcttgagcccgagaagtcgaggctgcagtgagctatgatcatgccactgcacaccagcctgggcgacagagcgagatcctgtctctaaaacaaaaaaagaaaacacatcacttctagggagccctcccaaggatttactcacttcctctattgcccactgctgcctctgctccaatgctgaccacacacactccttttctccatctgcctcccctgccaatctaggagctcagtagcgactcctcccaacactggtctggcccagagcaggcgctgagaaaggttatgaaagaaacagaggctaagccagaggctgcctagactgtgacaaggagaccacggttctgcaagggtggtccttaggccactggcttcagaaccacgtggtcacttgctaattttgggcccaccctggccctgccaatttaaaatctctaggtgcccaagaatctgcattttaacaatgccatgtcccctttccaggtgatatttgttattctttttctttttttttttttgacacttagggaattagaaaagccagtatcttattttttttttcctatttattttatatagacgaggtctcactatgttgcccagggtagtctcaaacccctgggctcaagagatcctcccgcctcagcctccagcatagctggtactccaggtgactgccacctcaccaagcttccaggttatttttatgcatactcacatttgaaagcaaactggtgtaccagcataatcaaaatgagtggtgcagcctcaaatcacagctcctgaggatgcttctcacccttagtttcaaatgggcacacagaccttgccctggccccttccagggttgccaggagaatgaaaagcataaggaattggaaagtgttttacaaactatgaggtggtttaggaaatcaggagttgttttcccctccaatgagtagtttctgaaattactcattgcaaatcctagaatgtatcatagctagaagggaccacagagaccacataagcctcttgctgtatggataggaaaactgaggccctttcaggagaaagtaactgtgaagccaaccagtgaccaaattgggcctacactgcattcccagccctgaggtctgcctgtcccccttccccatcccctctccataaagaagctgaggggtaggtcccattctaaacaaccaacgcaggtgctggcagagagcaagagaaaccagcacattcccattccagatggaaagagtgtcctttccctgcaccttcccacagggtcccagtaacactaacattcatttgtgtgaagccctctcaaacccaagtcattcaacaaacacttattaagcacctattatataccaagcactgtgctggtttaactgtggtggctggcaaagagagatgtctattattattgctccattttatgatgaggaaatttgaggccaaaagggcctgagtttaccaagtagatgaaaaggttatttttcaggcttggtgaggctgaggttgggggttttccaaagtcctgcccgccccagagtattcaagtacacatccaggtagaagtaggcgccctccgtcccacaatccttcaggtcctgctgaagcagaaaggagtgaagaccagcattcctagcatgaaactgaggaagagataagggccttctgtacctattaatacctacttgaaagcagaaaagcctgatagatgaggccccttggccctaagcctggcagctcctgataaggctgttctcaatgtcaacagttttcaaaaaacagtttccaaaaaatccacagtcactgggcagccacttccattgatgatctcctttcaaccccataatcccgtaagtaagcttgtttatccacatggtgcaggaaggaagaggctcagagaggggcattcatagctcaaggtcacacagcagaactgagatgagaacttcacttgtcccactgcaaaacccaggacctgcccttgccaccctctgtaaataccccaaaagccaggctcagggctgtcaagattataaagtgtagtttctaaagggtattatggtggatagtggcttggttcataggtgcttatttccatcaccaccttcaccaaccaaactagaggagttcgaggggatgcaatctgttgggcccacaatcctgtgcctggagacctctttcccttggttctttccaagaagcagagtggtgtagaggtgatagcatgggcttctaaatcaggtgggtgtaatcagaaatcttggtcaacatgaccttggacaagtcaattcacttcattcaatccacagatatttactgagcacctattatgtgtcagacattgtgctaggtgctggggacacagttataagtaaaacagacccctggaactcacagtccagtgggaaagttaggaattatttctctgtcactgcacagtatgcttgttaagaagtttgacaagtgacacaaataatttaaacctatttattccacaaacagcacctcccctaagcatacattcttagcttacaaaaaaacaaaaattcaccaaacatgaatatccagtcatgataaggaatgcataattgggagaaaagattctgtgatgacttaattttatgaagggcacagagatgtccattgttgagttgtggcagagggaggtggggagttttgcatctgcaacaatccctcaatgctaccctgactgacagtttactgtccctggagatattctgtcactgtgccagttctggctatatctgaacagacctcttgcccatccaaaaggcagtctaacatagaaacaagcctttggagtcgggtggcccccaaccctgtggcttcccgcctctgtgatcttggggaagtgattcaccctcttgaagagctttgcttgcctcatctgcagaacaacagataacagcttctttacacgatgcgtgtcaaagtttaagaaaacaaaacaagcagagtttgcaaactggcccccagatataactcaatttgcccatagaagatttttcttgaattatgaatttgttttaagatttgaggaaattggaaaataccatataaaaattaacatgtctggcttttctttctcttttcttttttttttttgagacggagtttcactattgttgcccaggctggagtgcagtggtgtgatctcggctcaccacaacctccgcctcccgggttcaagtgattctcctgcctcagcctccccagtagctgggattacaggcgcctgccaccaagcccggctaattttgtatctttagtaaagacggggtttctccatgttggtcaggctgttctcgaactcctgacctcaggtgatccgcccgcctcgggttcccaaagtgctgggattataagcgtaagccaccgtgcctggcctctttttttttttcttttgaaatgggagtctccctgtcacccaggctgaagtgccgtggcgtgatctcagctcactgcaacctccgtctcccaggttctggcaattctcctgcttcagcctcccaagtagctgggattacaggtgtgtgccaccataccaggctaatttttgtatttttagtagagacggggtttcaccatgttggccaggctggtctggaactcctgacctcagatgatccacccgcctcggcctcccaaagtgctgggattacaggcgtgagccaccacgcttggcctctggctttcttttcaaacagcagtatctggctatactggccaggccatcacggtgctaaacagttgttgtcccccagctagcgagggccttaccctccaggccaccagagtccttccctggcatgcctcactcagttcttgccctgccattccagggatgaacagccacccctcatgtacagtgcctggcacagagtgagcacccaaaaaatgtgagctgctgttagtcttattaccgccaaggaactgactggtaccagcacagcttctctgccttgcaagtaaccaaagataacatatggacaggccgggtgtcgtggcccatgcctgtaattccagcactttgggaggccgaggcaggtggatcatctgaggtcaggagttcgagaccagcctggccaacatggtgaaaccccgtctctactaaaaatacaaaaattagctgggcgtggtggtgggcacctgtaatcccagctacacaggtggctgaggcaggagaattgctggaacctgggaggcagaggttgcagtgagccaagactacaccattgcattccagtctgggcaacaagagtgaaactccatctaaaaacaaacaaacaaacaacaacaacaacaaaaacatggacatagaagagagggaaaagtggatattcgtggctgggtgcggtggctcacgcctgtaattccagcactttgggaagccgaggtgggtggatcacctgaggtcaggagttcgagagcagcctgaccaacatggtgaaaccccatctctattaaaaatacaaaaattagctgggtgtggtggcaggcgactgtaatcccagcaacttgggaggctgaggcaggagaatcacttgaaccggggaggtggaggttgtagtgagccaagatcaagccattgcactccagcctgggtgacagagtgagactccatctcaaaaaaaaaaaaaaaaaggcagatatttgtaatcaaacagcagacagggggtttggtgccagccagcagcctggctgtgtggccttggccaagtccttcaccatcagttggcccatatgttccgtgggttcaggccagagggtctgaggtccaaggtaactgcataggtctcagtcgattctcaagtctccccccagccctggtcactctctgagtgcacgctctggggacctcccttctctccaagcctcacccatggcaacttcctttctctgcgtcacccaagcctctcaggaggggtcatgcttttccaaggagtggggcgaaaccggacatatgactatgcctcctctgaccagggccacagcgaaggtgggagtaggaggcctttacagttgaggggctcagttttttcatctgtaaaatagtgatgataataatcatagtgtttacctgatggagttgttaggacattgagttattaacatgcctggcacatagggagagctcaatgaatgtcagctgttgtgaagagtgcagaatgactccctgaagtggcttgcctacactcccctctcaatttttcctctgaagaaatgcttcttgctgggcgcaatggctcacgcctgtaatcccagcactttgggaggccaaggcgggtggatcacctgaggtcaggagttcgagactagcctggccaacatggcgaaaccccatctctactaaaagtacaaaaattagccgggcgtggtggcagacgcctgtaatcccagctactcaggaggctgaggcaggagaatcgcttgagcctgggaggaggaggttgcagtgagccaagatcacgccaattgcactccagtctgggcgacagagcaaaattctgtctcataaaaaaacaaaacaataaaaaaattagctggttgtggtggcacacacctgtaatcccagctacttgggaggctgaagcaggagagttgcttgaacccagcaagtggagatggcagtgagctgagatcgcgccactgcactccagcctaggtgacagaatgagactctgtctcaaaaaaaaaaaaaaaaacagaaaaaaacgaaaaacttgttaggctgcagaatagcagaattttcatgaagcaattcctgcactgcctcccacattctattagccacaaggaggaaaaaaaaaaaactatgtttggagggcaacgaagcgtgtaaaatgaaataataccatattccattgattctgacaccttttctttcatattttaacctctctgaaattgaggtgcatcctaggatcagtggaatatccatttgtagtcagtaactatttttcttaggggctcaaaacggcatatctcatattggatggcatcttagaagtgacaagctgtggtgtacaaaaagtgccaggctcagggcccgccacgtcacaggccctcaggttgtcctcatgaccttcagcatccccagcacattcgaggctggtcatggtggagtgatcagcttttctttctttttgtcattttctcactgacacctgctgacctgcatttggtccccggcttgacaggcacatggcaaatgcagtcagggaggcatatggggagggctcaggatgggaagagaaagactttttataatatattaagatattcaaagaggaggagccagagattctttttttaaaaaacaaacaaacaaacaaaaaaatccccgctggaagccagagttatatatatgccacacaggccaggaaacccagcaggcctcctggagctggcagcaaaccgaaacaggggtattgtgtccaggccactggctggctgagggacattgttagggccttgccctgtctgggaaaaggggggtggcggggcagggggagtgtgttcccatgactccctggggagtaacaacaattgggccagctgggaagccggggatgccaggggcccagtgggcaggaggtaggcccccgaggggccatggagggcactgcggaggctgaggaggtggggtgcgggggaaggaaggtcagggtctgtttcttagctgggaggcaaggcctaggaggggaaacatgggcgtccttcactacacccctccctcaccccctccaaagccctgggccactgtgtctctctcgaaagtgcaccccagatgtgcccactcttctctacctctgtcgtcacccaccctggtctccctgcaggaccaccacgtggcttcctcactgggatgtatgccaccggcctggctcctacactctgttctatacatgaactagaaggatcttcccccaacataacccacatcacgtcactctcgtctatacctgccacaggctgcccgccacacttagaaaaaaagccagaccccttgccctggcccatgaagcctgcctggtggatccagctggcctccggcttcatctccagtgagccccacccctgcactcagtcagccaggctggccccttcccagccttggaatgccttggcctgctccctcctcaaagcctgtgcacttgcagaactcttgattggaacgctcttcctccaggcttgcagagctccccccttggtattcagggctcagagcaaacatcacctcctcagagaggccttccccggaaaacagcctcccattctctcctcccaagccccctctatcacactgccctgtatgacttcatggcaccccccaccctccaaagttctggaatgtggtcatcattggtcagtcttccctccttaggctatgagccccacgtgggaactgctttcttttgtcactgaatcctggcctccaccaccacctggcactttctaagaactcagccaacattagctagtatttgtatgattcctgtgctcagggcttggtaaaccatgccagctgcggctgggcacggtggctcatgtctgtaatcccagcactttgggaggccaaggcgggtggatcacttgaggccggcagttcaagaccagtctggccgacatggtgaaaacccgtctgtactacaaatacaaaaattagctgggcgtggtggcacttgcctgtaatcccagctacacaggaggctgaggcaggaggatcacttgaatgcgggagacaaagtttgcactgagctgagatcacaccacagcactccagcctgggaaagagaatgagaccccttctcaaaaaaaaaaaaaaaaaaaaacaacccaaaaaaaggcacaatgcccgctgctatgtggtcaggtggggaaggctactcttttttttttttttgagacagagtttcactcttgttgcccaggctggagtgcagtggtgcgatctcagctcactgcaacctccgcctaccaggttcaaacattctcctgcctcagcctccctggtagctgcgattacaggcatgtgccaccacacccggctaattttgtatttttagtagagacggggtttctccatgttggtcaggctgatctcaaactcctgacctcaggtgatccgcctgcctcggcctcccaaagtgctgggattacaggcgtgagccaccgtgcctggccggggaaggctactcttgagcagggagtcagaatctgggacccatggaccccaagttccatgaacttagacagaaaaaaaattacatttttattttcactagactctaactgaaatggaacatttcgttccattttgaatgtaggcaacaaaccagacgactgttggcagcacgtgggactttgtccccaatagaaatcacagctgtttccatctcccctcccagtgctgtgggtaccctgggatatgctcatgcctatcctacctctgaaatcatggccattttgaacctgatgctagatctttttattttatttatttatttattttgagacgaagtctcgctcttgtccccaggctggggtgcaatttcgcgatcttgactcactgcaacctccacctcccagattcaagcaattatcctgcctcagcctcccgagtagctgagactacaggcatgtgccaccacgtccagctaatttttgtatttttagtagagatggggtttcaccatgttggccaatctggtctcgaactcctgacctcaggtgatctacctgcctcagcctcccaaagtgctgggattacaggcgtgagccactgtgcctggccagatgttgttatttaatgtgttaaagaaagaacatggccgggcacggtggctcatgcctgtaatcccagcactttgggaggctgaggcagcgaatcaagaggtcaagaaatcaagaccagcctggccaacatggtgaaaccccgtctctacttaaaatacaaaaattagctgggcgtggtggcacacgcctgtagtcccagctagttgggaggctgaggcaggagaatcgcttgaacctgggaggcgaaggttgcaatgagcctcaatcgcaccactgcactccagcctggcaacagagtaagactccatctcaaaaataaataaataaaaataaaaaggagtgtcctaaaggagctgatgtggtctggccctgatccttctcccagctgacatccagcccacaaggagaagctggagggagaggccagaagagcaatgagaatgaggtttctgtcgcagacactgggacccacacttgcattccgcctggcttctgtcttgtttattaaattatgacatctgcagcagctttgagcacagagtcccagcacagaaaacaggtcccctccgttcagaagccctttctcagaacaacactcagaagagagctcagctctccctctgtcttctttattttttaattaatttcatttttattttttatctaaaggattacatgatcatcatctccctctgtcttctatctgggcagcacgagagtgggtcccactctacagggcaccctctgctgaaaatcaaaacttgctcaccccaaatgcccttcaaggctgaactaagacaaactctccccctgtgaatctggaacgagacaagcggaggaaaaaaaatttatttttataaagatcctcaaatttgtcatagaaagcaacccatctgaagtcacaaattgtggtgacgtgggcttcgttttgagaggttgagtacagcatggtgttctggtttaggagagagccacgttcaaagtctgattcttatacaccccaaatgcactcatggagaggtaaaagtgaacaatgtggaaggaaacactgtcactagaatcccttctgcagcttcagtgtggaaggctgcagcggcgagcatcaaacaaggcagcttcttggcgtctgggcctgtgagtcaccgcgctcacatgggttcacttagcatctctaatttgggagcagagcagcagaagaggcccaaattaacttgagttttgtccttccccttttacttggagttctgtgggcctgaatgcttggtgtcatctactgtaaggctcaggacacctggggccatcgtcttcacactgatcacggcaaggatctgcccaagatatttgggagaggaagctgtcaggggcgtagggggaaaacaggctcaaagaaaggactcacttttatattggattattgatcaaagagatcgccgaacacacagaggacaaggaagaaatgccaaagagttgagatgacattgcaatgtaaaagtttcttttaagataaaaataggtggctgtgcatagaatattccaggaaggctgtatgagaaagtgctaacagtgggtgccccagcaaaggaagggcctagggatgcagcacaggtgtaggaaggaacctgacttttccctgttacacacttttttttttttttcagacaaagtctcgctctgtcacccaggctggagtgcaggggtgtggtctcggctcactgcaacctccacctcccaggttcaagcgatcctcccaactcagcctcccaagtagctgggattacaggcgcacaccaccatacctagctaatctttgtatttttagtagagacagggtttcaccatgttggccagctggtgttgacctcctgacctaaagtgatccgcctgcctcggcctcccaaagtgctgggattacaggtgagagccaccatgcccggcccttttctttgcagggggcggggaaagggtctcactctgtcacccagactggagtgcaatggcatgatcacagctcactgcagcctcaacctcccgggttcaggtgatcctcccacctcagcctccccatggtgtacatgccaccataccaggctaattgtaatttttatagagacagggtctccctcttgcccaggctggtcttgaactcctgggctccagcaatgagcctgcttcaggctcccaaagtgttaggattatagcgtgagccactatgctggctatcaactttttataactttgagttttgtactatgtgtagtattgatttaaaaatattttttctgctctcgctctcgctctcgctctccctctccctctctttccacggtctccctctgatgccgagcggaagctggactgtactgctgccatctaggctcactgcaacctccctgcctgattctcctgcctcagcctgccgagtgcctgcaattgcaggcgcgcgcagccacgcctgactggttttcgtatttttttggtggagacggggtttcactgtgttggccgggctggtttccatctcctaaccgcgagtgatccgccagcctcggcctccggaggtgccgggattgcagacggtgtctggttcactcagtgctcaatggtgcccaggctggagtgcagtggcgtgatctcggctcgctacaacctccacctcccagccgcctgccttggcctcccaaagtgccgagagtgcagcctctgcccggccgccaccccgtctgggaagtgaggagcgtctctgcctggccgcccatcgtctgggacgtgaggaggccctctgcctggctgcccagtctggaaagtgaggagcgtctctgcccggccgccatcccatctaggaagtgaggagcgcctcttcccggccgccatcccatctaggaagtgaggagtggctctgcccggccgcccattatctgagatgtgcagagcgcctctgccccgccgccccgccccgtctgggatgtgaggagcgcctctgcccggccacaaccccgtctgggaggtgaggagcgtctctgcccagccgccccgtctgagaagtgaggagaccctctgcctggcaaccgccccgtctgagaagtgaggagcccctccgcccggcagccaccccatctgggaagtgaggagcgtctctgcccggcagccaccccgtccgggagggaggtgggggtcagcccccgccaggccagccgccccgtctgggagggaggtgggggggggtcagccccccgcccggccagcctccctgtccgggagggaggtggggggtgtcagccccccgcccggccagccgccccgtccgggagggagttgggggggtcagccccccgcccggccggccgccccgtccgggagggaggtgggggggtcagccccccgcccggccagctgcctcgtccgggaggtgaggggcgcctctgcccggccgcccctactgggaaatgaggagcccctctgcccggccagccgccccatccgggagggaggtgggggggtcagccccccgcccggccagccgccccgtccaggagggaggtggggggtcagccccccgcctggccagccgcctcgtccgggaggtgaggggcgcctctgcccggccgcccctactgggaaatgaggagcccctctgcccggccagccgccccatccgggagggaggtgggggggtcagccccccgcccggccagccgccccgtccaggagggaggtggggggtcagccccccgcctggccagccgcctcgtccgggaggtgaggggcgcctctgcccggccgcccctactgggaaatgaggagcccctctgcccggccagccgccccatccgggagggaggtgggggggtcagccccccgcccggccagccgccccgtccgggagggaggtgggggtcagccccccgcccggccagtcgcctcgtccgggaggtgaggggcgcctctgcctggccacccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgcagaaagaagtagacatgggagacttttcattttgttatgtactaagaaaaattcttctgccttgggatcctgttgatctgtgaccttacccccaaccctgtgctctctgaaacaggtgctgtgtccactcaggattaaatgggtcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgctaaatccccctctgcgagaaacacccaagaatgatcaataaaaaaaaaaaaaagaatttaaaaaaaaatatattttttcctctccctctccctctccccacggtctccctctccctctccccacagtctccctctccctctctttccacggtcttcctctgatgccgagccaaggctggactgtgctgccgccgtctcggctcactgcggccttcctgcctggttctcctgcctcagcctgccgagtgcctgcgattgcgggccgcaccgccacccctgactggttttcgtatttttttggtggagacgggttttcgctgtgttggccgggctggtctccagctcctgaccgcaagtgatccgccagcctcggcctcccgaggtgccgggattgcagacggagtgctcagtgctcagtggtgcccaggctggagtgcagtggcgtgatctcggctcgctacagcctccacctcccagccgcctgccttggcctcccaaagtgccgagattgcagcctctgcctggccgccaccccgtctgggaggtggggagcgtctctgcctggccacccatcgtctgggatgtgaggagcccctctgcctggctgcccagtctcgaaagtggggagcgtctctgcccggccgccatcccatctaggaagtgaggagcggctctgccctcccgcccatcgtctgagctgtggggagcgcctctgccctgctgccccgtctgggatgtgaggagcgcctctgcccggccgcgaccccgtctgggaggtgaggagtgtctctgcccagccgccccgtctgggaagtgaggagcccctccgcccggcagccgccccgtctgagaagtgaggagcccctccgccgggcagccaccccatctgggaagtgaggagcgtctccgcccggcagccaccccgtccgggagggtggtgggggtcagcccccgcccggctggccgccccgtccgggagggaggtgggggggtcagccccccgacccggccggccgccccgtctgggagggaggtgggggggtcagccccccgcccggccggccaccccatccgggaggtgaggggcgcctctgcccggccgcccctactgggaagtgaggagcccctctgcccggccgccaccccgtctgggaggtgtgcccagcggctcattgggaacgggccatgatgacaatggtggttttgtggagtagaggagggggaagggtggggagaagattgagaagtcggatggttgctgtgtctgtgtggaggggggtggacatgggagacttttcactttgttctgtggtaggaaaggttcttctgccttgggatcctgttgatctatgaccttgcccccagccctgtgctctctggaacatgtgctgtgtccactcagggttgggtggattgagggcggtgcaggatgtgctttgttgggcagatgcttgagggcagcatgctcgttgacagtcatcaccactccctagtctcgggtgcccagggacacagacactgcggagagccgcagggtcctctgcctgggaagaccagagacctttgttcacttgtttgtctgctgaccttcccttcactgttgtcctatgaccctgcggaatccccctttgcgagaaacacccaagagtgatcaatggaaaaaaaaaaaaaaacaaagaaaaaaggaacagaagcaaatgtggcaacatcttgataactgttggaactggacgttgggtacatggggttcattaaactcttttctctaaaaaaaaaaaaaaaaaatatttttttaggctgggcgtggtggctcatgcctataatctcagcactttgggaggctgaggtgggcggatcatgaggtcaggagatcgagaccatcctggctaccatgatgaaaccccatcgctactaaaaaaaaatgaaaaaattagccgggcatggtggcaggcgcctgtagtcccagctactcgggaggctgaggcaggagaatggcatgaacctgggaggaggagcttgccatgagccgagatcgcgccactgcactccagcctgggcgacagtgcgagactccatctcaaaatatatacacatatatatttatttatttatttatttattttagtcttacatgtcaaaagaattaacaggattgtagcaggtgtttagtaagtagaggttaaaccattctatttcaggaactagcatttaggaagcatagcacttactgtgcaacaagagccctctggccatccctgttttacaggtcttagagaatggagggcagctaggaaggagccaaatgggactcctctcagatctgctggaaggcagagccctgctccccggcacagaccacactgccttcctccctggagtgtgcagttggaagcaccagatgctctagcagcatccagagagatgccatctgtgagggaaacctattcttagagagcagagacagtcggtagcggagttggccaacccccagcagcagtggcgggacttcaggagggcaggcggccaaggtttcaccttcagctgggggcaggacaggctaaaagcagggtgtgctcagtcctcaggggcacacttcctctacatttggatgctcttagaaataacagcatttattggggactcactttaactgtgtcatattctttaaccctccacaccactcgatgaggtgtgtgctacgacaacgcctactttatcaatgaggaaatagaggcacagaatggctcagtcacttgcccaaggaaactgtggggccagggcttgagcccaggcactctggctccaaagcctatgtccctgaccaccatgctatattgcctctcaacctgctgtacagaggccagttttagtttgggttcccccaatagcagactctaagacaagggtttgagtgcaagtggttcatatgggaagtggtcccaggaagcactggtaggggcatgaggaagggagatggggagggtgtttgaggctcagccctgctgggcggccctgggagtcagtgtggagcacgcacctctgagttatcccacccgaggggtgagggatgcgggctgtgggagtgggggtatttatcagtcattggttgaaggttgctccaaggatgtgttcattctccagcccttcaggcctgccagaggctggcaaaggaggcaccagtgacaagctagagtcctcaggcagaaagacagaggggcggccactggcaaagctggctagtgtgcaccagagtcgttatttagaggagctataggcagggcacccccaccatctgctataaaacctgcctggtgatggcccaagccctctgccctccccaacccctagagcagcagtccccaacctttttggcaccagggaccagttttggggaagataatttttccacggaccactggggaggggacgtggtttcaggatgattcaagcacattgcatttactgtggattttatttctattattattaccttgtaatatataatgaaataattgtacaacacaccataatgtagaatcagtgggagccctgagtttgttttccagcaactagacagtcccatcaaggcgtgacgggagacagtgacagatcatcaggcattagattctcataaggagcatgcaacctagatcccttgcatgcgcagttcacaatagggtttgcattcctacgagcatctaatgccaccactgatctgacagaaggcagagctcaggtggtaatgtgagcagtggggagtggctgtacatacagatgaagcttcgctagctcacccacctttcaactcctgctgcgtggcctggttccgaacaggccatggaccggtaccggggttgcggaccccttactctagagctcattcaacctccacagcaagttaaaggaacttcataattacctactccaagtttgcagtaaatgttgtggctgaaaacacagcttacagaatcagactgatcccacctcaattacctaagggctctgtgactcatttgtcagatgggataataatggacggctccatatcattccccacccccttgttactcagagcagcaccactggcagcaccagggagcctgggagaaatgcagactctcaggccccaccccagctcactgaatcagaagctgcattttaataaggtctccagtgactcctgcatacatttctactagtaacttctaaaatatagaaagagtgatggagtaagtatattaatgaaagtgtatctaccagaccaatggtctcaaattggtagcccatggaccagattttcctggagacttgtttgatttgtccaggattgtgtttttttttttttttttttttttgagacagagtcttactctgtcacccaggctgaagtgtaatggaactatctcggctcacagcagccccccaggttcaagagattctcccacctcagcctcccaagtagctggaattacaggtgcctgccaccatgtccagctaatttttgtatttttagtagagacaggatttcgccatgttggccaggctggtctcgaactcctgacctcaggtgatccacccgcctcggcctcccaaagtgctgggattacaggtgcaagccaccgtgcctggtctaggatcgtggtttcgaaaaaagcagacttggccaggcatggtggctcacacctgtaatcccagcattttgggaggccaaggtgggtggatcatgaggtcaggagattgagaccatcctggctaacacggtgaaaccccatctctactaaaaatacaaaaaattagccgggtgtggtggcgggcacctgtaggcccagctactccggaggctgaggcaggagaatggtgtaagtaaacctgggaggcagagcttgcagtgagccaagatcgcgccactgcactccagcctgggcgagagagcaagactctgtctcaaaaaaaaaaaaaaaagaaaaaatcagactggtacacaagtctccagttccctatgtccccatcactcctcatcgcatagcactatgtcattgtaggcccctatgggcatttgaatgtgtacccctttctggcccatatcctataatgagctaacatttgcatagcatggcttaggtttctaaatttgaaacaaggcactggaaaaaacatgggctttgaaatcagacgaatctgagttcaaatcttgattcggctgttatactagctgtattaccttgggcaagttactctcctctctgattctcagtttcttttcttttctttttttattttttttttagacacagtctcgctctgtggcccaggctggagtgcagtcgtgcgatctcagctcactgcagcctctgcctcccaggttcaagcgattctcctgcctcagcctccccagtagctgggattacagggacgtgccaccatgcctggctaatttttgtatttttagtagagatggggttttaccatgttggccaggctggtcaagaactcctgatctcaggttatctgcctgcctcagcctcccaaagtgctgggattacaggcgtgagccactgcacctggcctgaccctcagtttctacatctgtaaaatggggacgaaaacacacatttgcaaggccactgtatggtttaaaaataatatgtgcaggctaggggcagtggctcatgcctgtaatcatggcactttgggagactgaggcaggaagattgcttgaggctaggaggtcgagactagccctagtgacagagcgagaccctgtcgctacttaaaaaaaaaaaataataataatatgtggaaaacacccaagtggaagtatgaatgcactaaatgaaagtaattagtagcacatcagtggtagttgcacaagtccagtgaggaccacggcattatgattatcctcattttatgataaattgaggctctgagaggtccagaaccttccccaaggttacacagtgggggagtggggactcaaacccatgtcctctagctctagatctgcactgtccactagaataatctgtgaggatacaagtgttccatatctgtgttgcccgtcacagcagccactagccacatgtggctactgggtcctgaaaatgtgggtggcaaaatatacacccaattttgaatacttaatacaaaaaagagtacaaaatatctaatgatgttaattatatgttgaaataacttttagaaatttgtgttaaaatatatagtgaagattaatctcaccttttttttttctttggtgagacagggtctcactgtcgcccaggctggagtgcagtggcgtgatctttgctcactgtagcctcgacctcataggctcaagtgatcctcccacctcagctggaaccacaggtgatggaacccggctaattttttgtattttttgtagaaactgggtttcaccatgttgcccaggctggtctcaagctcctgagctcaagtgatccacctgcctcagcctcccaaagttctgagattacaggagtgagccacagtgcccaggcttcttttttgtaatgcagctactagaaacattttaattacatatatggctcacgtgtttctattggacagtgggaatctagaacttctccagtagaacagcatctgagataaggaacttagtgttttttaaaaagtatttacaacccactgcccaccagcaaggagccctctgtgacataagaacagttgaagaatgaacatacccaccggaaagagacctcagggccctcctctgagctccttgacccctgaggcctagagagtagtgtggctggccccagtctcacagaagtcagctgcacagctggaaccaagccgtagattcctcagcctgattcggccacttgtgccaccatacaaaggtacccactgggattttaaaatcagtgtttttacttcagcaaacggaaccctgggataacaccagttggagtctgaggcctatgatcttgagaaggcagtatcctttgggagggtctgcatggggccaaatcttgagccacagccagacacctcagggctgcattaattggagggacggctcttgttatagacgaggaagtctgagatgtcgtgccatacattgctgtcctcatagaggtaggtcatggaggactgcagcgagggctgcagggtggatcggtgatactcaaagagccacagcaccagcccccacaccaccgcagtgagcagcgggaacgggtcccacctgggttcagggatgtagcccttctctacagccaggcggctcagggcaaacaggacgcgtgacaacaggtacatgttgatctgcaaagagggaatgatgggaattactggtgatcaatagtgatgtccctcttttgtttttgatattaataatttgtttcatttctctttttttcttagagagcctggctaggggtttatttattttaattatctcttcaaagaatcaacttttggtttaggtccttttctctattgatttcctgtttgcaatttcattgatttctgtactaattttttttttttttttctgagacagaatctggctctgtcggctaggctagagagagtgggcttactggatctcggctcactgcaacctccacctcctaggttcaagtgattctcctgcctcagcctccggagtagctgggattacaggtggcgcccaccatgcccagctagtttttatatttttagtagagatagggtttcaatgtgttggccaggatggtcctgaactcctgacctcagatgatctgcccaccttggcctcccaaagtgctgggattacaggtgggagccacagcattggcctgatttctgcacttatttttattgcttcttttcttcagcttactttggatgtagttaaaaaaaaaaaaaaactttagagatagggtcttggtctgttgccctggctgtctcaaactcctggcctcaagcaatcctcctcagcctaccaaagtgctgggattatatgtgacagccaataaaaattatggctaaaaaatggtaaaatttttttttctttttttttgagacagagtcttgctctgtcaccctggctggagtgcagtggcacgatcttggctcactgcaacctctgcctccctggttcaagcgattctcctgcctcagcctcccaagcagctgagactacaggtgtgcgccaccatgcctaatttttttgcatttttaatggaaatgggattaccggcatgagccaccatgcctggcctaaaaattatttttacaatttaaaaatatttaagaaatttgagggaggcaagtagagagaggctgccaacttttcaggtttccaaagaacattaaaaaacaactagcattctgccaggtgtggtggctcacgctgcactttgggagaccaagagggggtgcatcatctgaggtcaggagtttcagacccagcctgaccaatatggtgaaaccccatctctactaaaaatacaaaaattagctggtatggtggcaggcgcttgtagtcccagctacttgggaggctgagataggagaaatgcttgaacctgggaagtggaggttgttgcaatgagcctagatcgtgccactgcactccagcctgggcaacagagtaagactgtctcaacaaaaacaaaacagaacaaaaacccaacgactagcttttagtctcttattcatcatcatttcataacaaaagcgaagtttaacccagaaaaaggacaagtcacagaatgagagacagtttttagagtgtattaagttttcttttatgaaaaccttacttcagggtcatttttttccctcatttcactacagagtgatttttaaaaacaatctttgccccagagagcagcacatgcattgatttttgggaaccatgaaattacagatggaaaaactgagaggaaagtgaccttcccaaggtcacagagggactggtgagtcacagaactcagacatgcaaaagagccaagagcttatcatcttaatcacctccaccccaacctctatacagaaccagggccccctcctctagccccacctctatacagaaacacgcccctccacccacccctacctctagaataaaccacgcccctccccacccccacctctacactgaaccacgccccttcacccacccatacttctacactgaaccacgtccccttcccccacccccacctctacacggaaccaggccccttcccccactcccacctccacactgaaccacgctctttccccactcctaactctacactgaaccacgccctttctcccactcctacctctatacagaaccacgcccttctgccactcaaaactctacactgacccacaccccttcccccactcctacctctacactgagccacgcccttgtccccactcataactctacactgaaccacaccccttccccgactcccacctctatccagaaccacgcccttcccccactcccacctctatccagaaccacgccctttccccactcctacctctatacagaaccacaccccttcccccactcccacctctacaatgaaccacgccctttcccccactcccacctctatccagaaccacgccctttcccccactcctacctccatacagaaccacacctcttctcctactcctacctctacactgaatcacgccccttcccccactcctacctctatactgaaacaagccctcttccccaaccccctcctctacactgaaccacgcccccttccgtcaccacctctgtactgaaccacgcccccttccatcacccccacctctgtactgaaccacgcccccttctgtcacccccacctctgtgctgaaccacgcccccttcactacccccatctcgggaggatctttacctggctgttgatgttattgttttctccaaacaccaggatacccccgaggaaggccgccaggaatgcgtgtgctgggtaggtcttgccttgtatgtaggactgcagggcacggagacccttgtaggtgaacacaaaccgtgccaggttccaggagtggatatatgtggcctgcagtatggcccacagcttctcctggaggctgcacaaacacaggtgcccctgccatgagtgcaggctcagcagccccaaagggcttttacgcactgggcatgcctaacaaccagccaaggagctcggagtaatgctcattcagtcaccggcctctacccttcatgttctctcccttgattcaggccttgactcagtgccacctccccaaggagaccctccctgatcaccctacagaacagaatacccatcacatcctgtcctgaccctaattttcttttccttcctagctatggtcaccaaccgacatttatgtgcttgtttattatcttccctcaccccagtagcagctataggagggtggtgtctggatctggcttgttcatctgcagggcttggcacgtagtaggtgcttaataaatgtttttttgagtaaacatgtgaaggagtgagtgtctgccatgtgctggatgtgggggtacgattctgagaagaaacagatctgctcgccaccctcaggggcttatgatctactgggagaggaaaatgttaaataaataatcacaaaaagaactttgaccttgacaagagatggcgctgggatcttcccgatgaggaggtcaagaggggaggagagccacatcccaggcagagggctcagcacgtgccacgcccggaggagggtcagggagtatgaggaaaggagcagagagaagccaccgtggccatgggcagagaaccagagagtttgtggggagggtgcagggcaaagacagtggggccatgctgagtttggtctttatcctgagaagtgaacatttagatagaggaggctattctttttatctcttaaaaatcactagaggccaggtgcagtggctcacacctataaccccaacactttgggaggctgagctgagatggtgccactgcattccagcctggacgacagagactctaccttaaaaaaagaaaaaattactaggaggccagacacagtggctcacacctgtcatcccagcacttcgagaggtcaacacgggcagatcccttgagcccaggagttccagaccagcctgggcaacataatgagacctcgtctctataaaaaatagaaaaaattagccaggtgtggtggcacacgcgtgtagttcctgctacttgggaggctgaaggaggaggtttgcttgagtctgcagtgaactgtgattgtgccacagcactccagtctgggtgacagagaccctgtctctaaaaattaaaaaaaaaaaaaaaaatcactagggggcaggaaggataacacagagaaggagcagagtctactcctcccaattcaggaatggcaaactcaggtgctcttaaggctagacgaagaccctaaatgagtgagagggtccacggggaaatcttccaggtgactggggacagccgggagcagatggctctcaccccgcgcaaacacaggccccagtgttgccagttctaaggcaggaaagctggatttccatgtggaatctaccagtttttaaatgttggcactaaccctgccttcaaaatgtgtctagagactgaccactcttctcacctgcaccagcaccactgaggtccaagcccgacatttgctcacttgcatcactgccacagcctcttggagggaacctgcttctgcccttgggtggccctgctcccctccccccacaccaatctgttcttaacctggcagcaattttttttttttttcctctgagatggagtctagctctgttgcccaggctggagtccagtggcatgatctgggctcactgcaacctcttcctcctgggtttgagcgattctcctgcctcagcctcccgagtagctgggactacaggtgtgcaacatcacatccgactaatctttgtttgttcatttatttatttattttgagacggagtctcactctgtgtggcccaggctggagcgcagtagcgcaatctcggctcactgcaatctccgcctctcaggttcaagcaattctcctgcctcagcctcccgagtagctgggaccacaggtgtgcgccgccaagcccagctaatttttgtatttttagtagagacggggtttcaccatgttggccaggatggtcttgatctcctgacctcgtgatctgcctgcctcggcttcccaaagtgctgggattacaggcatgagccactgtgcccaacctaatctttgtatttttcagtagagacagggttttgccatgttggccagactggtctcgaactcctgacctcaagtgtaccacctcggcctcccaaaatgttgggattataggcgtgagccactgcgcctggcctagcagcaaattcttaactctcacgctgttaacacataagtcaaataatggtgcagccctgctcaaaatcttacaacaatttcccattgcacttaaaggaaaagccaaattcctctctatgacccaaagctggaaaggaccaacccaggtcaagctgtgacccgcctctctgtcctctctccccttcagcccctctgctccagcctcctcacacttatcaagcaggatcctatctcaaggtctttgcactggctatgcccgtggcctggaacactcactctttcccctcatatccacctggacaactctgtctccttcaagtctttactccaatgtcactttctcatagcggccttccctatttaattctgcaacctgtcccctcagcacttctgatgccctttccctttttccctgctctaattttgcttttccataaccatagcaccttctaacataccacagactctccttactatgtttattttctgccaccccctgctagaatgtcagcaggagtcactgtccgttttgttcactgctgtatccccagtacctagaacagtgtctggcacatagcagatgctcaataaatatctgctgaatgaacacatgagttcagtttttcaaaaaatgacttggaggacaacaaaaacaaaatagaaaaaaataaataagataaaaatacaaaatgagcacatcttgcaagttggatttggcctggaggctgccagtgcatgattcctgtatgttccacatgagcctatatgcattaaacactagaccgcaacccgttttctgagaagtgccttgagggaagagctacgggagatgacaggaaggtgaagatgcttcagcgagagacaagagatcagggagctttgaggaggaagtgatcctcagagaactggtctggattgccaggagggaagtaaaggtggagtgcgagccaaaggcactcctggcgggggtgctgcgtgagcagatgtgtgcaggtggagctatacacatggcatgtgcatggaatggcagcgagttctgtgtgccaagggcacgccagggtggacacaacgggggtcagctgaggccagactgcagaaggccctgaaggccaggcctggaagctgggcttccttggagggcacagggagttttcaagcagggataatgggatcagagttggactttagggccgggcacggtgactcacacctgtaatctcagcactgtggaaggcccctgaagtcaggagttcaagaccagcctggccaatatggtaaaactccatctctactaaaaatacaaaaattagccaggtgtggtggtgggtgcctatagtcccagctactcaggagactgaagcaggagaatcgcttgaaccccagaggcggaggttgcagtgaaccgagatcatcaccgcactctgacctgggtgacagagagagactccatctcaacaacaacaacaacaacaacaacaaaacacaacaaaaaaagagttgaactttagaaggcgtgatggggggacagggtagacccagctaagaagctattacgactgtcctggcactgagggctgaccacattctctcccagtttgagggatgtgtacctgccattccggaagagaaaggtcatgaccagcgcgtgaggggcccggattttggctccatagctgtagaaacagaagaaaacagttactataatgtcactgtgtcgcactttctttttgggctgtccttttgaccccttgttctctccccccatcccaaattctaacaccactttgggaggggaaatcatgctggatgcaaatcctggctctgatacttcctggtagtatggtctcaggcgcgtcctttaacttctctcagactcagtttccgcaccataaaaagggatgtttatttttaattatttagcgacagagcctcactttgtctcccaggctggtgtgcagtggtacgatcatagctcactgcagccctgaactcctggaatccagcgatcctccagcctcacctccctgagtagctgagactacaggtgtgtgccatcacgctcagcataaaaagggatgttttttgtttgttttttgagatggagtctcactctgtcgcccaggctggagtacagtggtgcaatcttggctcactgcagcctcggcctcccgggttcaagcaattctcctgtctcagcctcccaagtagctgggattacaggcgccagccaccatgccaggctaatttttgtatttttagtagagatggagtttcaccatgttgcccaggctggtctggaactcctgatctcaggtgatccactcacctcaaaaagggatgttaaacttcagagggctggttgtaatttttttcttttctgagacagagtctctctctgtagcccaggcttggagtgcagtggtatgatcttagcttactgcaacctccacctcctgggttcaagcaattctcctggttcagcctcccaagtagctgggattacaggcacgtgccaccatgcctggctaatttttgtatttttagtatgagataaggtttctccatgttggccaggctggtctcaaactcctgagctcaggtgatctgcccgccttggcctcctaaagtgctgggattacaggcgtgagccactgtgccccgccccataattttgatggaaggagatggtacatgtaaaaggtccaccatccttgctcaactggctttgtggaattgctccctctgctccatcctgacgttctcactgcagccagtctcttttttttttttttttttttgagacgaagttttgttcttgttgcccagcctggagtgcaatggcatgatctcggctcactgcaacctccgcctcctgggttcaagcgattctcctgcctcagcctcccgagtagctgggattacaggcatgtgccaccatgcctggctaactttgtatttttagtagagacgaggtttctccctgttggtcaggctggtctcgaactcccgacctcaggtgatccgcccacctcggcctcccaaagtgctgggattacaggcgtgagccatcctgcctgtcctagccagtctcatcttttaaaaacatcaatctcatcacatcactcccagcttaaaatcctctaacacctttccactactcacagaacaaattccaagctcttccctgcagccttgaaagtgctatagccttggcccctgctcactgctcctacctcaccccagggccctcctctgctgctccagccacactgtccttcctggactgcatctgacacatcaggttcttctctgctcctggctttggcctggcagttcctactacctggcgtgctcctccccagccaccttccctcagccttccggtctcagctgggccctctgcaaaggcctcctgatgctccagcctaggtttgagcaatttttcattgccacagatcccaaaacttctctccagcacttcatcttcccaatttaatgactcggttattcagtatttattctattataatgatctctttcctgtgctagactgtgggctctgtgaagacagggaatgtgtctggcttgtcatctgcatagtccctagcatagtaccccacatggtacctgacatataacatgtgcttgataaataactgttgactgaccgatgccagaacaccccttacccatgacaatgtcatttctagaaggttctgtcttcagcttagctcatcttaaagttaacagattccctaaaacagctgttaggtaacactgtacctattcaaaatgtacctctttctaactattatacaaagaaggacctcaactttgtaaaaatgcatttataaaaaggctggcactttgggaagctgaagtgggcagatcatttgaggtcaggagtttgagaccaacctggacaacatggtgaaaccctgtctctactaaaaatactacaaaaattagctgggtgtggtggcaggcacctgtaatcccagctactcgggaggctgaggcaggagaatctcttgaacccaggaggcagaggctgcagcgagttaagatcgtgccactgtactccagcctgggcagcagactaagactctgtctcaaaaacaaaaataaaataaaataaaaaactggaaggaaatatgccactgttattagcaatgcccactgcactggaggaatatataatagatataatttatttttgcttgctttttaaacttttctagacttccagaattatctatgattaagtactgcttttaaaattattaaatattttaggccgggcgcggtggctcacgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaattattaaatattttaaatgttacataattgttacataattgcctctttttaagattcaaacctcttcccccacccttcctttcccctcctcatttagggatctaggaatgacgtgaacaagaccatgtttactttcattgttttaactatactcagatgaatagtagaaagacagtggtatttgggccaaagccctgccatgttttgctatgtgagcttggataaattagttaacctctctgaacctcccttttcccatcaacaaaaggtattctccattttacagaatggcttttggcagttacgcacatataaaagttcctaggtcaatcaatattagtgtctcttcttttcttactcttctttattggacacctccacccctacccctatccctaagttctccaggtacccaaccctggtcttaccaggctacaaggtctaaaaatcctgacagcctccttgagacaatggtcatgagccacatactattgtctccccaaatatacatgaatgttcactgcaggcttgtttgaaaaaacaaaagactggaatcaaacctgtgtccaaggctgggtgtggtggctcacgcctgtaatcccagcacaatgggaggccgagacaggccgatcacgaggtcaggagatcgagcccatcctggctaacacggtgaaaccctgtctctactaaaaatacaaaaaaattagccgggcgtggtggtgggtgcctgtagtcccagctactcaggaggctgaggcaggagaatggtgtgaacctgggagacggagcttgcagtgagccgagattgcgccactgcactccagcctgggcaacagagcgacactccatctcaaaaaaaaaaaaaaaaaaaaaaaaaaaaaacttggcaaaagggttactgatgttatctcagggcacatcaaggatatgcccttggccagacccagtgggaaccagttctacctgactcttgagtgtccatgggagccaagagcctggcactggtgccaggcatccttgggtttgaatcccggctccaaccgtgaccaagtgctgtggccacgagcaatgggtctacctctgagctacagccttttcatctggaaaatggggacaatggcaattctgatcttgcacacttattcattcattcaataaatatttcagaaactactaaataccaggtgctagtaatacaccaaggaacaaaatagataaagttatggcctcatgaaactttcttttttttccttttgagatggagtttcactctgtcacccaggctggagtgcagtggcacaatctcagctcactgcaacctccacctcctgggttcaagcggttctcctgcctcagcctcccatgtagccgggactacaggcatgtgacactacacccggctaatttttgtatttttggtagaaacggggttttgccatgttggccaggctagtctcgaactcctgacctcagataatccgcctgcctcggcctcccaaagtgctaggattacaggtgtgagccaccgtggccagcctgtgctaagcatttcacacatattgactcaatcctgatagtataagtactagtaccatgcccattttacagatattgaggcttagagaggctaaatgacttcctccagatcacacgggtaggtggggccagggttcaagccaaggcatccacatccttcccaccatcccacgttgccactaggatgccaattctgggggacacaaaccactttctctggtttgttctctgctttgtccccggttctggcactgtaggccctcaataaatggtggctgttatgcactaggtttaaaggagactgagctcccctctaggcaccagccagggcaatgaccccaagacctctcttgcaggtaagatgccaggatagttgcagcttcttttacattcattgtcacgtcccaggagccccctgagccgaacgggacttagcgctggagtcctacaggtgagaagtgagaagcaggatgcaagcccatgggcaagcttcatggggacagaatagacaggaggcatccgcctgccagctagaggccagagtccagttccccattgtgcagatggggccgttgaggcccaaaggcacacagagaggtgaggtgaactgaacccaaatgaggggatacagaagctggcatgggaggagtcaaagcaagagggccaggctgcaaaggttggaagacccagaaaatgtgcagtgggagccccagttcagagctgggaaggcgcgcaagccaaaatccagctcccattgcacagatggtgacctccgagacttagagacacacgaggactgctccagggcaaacagcaccgcggcatcggacttcgaactcgcgcctctgaccccaggcaggacatccctcagccccagcccggcccgacggccccactcacacagccccgttccggaagcccttaagcacggccaacgcagcgtggtagcggcgcttgcgcagcagtgcgttgacgactacgagcagagcccttagctgcggcggggctgccatagtgcgggctgcgcgcagggtcggggttaggaactgtaagcgcactgacagccggaggttccagctgcgcgcccacagcccctcggtagcgccgccgactcgtggcgtctataggctgtttctgcgtcactcatgcatggaagaccaatcagagagcgtacttgtctcatgggacaatagcactcatcgaaatagttgtctgactggaagagaaaggaaagcttgtagccaatcacagtgggctccgcccaaggtcacacacgatttgtccaatcagaaggcactttcccttgggccatgttgggttcacgagtgggtttggaaggaggcgtgtacttggaaggagggctcctgaatgaggagtggccctgcttagagatgggatgggcgacaggtgatgatacagggaggagcagggccccatctttatgcgagatagttctgactgggatatcctttaccatagcgatcttcccagagtgtcagtcacatggcccctcaatggcttccatgtacgtatgtatgttttgagatgcagcctcgctctgtcacccaggctggagtgcagtggcgcgatctcggctcactgcaacctccaccccccagggttcaagcagttctcctgcctcagcctcctgagtagctgggactacaggcacccaccaccatgcctggcaaatttttttgtatttttagtagagacggggtttcaccatgttggccaggctgctctcctgacctcaggtgatccacctgcctcggccttccaaagtgctgggattacaggcgtgaacccagccggcgtccacttattcttagaatccaaactcctccccaaggcccaagagagaagacctcctgtgatctggtccgtgcctctccctctgaccccacgttccagcacttgccacctcactgcttcccagccaaacagcctcctttctgttccttgggccaagaacccttctacctcagggcctttgcacttgctggttccctgcttgatattcgccatcctgggctcttcccatgatgggcttcttctcatccttcaggtttcagctcaaatgccacttcatcagagagactttctgagacatccaatttgaagtagcactgtccactctgactcattaccctggctcttttttttttttttttttttttagactgagtctcggatctatcacccaggctggagcgcagtagtgtgatctcagctcacttcaacttctgcctcccaggttcaagggattcttctgcctcagcctcctgaggagctaggactacaggtgcatgccaccacgcccggctaatttttgtatttttagtaaagacggggtttcaccatattggccaggctagtccaaactcccgaccttgtgatccgcccgcctcggcctcccaaagtgctggaattacaaatgtgagccatcgtgcccggccaccctggttcttatgtgttttttttttttatagaacttttgacactttagacttgtttactatgtgttcattgtccattgcccttatcaaactgtaaattctatgaaggaagaaatcttatttgtcttgttttctgctgtaaccccaacactaggcacatggtgggtactcaacacttgcttgtttaagcaacacatagttttgggttgtcatctctgagagcattgatgggtgacattaacatatgatgtcactatgtggagttgtcactgaataacagctacacactgagtggtggctgtgacttgtgagggtgtcccctggtacttgggccatatggtatttaccagtgatgttatttgctcagtgtcaggggacaatttcagaggtcaatgaaggagggagttgtgctgggcctattttgtcactgaaactgggttgtccgggatttttcttttgtgatggtaggctactttattcagttcatccttcctctgaagataatgactatgttagataatatattaaaatatcctcttaaaaacactgaagttccttggctgggcacagtggctcatgcctgtaatcccagcactttgggaagccgaggcgggcggatcacttgaagccaggagttcgagaccacccctgaccaacatggtgaaaccccgtctctaaaaaattaaaaaacaaaaacaaaaacaaaaaaacactgaagctctgccaggtgcggtaggtagctcacgcctgtaatcccggcactttgggaagccaaggtgggtggatctcttgagcccaggagttcaagaccagcctgggcaacatggcgaaaacccatctctactaaaaatacaaaaattagccaggcctggtggcacacacctgtagtcccaactacaggtgcgggaggatcacctgagcctggagaggtcaacactgcggtgagcggtgatcacgccactggactccagcctgggtgactgagaccctgtgtcaaactgaagtgcttaaaagtatgaggaatgtggccgggcacggtggctcacgcctttaatcccagcactttgggagggtgaggtgggtgggtcacctggggtcggagttcgagacgagcctgaccaacacagagaaatcctgtctctactaaaaatacaaaattagccgggcgtggtggcacgtgcctgtaatcccagctactcaggaggctgaagcaggagaatcgcttgaacccgggaggcagaggttgcagtaagctgagatcgcgccgctgcactccagcctgggcaaccagagcgaaagtccatcttttttttttttttttttgagacggagtctcgctctgtcgcccaagctggaatgcagtggtgcgatcttggctcactgcaagctccacctcccgggttcacgccattctcctgcctcagcctcccgagcagctgggactacaggtgcccaccaccacgctgggctaattttttgtatttttagtagagatggggtttcatcatgttagccaggatggtctcgatctcctgacctcgtgatccgcccgcctccgcctcccaaagtgctgggattataggcgtgagccaccgcgcccggcccgaaagtccatcttaaaaaaaaaaaaaaaagtatgaggaatgctcaggccaattatggagtgaaagctggtaaccagatgcttaacgggaagattgggatattggagcaccaaggctacttatgacatgagggcgtttaccaatattaaacctgcaagtttcagcttgtcaaccacacagggcaagagggacacaagtgaaaatctagggcctccccaggtggggagccatatagcagatctcctcacattaagctgagccccaaagggtgttgccctcaagtctaatgtgaaatgaatccactgcacaacccacaccaccagcccctaggaactacagaaaaggctgccttggtgctaagcagaacagctgaaggagaaggaaagaggaattttttttttaaagctcttccttaggaagttgtgatcattgatgagtttttttgtaccccagggagtagagcctgatataatagatcaagaaagctcaagctatgaactgggaacctggtttgagatgataaccgagtagatgtgctctccaaacccttggcaaaaaggaaatacaggccgggcacagtggctcgcgcctgtaatcccagcactttgggaggctgaggcaggtggatcacctgaggtcgggagttcgagaccagcttggccaacatggtgaaacctcatctctactaaaaatacaaaaattagctgggcatggtggtgcgcgcctgtagtcccagtcacacaggaggctgaggcaggagaatcgcttgaacccgggaggcagaggttgcagtgagccgagatcatgccactgcactccagcctgccaacagagcaagacttcgtctcaaaaagaaaaaaaagaagaaaaaaaaaagcaaaaattagcccagcatggtggcaggcacctgtagtcccagctactcgggaggctgaggcatgagaatcacttgaactcagaagacgaagggtgcagtgagccaagatggcaccactgcactccagcgtgggcgacagagcaagactccatctcaaaaaaaaaaaaaattgtgctcacgaaatttaaaacttaaaaaaatcaatattgggagcaaaaaactatttatttcatggcagatttgaaaaggaaccaaacagaatttctagaaatctacttctactgctcccatgaggagtcagtcacaaagtcctgacatacggcccggcatcagaaggtgtttcgaaactatttggtttggcaagttcttcctgggtgctctcttttgctaagtactttctcacatagttgaataagtttctgccctcaaggggccctgcagggtgctaaggatagagttgcaataatggggacgcttattatctggtgacctttttaattttacgtaactctgagttcctcagtgcagggcctgtttgttcacctttgcccagtaagcacttacagagagtacagtactgagtactgcctgtgggccagggattgtttcctgagtgctttcttttctttctttctttctttttttttttttctttgagacacagtcttgctctgtcacgcaggctggagtgcagtgtggcgtgatcttggctcactgcaacctccgcctcccaggttcaagccattctgctgcctcagcctcctgagtagctgcgattacaggcacccaccaccacgcccagctaatttttgtatttttagtagaaatgaggtttcaccatgttgatcaggccggtcttgaactcctgacctcaagtgatcctcccgcctggacctcctaaagtcaccgcgcctggccctaacctttttttttttttgagacaagagtcttgctctgttgcgcccaggctggagtgcagtggcgcaatctcggctcaccgcaacctctgcctctcaggttcaagtgattctcctgcctcagcctccctagtagctgggattacaggtgcccgtcaccatgtccagctaattttttttttttgtatttttagtagagatagggtttcactgtgttggcctggctggtcttgaactcctgaccttgccaaactccaaggcccacctcagcctctcaaagtgctgggattacaagcctgagccactgtgcctggccggacctcgtttaaccttaattagctctttatttatttatttatttatttattatttgagacagaatcttgctctgtcacccaggctggactgcagtggcgcatctgcctcccgggttcaagtgattctcttgcctcaacctcccgagtaactgcgattacaggtgcgcgccaccatgcccagctaatttttgtacttttagtagaaacagggtttcaccatgttggccaggctggtcttgaactcccgacctcagctaatccacccacctcagcctcccaaagtgctgggattacaagcatgagccatcgcacccggccccttaattagctctttaaagactcaggttacagttacattctgaggtactaggggctaggacatcaacgtatgaattttgtggggaagacacaattcaatccataacagccacatgctttgctgcttactaccaacaccaaccaacctaacaagatgtcaggacccagcattgccttgtgtgtcagcacattcttccccttgtagctgggagtctgatttaagcatgagattcttccctccccacagagaagttaatttttctggggtggctggagcactcactgtggagtgggacactggacgtttcccactctccctcctccctgcttgaccccttgcctggaattattacattacctaccccaggagtctctaagctgtgattggattctgttcggtgccaaccaggtagccccaagggaactggacatgtgactgataagtgtttggtggatgaagagatgccagtaaggggtggaaagtttggagtgggggcagcctgactggggagcctgccagaggtggggctctacctccctgaaactcattcagttccatcggtcaagccttcagtgaagcatttcccaagttgcctctgtgccaagccctggggtccaatttgtgtgtgtgggggtggtggtggggttcttttttgagatgaagtcttgctctgtagcccagatctcagctacaggtagctgagacaacaggtatactacaggcatatgtggctcatatctcagcttgctgcaacctctgcctcttgggttcaagcgattctcctgccccagcctcccaagtagctgggattacaggcatgcgccatcatgcctggctaatttttgtatttttagtagagacacagtttgagacaagagtcttgtctggtcttgaactcctgacctcaggtgatctgcccacctgggcctcccaaagtgctgggattacaggtgtgagccatggcgcatggccaagctcctattgttgcaggcgtttcagcaggagagaacagcatatgcaatatgcatctatgcaacagcatagatgaaaatctactctgcatatgcacctggtggtatggaaatatatgggaagctggccaggcacagtggctcacatctgtaatcccagcactttgggaggccgaagtgggtggatcacgaggtcagatcgagaccattctggctcacacagtgaaaccccgtctctactgaaaatacaaatacccatacatcacttattactctcagctgcccctttacagttcttggcctcttttcattttggcctcagggcctttgcacttgttggtctctctgcctttctcttctcttttcacattgctgactccagcttatttctcaggcccacttcctcagacagactccccctgaccattctgtctaaaagtagcttcccctctttctggaaaaaaagtatttaaagtcatagaaaatttctctctttctctttttttttccccttgtttacagcccatctcacctagctagactaagactccatgaaggcaaggatttttgtcttttggttcatgcctgcatccgcagcatctagaatggtgtctagcacacagtaggtgctcaacaaatattttgaaagtaatcaaataaatgtgaacatattcatttcttatttgaataataaaactaaaacaggccgggcgtggtggctcacgcctataatcccagcactttgggaagctgaagcaggcaattgcctgagctcaggagttcgaggccagcctggccaacatggtgaaacactgtctctgcaaaaaatacaaaaattagctgggcatggtggcaggcacctgtagtctaagatacttgagaggctgaggcacgagaatctcttgaacccgggaggtggaggttgcagtgagcagagattggccactgcattccagcctgggcaacacaacatgactctgtctcaaaaaacaaaaaataataaataaataaataaaacaaaaacaataggtatactttgcaggctttggtgatgcagacaaacaaagaatagttatatggagaaacttgcaggggagaggggagaatctgaggccattggatcagtgagcatgttagagacagggaggaaggaaccctgactttaccctgccagcaaggcaatggaagggggcgctcacagcttggggtgtgcccttcaagattcccaggaaggtaggtggggtgtggtgtcttggagaagagtggatttcctcttttttctttttctcctttttgtggagaatggggtctcactgtgttgccccagctggtcttgaactcctaggctcaagcgatcctccagcctctgcctccctaaatgctgggatgacaggcttgagccactgcccctggcaggttgggttttctgtggggaacatttgctcagggctcactgtgcaggggggaatgggaagggaaatggaggtaagggggtagcagtggtgtgcacaggggtggtgttcagggaagtacaaggagttcaccggcagaaatgggccttgagggggtaaataggcagagagtctgtgaggctattctgtgaaagggccatatatacaaagtggtccccaaatgccaacggagccaaaaaaccaaggaatgaggcagacaaattcagtttgtcagtaaagggtgttttaatgggggatcttaaaagcagcatgggcttgggcggcagcaagacaggagatctctccctctgttaccccaagacttaggccttatattccacagggaaagagttttaagtgctctctgcaagacaattaaaggaaacttccagagcagacaagaatgctgtatgtttcatagcttataatttatgcaataacatcagggcggcatatagcttataatttgtgcaataacatcaggctgactagggacagtaaataaagtaggaatcaggaggcattcacgggactggggctaatcagaagtcaacatgggggattagcatccaagatggagtcacttttgtctccacagagacaacttgtcaggaacagtggctagcagggttccccaaggggagaggaactttgaaaaaacaattttaaaaaattgtagttcacaggtctcaaactcctgggctcatgcagtcctcctgccttggcctctcaaagtgctaggcttagagcagtgcgccaccatgcccagctgcaaacaaataatttttaattgtaggagttatatagtgaatacaagaaaatgaaaattatgatatttgttatttatttagctgaggctaaaataggtattttagtaaaaccaatgagaacatttagagtccaatccatggttgtcccgttgtatgacgatgtggccatgatcatgggagagattcatgattgatggtgacaaagattctttgcttgctgtaactgcttggtcagactttggaatcttctgctaggcccacctgtgcacttctttgtaaaatctagttttcacaaagaatgctttaagtcagtttagcaggaacccccatccttaatatttaatcatcctagatatctgatcaggttcctcatctgtcaccatctcctaggtgatgttgattaccctagcccatcttcagcaagaatcctgttaggtcggtttagccagaattccccttacctccgatgtttcctcttggtaattttctatcaactgacctccctacccccagcccccatgatgttcctcggctataaattcccacttgcctatgctgtattcagagttgagcccagtctctctcccccactgcaaggcccctttgtagtggtacctatcgcagtagttctgaataaagccttccttattgtgtttgtgttttagcaaagatcattgaacaattttttttctttttttttttttttttttgagacagggtctcattctgtcacccgggctggcatgcagtgacatgatcatggctcactgcagctttgacttctctggctcaagaaatcctctcacctcagcatccctacctagtagctgggattataggtatgtgccacatacctggctaatatttttaaaaatcatttgtggagatgctggtctgactatgttacctgggctggtctccaatttctgggctcaagcaatcctcccgccacctcagcctcccaaagtgctgggattacagaggagccaccacacccaggtaaataattttttctttttctttttttttttaaatttgagatggagttttgcttttgttgtccaggctggagtgcagtggcgtgatctcggctcaccgcaaccttcgcctcccgggttcaagcaattatcctgcctcagcctcccgagtagctgggattataggcatgtgccaccatggccacctaattttatttatttattgtttttaagtagagacggggtttctccatgttggtcaggctggtctcaaactcccgacttcaggtgatctgcccaccttggcctcccaaagtgctgggattacaggcgtgagccactgtgcccggcctaattttttctttaacaatagccccttccttagtttccccctcccctctatgcactccctaaactcttgcttgtttcccaagggtactttgaaaccactatcacacattgattattgagaaagggtctcactctgttgcctaggcttgagtgcagtggtgagatcatagcccactgcagcctctacttcctaggcttaagcaattctcctgcctcagcctcctgagtagctggtactcaagtgcaaaccaccatgcccagctacttttgttgttgttgttgagacggggtctcactatgttgctcagacaggtctcaaactcctggatacaaatgatcctccagcctcagcctcccaaagtgctgggattacaggtgtgaaccactgtggccggcatacacattgtaattaaataacctttaagatttaatgtcggtctttttttttttttttgagacagagtcttgctctgtcgctaggctggagtctgtggcacgatctcggctcactgcaacctctgactccctggttcaagcaattctcctgcctcagcctcccaagtaactgggattacaggcacgtgccaccatgcccagataatttttatatttttagtagagacggggtttcactaggttggccaggatggtctcgaactcctgacctcgtgatccgcctgcctcggcctcccaaagtgctgggattacaggcatgagccgccgcgcctggcctaatgtcggtctttcttcccacctctaactccatgggaaaggaccaccatgtctctagagctattacgggacttggtgcatagcaggccgttaataagcagttgatggaggatgaatgaagatgagaggggtctgtgtgtgtaggggaagtcccagtgaggagcacctctcattctgtgagacctggataggacccctcggaggctgggctaggagtggctggggtgggtgttgggggtttatgtgacagaaatggggtcccaacaagcagggatggagggtgaagagatggagttacttaagagataatgggatccccagcacggagacccacgcctgtaatcccagtgctttgggaggccgagacgtgaggatcgctggaggccagaagttgacaccagcctggacaaaatagtgagaccctgatctctacaaaaaaataaaaataaaaattagtaggacatggtggcgtgtgccggtagtccccgctactctggaggctgaggcgggctcccaacaggcagagttgagcagggtagtaggggcgggaagtctctaataggggatgagggatgggaatctatgttgtacagcctggagatccctgtgacagttgggtggtctgggtgagatgggataggggtcatggtttgttgcagagtcggggtatactgtgctcagcggaaatggggtccgtgcagcagacctggaggactcacgtgctgtgggaatgggggattctgtgtcagagctggggggtcgggtccggtgagatggggatgcggatttagataatagggatgggaagttccgcgtgtgcggcggatataaggtcggtgtagacttggtcgttcaagtgaggcggggtccacactcggtggcccggtgactgggttatcgagtggagccagggcagcccagagatgctggggtcccgcgagcctaggttgggtttccagggctgggggctcggcggcggctcctgggcgccccctggcggccccgactcaaccgccacggctcccacaatgctcgcgtagccgggcttcggttcctgtggcggcgacggcggcggctccaagatggcgcaggcgatctttgaggccctggagggtgagcggcggcggggccggcggaggcggctgttccgcgctgcgccccctcccgccgcgccctcgcagcgcccggcctagggcgcgcagcggccgcggggcggagggcgccggggctggaacagccgcggggcgggaggggcgcgggcgggaacagcgcgggagccgaggcccggcgggggagctccggggccggaacagccggggagagccaggccggcggggagggggctcgggtccggaacagcgccagcctgggcggccttgggcgggcgcgggaggggctccctgcagggaactgcgcgggaggcgacggcggggcggtctggaacagccgcggccagggaggcggcttggcggcgcgcggggcccgggacgggggtgcggtcgcagctgcgggcaggagggcctcggcggcctgaccacgaagaacttctgcggagcggactgtatgcctcgtgctaggacgtagtctcaaaatcagaccacagcagcagaggcgccacctgtgtgcacagcctggactcagagcttagggacccaagccagcaaacacctggcgcctgcagtgcgcaccgtggccggtgcagttttacaaattaaactgacaccgtgggtgctggcgcggtgtgcccggccgggacgcggtgttcccagacccaggccagcaaacgctgggtgccgacagactgttccgtgctctgcaagaacctgggatggggttggtgctcaggctcaaaactgtgggctttggagacagcaaacactgagcacctccatgtgtgcatctgctgggcgtcggggaggaagggcagccttagcgactcggggccatggcgcagaatagatattgtgggaaatacagaccaagaatggtcttggaggagtgggatgagatgagtatacagatagggtgcaaactcgaagtactggactggcgggatgaagctgaagctttgagtcctgcagcttcctaggagatctcagccactccctgcactttttaattttttgagacggagtctcactctgtcgcccaggctggagtgcagtggcgcgatctcggctcactgcaacctccccctcccaggtttgagcgattctcgtgcctccgcctcctgagtagctgggactataggcgtgcaccaccacacccggctaatttccttttttttttttttttttgagacagagtcttgctctgttgcccaggctggagtgcagtggagcgatctcggctcactgcaacctccgcttcccggggttcacgccattcttctgcttcttctgcctcagcctcgagagcagctgagactacaggcatccgccaccacgcccggctaatttttttttttttttgtattttaagtagagacggggtttcaccgtgttagcgagcatggactcgatctcgtgacctcgtgatccgcccgccttggcctcccaaagtgctgggattacaggcgtgagccaccgcgcccggccatttttttgtatttttaatagagacggagtttcaccatgttggccagattggtcttgaactcctggcctcaagtgatctgcccgcctcagcctcccaaagtgctgggattacaggcgtgagcgactgctccaggactcccttcacttcttgaaggatcacaattcgcaccaggaaatggggggcggggtagccctgtctccatctagtggggttccgattcaaagactgactgagacagacactccctgtagtttctgccctgcagtctggtagaggagagaaattataaaacaagcaattatagaaattatagaattatggaaaaggtcatgtagaataagatgacctcagctggccattcctactgtgaataacataagcaggaggtggtggatcaggaaggccgaggtcagtggtagttccctcccagaggccaatagaatggggtgaggcttactttctctttaggctgtttggacttcctcattgtttgaatatttactgcaagaatgtgtttgtgtattgagtaatgaagacagttaaagagaaatcagttcctaggacagtgggatgcatgttgggtgaagaaagggcagcaggactgtggagatctaggggaggagggcaggagaatggcccaggcagcaggaactgcattttcaaagccctggggagaaaggtctcctgggattcacagaagctgggtgtgggtgaactgctagagatggggtttgatggagcagctaaactttatcttgggatcagtgtggagctaacaaaaggttttcagcaggggagcagcacaatgtgatgtatgttttataaagttcaccctagctgctctggaacagactggagggggccagagtggcagtggggggtcggggtggaggctgctgaggttgtacagcagagaactgggctggtaaacaactgtggggatggaaagacagtttatttgagatgtattggggagacagaataggctagacttgcagaagaaccagaaatggggagtggggagggggagcagtgggttgagggaagacccaagtggtgccgccccagagggtgccctggtgccctgttctccttgatgaggattactggaagaacaaactttggggtggaggatgacatttaattcaagttcagttttacacaggctgccttttttttgtttttgagacagcatctcacactgtctcccaggctgaagtgcagtggtgcaatcttggctcaatgcagcctccacctcctgggttcaagtgattcttgtacctcagcctcccgagtagctgagactacaggcacatgccaccacgtctggctaatttttgtatttttaatagagaagggggtttcaccatgttggccaggctggtctcaaactcctgacctcaagtgatccacccatctctgcctcccaaagtgctgggattacaggcatgagccactgagcctggcccaggctgcctttttaatttaatttaacttaattttttatttttttgtgacactctcactctgtcacccaagctggactggggtggtgcgatcttggctcactgcaacctctgcctcccaggttcaagcgattctcctgcctcagcctcttgagtagctgggattacaggcgcttaccaccacgcctgactaattttgtattttttagtagagacggggtttcaccatgttggccaggctagtctcgaactcttgacctcaagtgatctgcccgccttggcctccaaagtgatgggattgcaggcgtgaggcactgtgtccagccagccttttttatttttatttgtagagacaggatctcactctgtctccaaagctggagtgcagtagtgcattcatagctcactgcagcctcaaactcctgggctcaagtgatcctcccacctcagcctcccaggtgcgtgccaggacacccagccaattttttaaattttctagagatgaggtcttgctatgttgcccaggttgatcttgaactcctagcatcaagcagtcctcctgcattgacttcccaaagtgttaggattacaggcatgaggcactgtacccaccctgcatttgtttaaatttttttattttgaaatcactttttctgtagattcacatgcagttgtgggaaatgataaagagagatcccacgtgtccttgaccccatttcccctggtgtaacattttgcacaactacagtgtgttaccaccagtcaacatacagaacaggggcatcactccaaggagttgcccttttatagccacaccctaaatcctccccttctcccaccatccttgatgcctggcaaccactaatctgtctccatttgtaaaattttgtgatttcaagaatactatataaatgaaatcataaagtgtataccattgagatgggcttttttcacccgtcataattccctagtgattcatccaagttgttgtgtatagcaatagtttgttcctttttattgcttagtagtattccatagtatggctatttcaccatttaaccactcactgaagaacatctgaactgtttccagtttttactatttttttttttagaccctgtctcaaaaaaaaaaaaaagtaaaaactggaaacagttcagatgttcttctgaaccatttcctacaccctctatctcctctactaccttctggccctcctcccccactctagtggggcttaagccccccaccattctgaaactgcctctgcaaaaattgtaacagtgagaaaatcatgacagagaaagacgcctgacctaaccaatccctaccttgcctttaacctccaaactgcccttagtcatccccgggcttgggccaagctaacttcggcagaaatttaatttacagtttaaatgataatagcccttccccaaaactaaactgtctttgtaaagctattgaaagaccaccaggttttcacctgggcaacatggggagattccatctcaaagtgttcactgttgcccaggctggagtgcagtggcatgatcttggctcactgcaacctccacatcccaagttcaagcgattctcctgcctcagcctcccgagtagctgggactacaggtgcgtgcctccacacccagctaattttttctatttttagtagggacgggtttcaccatgttgcccaggctaaattttttactgttatacctaaaagtgctatgaacatttgtatacagatttgcacacaaatgctaaaacactcacaattttgcataaaatggtagaagattcactgaagcttgttcaggagagcttgaaccccaggcttgaaactccagatattggaaggaagtagactggggtgagtgagactgcccagggacagcatgagaggcagaggtgagagagtccagacaaaggaacaaaggacaaagtgtttcctcaaaatggaaacacttagggggtggccaggagaagagagtaaaggaggcacagaaaggtagagaagacccaggaaggctgtgccctggagccaagaacagagtgtttcagggagtggcaggtgctgccagatggtctttggtgatgatggggaaagtgttttggtggaactgtaaccatccaatgggttcattttgcctgctgcccagatacagccaatttatcaagacaggggaattgcgacagagaaaaagttacattcacacagagccagctgaacaggagactggaattgtgttattactcaaatcagcctcctagaaaattcagagactaggttttttatttttatttatttatttattttttattttttattttttgagacgtagtctcgctctgttgcccaggctggagtgcaatggcgtgatctcacctcactgcaacctccgcctcctgggttcacgccattctcctgcctcagcctcccaagtagctgggactgcaggcacctgccaccatgcccggctaattttttatatttttagtaaggatggggttttaccgtattagccaggatggtcttgatctcctgacctcatgatctgcccaccttggcctcccaaaatgctgggattacaggcgtgagccaccatgcccagccagacactaggttttttcaaagatagtttgggggacaagggaatgggtgctgttgattggttggaggtgcaatcatagagttgtggaaaatggtcctcctacatgcagagtctgcttctgggtggggctgcaggactcattggcgagtctacgtggagccattggttgtcagaaatgcaaaaatctgaaaagatatctcaaaaggctaatcttaggttctataataatgatgttggggccaggtgcggtggctcacacctgtaaccccagcactttgggaggtcaaggcgggcagatcacctgaggtcaggagtttgagaccagcctgaccaacatggagaaaccctgtcattactaaaagtacaaaattagccaggcatgggggcgtgtgcctataatcccagctactcgggaggctgaggcaggaaagttgcttgaacccgggagacagaggttgcagtgagccaagattgcgccattgcactccagcctgggcaacaagagtgaaactccatctcaaaaaaaaaaaaaaaagttggccaggcgtggtggctcatgcctgtattcccagcactttgggaggccaaggtgggaggatcccttgagtgcaagagtttgagactgtcctgggcaacatagggagattctatctcaaaataataataatgataataatattatatgcaggagtaattggggaagttgcaaatcttgtgatctctggaataatggctggtaatatttatgtctacaccttaccagaatgtaggttcctcttatcctcctaacctcatggtctttcattagcttcacaaaggagggttagttttggggaagggctattatcatttaaactgtaaactaaatttctccctagttatcttggcccaagcccagggattactaagggcagtttggaggttaaaggcaagatgggggttcgttaggtcaggtgtctttcactgtcatgattttctcactttgcaactttttcaaaggtggttccagatagtggagggcttaagtcccactagagtggggaaggagaactggaaggtggtagaagagatagagggtgtaggtgaccctcatgggatacttgccattgaagggaggagagatggaaacatgaatttgcaggagggcactctggagagactgatcgtgtgtagctgtggatggttcccaggcacagtgtggtgagagttggtggagagtggcttctgaggagcaggaggagatggaggggagggctgcgctggcagcgtcaggagggacacagcctgcattgtgacaagggaaggcatggattcagtttggctgcagtagctgatggtttcaattttttattttattttattttatttttgagacggagtctcactctgtcacccaggctggagtgcagtggcgccatctccgctcactgcaacctccacctcccgggttcaagcagttctctgcctcagcctccctagtagctgggattacaggcacccaccaccatgcccagctaatttttgtatttttagtagagatggggtttcaccatcttggccaggctagtcttgaattcctaacctcgtgattcacccgcccctgcctcccaaagtgctggaattacaggcgtgagccaccatgcccggccagagataactggtctgatggtttcaatttgcattgcagttagaagctggggaagacatcccagtaaaagctgagaggttggaggcagagcatcggctgtggggtcatagagaggaggcaccatctgggtcttttgggagtggcacagtgtgccttggtggccactgagatgtgaggaggcctgtcatccggctagtgacatggccagacagtgtactactgtgaacttcaactgtgataactgattagaaaacatggaagaagtcagtttctcgatcccccagccaccaattcagagtctattgtttattgcagaacaaaaaagatagacacacattgagaaataaggaaggcaaggacgcccgcgtgcacacagatttgtggggtttggggagtgtgcatgaggaaaactggctaacgtgatttctggagggactttgtcacctaggattagcgtcagccatgagtaagacaggccccacgtcacagtggcttcaacaggctggaaggttatttctttcacatgaaagtccagaggaaggcagtctaagataggaagatggctgtgttctacaaggttctcagaggcccaggatttatccagcttttttttttgagacagagtttcgctcttgttgcccaggctggagtgcagtggcaggatctcagctcactgcaacctctgcctcctgggtccaagtgattctcctgcctcagtctcccaagtagttgggattacaggcacacaccaccacgcccagctaattttgtatttttagtagagacagggtctcaccatgttggccaggatggtctcgaactcctgacctcaggtgctctgcccgccttggccacccagagtgttgggattacaggcgtgagccactgcgcctggctccatccagctttttatcctacgatcctaaggttgtccttatgatccaggatggtggattgagttgctaccaccatattcttattctgggaagtggaaaggaggatgggacaaagaagagggtcacatatcaggcagttttaagaaaactttccagaagctgccacatagcacatttacattcctttggccagaacttagtcattccctaactgtaagagagcctgggaagtgtaacctttatttgggggccatctttgcagcccaaaatcttgggctctctcacaatggaaatagaagagaatgtatattggggcatagccggccatccttgccatggggttttgtcttgcttgagacagggtcttgctctgtcaagagcaagtacagtggagtgaggtgatatgatcatggctcactgtacccttgaccatccaggctcaagcagtcctcccgcctcagcctccctagtagctgggaccacaggcatgcaccaccaagcctacctaaattttgtatttttttgtagaggtggagtctcactatgttgctgcctagaatggtcttaaactcctgggctcaagcgatctcccaccttagcctcccatggtgctgggattacaggtctgagccaccgtacccagccgccacaggggttttgcctgggtctggcttgtaagggtgatgtcagagcatgatgctgggcctaccttccaaagaggctgcacttcttttttcaggaatggacaatcagaccgttctggctgtccagtcattattggatggccaaggagcagtccctgatccgacaggccagagtgtcaatgcgccccctgctatccagccattgggtgagtatctgctcaggttcaccggtgggagagtgaatggctccccgcgaagagtaggtggagcttgtgctgggctgtgggagtgaaatgcttgctgtggtccccaggacatgctctggtgtctgaaccctctcccccgcctcccagccgggatctttgggctcacggctttctctgcttagctctgaggacactgctctcaattgcttagtaaatgtggggagatgggatcaagatgcagggaatggctaagggccccaatgcctgacaacaatgcctgtgcctttgccctggaagtgattattcagcctcccttctgtggaaagaataggctgagcatgaattgctcctgtttactgggccaggcctgtaagggtcttcttttttttttttttcttttttttctttttgagacagagtgttactctgtcctccaggctggagtgcagggcacgatcttggctcactgcaacctccacctcctaggttcaagcaattctcatacctcagcctcctgcgtagctgggattacaggcgtgcgccaccacgcctggctaattttttgtatttttaatagagatggggtttcaccatgttggccaggctggtctcaaacgcctgacctaaggtgatctgctcacctcagcctcctaaagtgctgggattacctgcatgagccactgcacctggcctgtaagggccttcttttggaagtttctatgtgagactgtgttcatttattcattccacaaacatttttgtgtacttgggaatcacactaggggcagggagataaatggctgggtttgaattattgttcttatagttcttagctctgtgaccgtgggcaagtgagtgaatttctctgtggttcagttcctacacctgtaaaatagggacaattgttctgcctcataggaatcttatgagagtacttgggatttggttctagctgttgaagtttaccatggtttctacaagattaaagtttgtttctgtgttacgcgaagtcctgatgggcatttgggcatttggggtgggcatggtgagactcagactccttctttcctgtggctctactgccctcgagctgcagcccgggatggctgctctagctcccactttgattggcacattccagccaacatgaagggaagaaagagggaagtggaattcataccctttcgttttgttttgtttttgagatggagtcttgctctgtcgcccaggctggagtgcagtggcgcgatctcggctcactgcaacctccgcctcccgggttcaagcaatcctcctgcctcagcctcctgagtagctgggattacaggtgcccgccaccatgcccagctaatttttgtatttttagtagagatggggtttcaccacgttggtcaggctggtctcaaaccccctgacctcatgatcacccgcctcggcctcccaaagtgctgggattgcaggcgtgagccacaccgcccggccaagtcgagacaggatttcatcatgttggcctggctggtctcgaactcctgacctcaggtgatccacccacttcagcttcccaaagtgcagagattacaggcgtgaaccaccatgcctggccaaaaaacttctctttaattaaaaaaaaaaaatagagatagggtctctctgtgctgcccaggctggtcttgaactcctgagctcaagcaatcctcccacctcagcctgccaatgtactgggattgcaggcatgagccacagtgccctgtccatgccctttccttttccttttatgaggaagttgcagatacggtacagttctattgttgtcccattggtgagaattctgtcacatgacattcctagctgcagagaagcctgggaaatatattatttaactatgaagccatgtttcccactgaaatttgtattattgtataagaaggatacgagttgagagtggtgtgcactatgatcatgcctgtgaatagccactgtgctgcagcctgggcaacacaacaggaccctgtctctctctttttttttttttttttgagacggagttttgctcatgttgcccaggctggagtgcaatggcatgatcttggcttactgctacctctgtctcctgggttcaagtgattctcctgcttcagcctcctgagtagctgggactacaggcacctgccaccacacccggctaatttttgtatttttggtagagacggggtttcgccatgttggccaggctggtctcgaactcgtgaccctcaggtgatccgcctgcctcagcctcacaaactgctgggattacaggcgtgagccaccgcaccctgcccaatttttttttttttttttttttttgagacagagtcttgctctgttgcccaggctggagtgcagtggtgtgatctcgctcactgcaacctccacctcctgggtttaagcaattctcctgcctcagcctcctgagtagctgagattacaggcatgcaccatcatgcccagctaattttgtatttttaggagagctggggtttcaccatgttggccaggctggtcatgaattcctgacctcaagtgatccacccaccttggcctcccaaagtgctaggattacaggtgtgagtgagccacctcgcctggcaacccgtctcttaaaaaaataaataaataaaaaaggatacaattagaattgaataacaattagacatttctgctaccacatgttgggtgcttgacacagtgagcgcatagctgtggtaggccctcagcaatggatggtgttaactgtagttaatcattcatttagtttttcattcattcaacaaacgtccattgagaacctcctctgtgtccaggagatattgtagttatggtgataaataagacacatgtccttcccttaggggactcacagtctggtgttgataagaaaactgttatatgataggtgtgccagaggaaggaactatagccgctggctttagaaaaacttcctggagaggtcggtgcagtggctcacgcctgtaatcccagcactttgggaggctgaggtgagtggatcccttgaggtcaggaagttcgagaccagcctggtcaacgtggtgaaaccccgtctctactaaaaatacaaaaattagccgggcgtggtggcgcatgcctgtaatcccagctactggggtggctgaggcaggagaatcgcatgaatatgggaggcagaggttgcagagagctgagattgtgccactgcaccccagcctgggcagcaagagtgaaactctctctcagaaagaaaaaaaaaaaaagaaaagaaaaggaaagaaaaagaaaaaaagacttcttggaagaggtgacagtcaagctgaggcttgcagaacaagttgtcctcagagaggcagcctggcagggcgaacggtggatgcaaaggcatgggaggagtatgatcaggtggctcatttggggactgatgaataaattcagacaggataaaggttctggagttctcaactttgtagtgaacatactttactgttttttgatttctaattaattggtacctggccacatatggctatccctgcaggaaactgtgtggttttttttcttttttttgagatggagtctcgctctgttgcccaggctggagtgcagtggcacgatctgggctcactgcaacctctgcctcctgggttcaagcaattctcctgcctcagcctcccgagtagctgggactataggcgcgcaccaccatgcccagctaatttttgtatttttagtggagatggggtttcgccatgttgtccaggctgatcttgaactcctgacctcaggtgatccaccctccaaggcctcgcaaagtgctgggattacaggcatgagccactgtgcctggccacctgtgtggcttcgaaaactcccaggaagcacatagttgatggctgacacctgcatgtcaagtcgcagcatgccccccagattgctgcttgtggtcagctgcagttctcctgtctcatactgtgatgccccttgacatagtcttgcttttttttcattactttaccttcatctgtggcctcttcccactactctgcgggtatgaccccagatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccaggtatttgttcatttattcattcaacatgtcttttttgagggcctaacatgctcaggcactgtgctgggcactggggctatagcaatggataagacagaccaagtccctgcccttgtggagtggggcgagatggatggtgcacatgtactgttttcagcatgttaaatgcggagagataggggatgccagacggggatgggaggttttgccatattgtctatcgtgcttggggaagagctctgtgaagaggtgaccaggaagaatactatatagcaggtaaaaggttttgtatgaaaaatcaaattgtagaataataagtagataatatattattatttttaaaatctgaaacaatagtactatataatttccgcagttacttaaataagtaggaagaacataccagatagacctaaggaggtgtgggaatgagttatgcggctggtttggggaaggaagcaggagccaggtgcagggatcagcagatgcagaggccttgaggcaggagtgtgctgggtttgttccagaactataaggaggtgagagtggctgggactgagtaagtaggaaggtgggaggtgctaggagaggcagcaggagggtcttggcagatcgtgtagggtctgggcctttttttttttttttttttgagacggagtcttgctctgttgcccaggctggagtgcagtggcgccatctcggctcaccgcaagctccgcctcctgggttcacgccattctcctgcctcagcctcccaagtagctgggactacaggtgcccgccaccacaccaggctgatttttgtatttttagtagagacggggtttcaccatgttagccaggatggtctcaatctcctgacctcgtgatctgcccgcctcggcctcccaaagtgctgggattacaggcgtgagccaccgcgcccggccttttttttttttttttttttttgagacggagtttcactcttgttgcccaggatggagtgcagtggcaggatctcggctcactgcaacctccgcctcctgggttcaagtgattctcctgcctcagcctccagagtagctgggactacaggcgcgcaccaccacgcccagctgatttttgtatttttagtagagatggggtttcaccatgttggccaagatattctcgatctcctgaccttgtgatctccccgcctcggccgcccaaagtgccaggataacaagtgtgagccaccacacccagccgctggggcttttactgagaatgacatgggagccattggaggctgtcaagcagaggagggacatagtgacttttatcaggtcactctggctgctggacagagaataggttttgagggagggtgagagagaaagccaggagacccgttgagggactgtagtgcaaatccaggcagtggatgcgggtagcttgaccagcatgttggcagtggaggtggtgagaaagtgtgagattttagaaatactttgaaggtgttgctgatagaacttgtgaattgattgggtgaggagtgtgagatcaagaagggtcacagaggactcctgatttagagttgccactagctgaagggaggaggctgtgaggagaaggttttggggggatgtcaggagttcagctgggcacgttgaagttgagatgcctgccaacctttaaacggaggcagtgacaaagtagacaatgtagatttccaagtccggaggccagagcagaggacaaggctggaggcatctggggaagcttccagagtcctcagccgaaaacacggttctggagcaaagacaccctggatagggggctcatagaaagactaaaggatccctcataaaggaggctgggcatatctcaggatgccaggtcaaggggtcagattttcaactggcttccttttctttccttatccctttagaacattatcttcattcattgtataggtgtcatttctgccatcactatgaaagcattcaccccagacccataggacatatagactgaaacaggcatcttctggcataaaacagtcattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtggacccgggaggcggagcttgcagtgagccgaggtcccgccactgcactccagcctgggcgacagagcgagactccgtctcaaaaaaaaaaaaaaaaaaaaaaaaaaaacacagtcatttttctcactgcttgactgtgagttttgctagtagaaaatattcccctcaccatctcttacctttttttttttttttttgagacaaggtcttactgtcgctcaggctggccttggctcactgcaacctccatctgccaggttcaagtgattctcctgcctcagcctcctgagtagctgggactacagacacccgccaccatgcccagctaatttttgtatttttattggagatggggtttcactgttggccaggctggtctcgaactcctgacctcaagtgatccgcctgtcttggcctcccaaagtgctggaattacaggcatgagccaccgtgccacaccagatattcttcttgacctaagatacttgtggacttcatgtggacatgtgttcagtgtttctctagcatagatacaaggaagtatttttttttctcttgagatggagtctcactctgtcgccaggctggagtgcagtggcacgatctcagctcactgcaacctccatctcccaggttcaagcggttctcctgcctcagcctcctgagtagctgggactacaggcgcgcactaccacgcctagctactttttgtatttttagtagagatggggtttcaccacgttggccaggatggtctcgatctcttgacctcgtgatctgcccgcctcagcctcccaaagtgctgggattacaggcgtgagccaccatgcctggctgatacaaggaagtattattactgagtcatagggtatgtactttgcagagggatgtgagttattctcctcatttgttttttctttcattccgtttttgtttgtttgtttttagagacagagtctctaaaaccacaccagctgcgtgcaaaaccacaccggctaatttttgtatttttcttgtagagacagggtttcaccatgttgcccaggctggtcttgaactcctgggttcaagtgattcacctgcctcagcctcccaaaatgctgggattatagttgtgagccaccgtgcccagtcttatcatcctcattcagtagatgattaaatggaggcacagagaggtagagtgacttgcccagggtcacacagcagggagcagcagaggtagaaatggaatccacgtctgtgggattccagaacctggatcttttgtgccatgccctcggcttacttacagagcctgacatgtccacacatgcacacacgcacacatgagcacacacacactctgtctctctccgtctcactcattctctctctcccactgtccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcaggtaagaaggtgtgggcttctcacagggtcttgattccagacctgtacattaactcctgcagattcagaatcttgtagaataaagggggcctggccccagctctccctgatgctgagggaggctatcagctttcccttgtccagctctgctatagatggggaagctgctacgtctaggtggggacccagaacatgtggggctttgtcaatacagtgcagctattttgacttttttttttgagatggagtctcactctgttgcccaggctggagtgcagtggcacgatcttggctcactgcaacctctgcctcctgggttcaagtgattcttctgcctcagcctcctgagtagctgagattacaggcatgtgccaccacagccagctaatttttttttgtatttttagtagagacaggttttctccatgttgatcaggctgatcacgaactcttgacctcaagtgagccccccacctcagcctcctgaagtgctaggattacaggtgtgagccactgtgcccagccaatttttgtatttttaatggagacggggtttcaccatgttggccaggctggtctcaaactcctgacctcaggtgatcctcccaccttggcctcccaaagtgctgggattacaggattacaggtgtgagccactgcacccagcctgacttttgtttttgttctttttttttttttgagacagagtcttgctctgttgcccaggctgaagtgcagtggtgcgatcttggctccctgcaacttccacctcccaggtccaagcaattctcctgcctcaacctcctgagtagctgggattacaggtgtgcgccaccacgcccagctgatttttgtatttttagtagagatggggtttcactgtgttggtcaggctggtctcaaactcatgacctcaggtgatccacctgccttggcccaaagtgctgggatcacaggtgtgcgccaccgcgcccagccttgtttttattcttaacaagtgtcccatgtctattagaaaaatagaaaatgcacagtagctccctgggatttaaaaaaaaaatttttgtagagatgaccatctccctttgttgtccaggctgatcttgaactcctgggctcaagggatcctctagtgtcggcctctcaaagtgctgggattgtagacgtgagctactgcacctggccaggattttttaatacaaaaaagatctgtggccaaaggaacctaaggtggaggtgttttacttctccccttgctgtgtccctggattcttcctgccatatagaaatccttttgattttctcaaccgagactttttttttccctgtttgggaacccaacgaacacagtgaagaagaggaccccgtgtcctttatgaaatgctgatcagcatcacgtttttatttttgagacagcgtctcactcaggtcactcaggctggagtacagtggtaggatcatagctcactgtaacctcaaactccagggctcaagcaatcctccctgctcagcctcctgaggagctgggactacatacatggtgccaacatacttggctaattttaaaaaaaaatttttttttttttgagatggagtctcgctcttgtcacctaggctggagtgcagtggcaccatctcggctcactgcaatctccgcatcctgggttcaagcgattctcctgtctcagcctcctgagtagctggtattacaggcacccgccaccatgtctggctaatttttgtacttttagtagagacaaggttttgccatgttggccaggctggtcttgaactcctgacctcaggtgatctgcccaccttggcctcccaaagtcctgggattacaggcgtgagccaccgtgcctggcctaaaaaaatttttttttagagacagagtctcgctatgttacccaggctggtcttgaactcctgggctcaagcaatcctcctccctctgtctcccaaagtgctgggattacaggtgtgagccactgcacccagcagtaccatcattttaacaactgcaaaggattccaccatatggataggccatcttctgcttagccaagtttctatgtatagacatgtaggtcattgctgttttttgcttttatgaaaatggctggagtcactatccataaacagacatctttgcccacctgcttgattttttttgtagcataaatttctagaagttactggctgcgtttcacgactacccacacattcatgattctctcaaaagactcacgggactcagaggtagttgtactcatggctgtggtttattacagcaaaggaacacacagcaagatcagcaagggaaaaagacacatcaggtggaatctggaggaatccagagttctctgtcttggggaggtggggagaggttgcacaaaacacacttcttcctgcagcagtgaagtctagcaacatgtgtgctgtgtttctacccagggaaacacacttcagactccaaagccagggttttgtttgtttgtttgtttgtttgtttttctgagacagggtctcacttcagctgccctggctggagtgcagtggtgcaatttcggctcactgcaacctccacctccctgggctcaggtgattctcccacctcagcctcccaagtagctgggactacaggtgtgcaccactatgcctggctaatgtttttgtatttttagtagagatggggttttgccatgttgcccaggctggtctcaaactcctggactccacccgcctcagcctcccaaagtgttgagattacaggtgttagccgctgcaccaagcccaaggccagggtttctgttagggattggtcatgtaggtgaccagccaccatgaccaaaattccagactcccagaagagaaggaagtgttcaccatgaatcacatattttgtccaagcagtctacataatctggtacaatagaacagtgccccaggtgggcaaaataagccttatcaacaaaggagatgtcccacaaaccagattctcagatcccagtcacgagctagtgctgcaagcaagcccccccccctttttttttaattttataactttatttgaggtatttgatgatcagcgattagttctcatccacattgactgtctgtagatttttgaaagtggtaacaggtacataggtaaccaaagtatagagcttatttggtggatcttcatcctcataacattttctggacaaccgcacacggatgcagtatgggacattctttattcctttgtctcagacagctttgttgaggctggtatcaatgcacacatctggagttcccatctccttcatggcaagtttccgaatctctttgagtgcctgaggagcacgcttcttgaagccactccatggatgcacttgtgaatgttgatggtgtattctcaggtcaccacctcattgatggccgaatgaccctttttcttctcgccacccttctttctgggagccattctgctgggtccaagatggaaagggaagcccttcttaagatagcaacattaggctgctatattaactcttttctgcatgaatgaggtcatttttgcctattttcttttcttttttttttttttttttgagatggagtcttgctctgtcacccaggctaaagtgtggtggtgcaatctccactcactgccagctccgtctcccaggttcacaccattctcctgcctcagcctcccgatagctgggactacaggcgcccgccaccacgcccggctaattttttgtatttttagtagagacagggtttcaccattagccaaggttgtctcgatctcctgacctcgtgatccgcccgcctcagctcccaaagtgttgggattacaggcgtgagccactgcgcccggccatttttgcctactttcatagggaaaagggatagcagcaccaagctgaggcttccttcgaattctcccatgactttgtttccccaacctctcttagcccctctcctgagctgtctggtaagtagctgtttttccacctggctggctaaagcaaatgtccttccttcctgataaataagacaactggtatcaagaggctataacactttttcttttctgatttcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgagcagagggggcagggtggaagaggacactggtcatggacatcatggccaacccggacccatcctgagcaccagctgtgtgccagacactgtgctggggataccatgaaaaccagacccggtcctggccttcatggggtgtaccacatcacaggggagaaggactttaatcaaagcatcacacccacagatgtaagatgcaagccatgagaaggtggaatggagtacaggttgtagcagaaatataagctgcctgcaggtaatgctcagaacagtcagagaatgcctaccttttcaggcaaaaaaaagaaaaaagattcaaaaaaattatctgcctgagtgtctcttacagtttttaataagctaggtgtatcagttagctattgctgggtaagaaatatccatcaggcatcagtggcatataccaaaagtgtttattattcacgtgtttacagtggtcagctagacaactgcggatcttggctgggctcactcatatgtctgaacgttggctggctgtcagctgctctaggatggcctgggctgggacaagtggggtgactcagctctgttctgcgtgactctcatcctccactaggttctcatggccatggtggaggtgcaaaaatgcagacagaaatgcccaaggccttttgaggtttaggcttgtaagtaacacagaatcacttctattggccaaagcagatcacaagtccagcttagatagcgcaggtagggaaatagatgccacctcttgatgggaggaactgcagagtcacactgcaaaggcttgggtacagggaggggcaaagaattggtgccataatacaatcaatgtaccatactaattccctgccaatgagctctaagttataggccatctacttgaaatgcactgagttcatagaaccttccaagacaccagtgctagagggtatggttatgacagaaacaacccacctgcactagaaatcacactaactcagactcaccatagaatccagccacagacatcccctgtcaggtagtctctttatgtaaagagagcccagaccagtgggaagatcccaccacgaggcattcacgtgatgttctgaggggctgcgaggggatttgccctaccctgggagaatagaacaagcttctctagggaatttattgcattgagaaaaagttaagttagtgggatgctgagataatgctggtggcttgtggtagtcagaggggaccagcccagagaggaccagcacagaaggagctgctgctgttgattttccatgtagatgagggtatttgagggcagggtctgagtcttactagactttgcatccttagcacctagcagagcactcctagagtagatatcttacattggactgtctgacctcagtctgcgctcctctaaaatgggaactctcctgaaaagctgttgaggataataagagcctatgccagtggcagtcacattaattactcagtaatgccttgagtgatggctgaatttattcacgtgacaagtatttatttatttatttgagacagagtctcactctatcgcccaggttggagtgcagtggtgtgatctcggctcactgcaacctccacctctcaggttcaagcgattctcgtgcctcagcctcccaagtagctggtattacaggtatgagctaccacgcccaactaattttttttgtatttttagtagaaacgggtttcaccatgatggccaggctggtctcgaactcctggcctcaggtgatctgcctgccttggcctcccaaagtgctgggattacaggcatgagccaccacacccgtcccaacaagtatttattgagtgctgtattggtcagggtttggtcaggaaaatagaaaccaggcaaggtatttctgcagagggatgttttttcttttctaaattagagataggggtctcactttagcccaggttggtctccatctcctggcctcaagtgatcctctcacctcagcctcccagagtgctgggattacaggcatgagccaccatacccggccagattttataattttttttgtacctttttttcagctttgtctgattttattactccaactgtagctttctatttatttatatttgtctgaaatattttttcaactttgggctttttgctgagttgaattctttttttttttttttttttgagactgagtcttgctctgtcacccaggctggagtgcaatggcatgatcacggctcaccacagtctcgatctcccaggctcagatgattctcccacctcagcctcctgagtaactgggactacaggcatgcaccaccatgcccatctaatttttttaatgttttgtggagatgagatctccctatgttgcccaggctagtctcaaactcttgtgctcaagtgatcctccttcctcggcctgccaaagtgctggaattacaggcatgagccatcgtgcctggccagagattttggataggacacctcaggaagaccaatggatgatgaataggccaggcacaggggctcacgcctgtaatccctgcactttgggagcccgaggtgggtggatcacttaagctcaggagtttgagtccagcttgggcaacatggtgaaatcttgtctctacaaattacacaaaaattatctgggcatggtggtgtgtgcctgttatcccagctatttggtggggtgaggcgggagggttgcttgagcctgggaggtcaaggctgcagtgagccgagatcacatcattgcattccagcctggacaatagagcaagaaaaatctgaatgcctcagaattcatttggtaatttctcgtggcttcagttctcagtgaagagaagcctgctactctggcattgggtagtgtcagtcaggaagtggagcagctgggggagcacagacccctctgacttcctggttctctctctctcttttttttttttttttgagacagagtctcactccatcgcccaggctggagtgcagtggcgcgatctcggcccactgcaacctccgcctcccaggctcaagtgattctcctgccttagcctcctgagtagctgggattacaggcacacaccaccatgcctgacttaatttttgtatttttagtagagatggggtttcaccatgttggccaggctggtctcaaactcctgaccttaggtgatctgcccaccttggtctcccaaagtgctgggattacaggtgtgagccaccaggctcagccacctagttctcttaatgctagcaaagtaccactgataagaatagacagggcaaataataacagctaatgtgtattgcatgctcactctatgccagtcactgttctaagccctttatatgttgcttcatttaatcttcacagtaaccgcatgagaggggtactatgatgagtcccattttacagatgtggaaactgagacagagaaattaaaaagatgcctaaggtcacttcggtgctaagtggaagagtcaagatttgaatccaggcagcctggctccatagctgttctggcctcctggcttcatgaagttctaagggagcttgggagtggcttgggtgaccgggccaggtggaggggctgtgatggtgatgtaggggagagcggctgaggtcaatcagggaggcagggagagtgcccctggctgggagctcttccccttccctggcagggctttttccctgactgtgttgtcctcctaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaaggtgccaggggactcccggaaggtgggcccccagcctgccatgggcatctttcctcaacattggccaatccacaagctacttggttctggtcttcccttttatggttgttcaagtttggttgcatgtaatagaaaattcaaaatatcaatgacttcaaaatgatagaattttgtttctctcctgtgtaagtcaaggccagaagccagacaatctggggatcatgtgactgcatgggcaccaggcaccctcgtttcttctgtctttctgtttccaccacctccagaacatggtatcagttatcctggtgcctcattgtctaagatggctgctggagctccagtcatcactttaatattccaggcagtaagaagaagggaaagagaaggataaaaggggcttctcccagcttctagaagttctgtttgatatttttgctcatatctcattgatgaaaacttagtcacatggccatacctagctgcaagagaagctgggaagtgtctattttggctagggacattgatattcccattatgggatttgtgaggagtgaagaaggagagagtggatattaggcaagcagtagtatctgccatcctaatgcagatgctaagtatggggtgggaggtggtgtcagagcaggcagcagatggagaggatagaaattgagaatttttcagtggctttccagtcaactactcctccccttccttccttccacaatgatgtattgagcatctgtgtgccaggccccatgtcaggcactggaatctagtctcttggtctatgattccttctgccttcagtttaatggaagagacagacagggaataaataaataaatatttctgggttgctccaggaaggaggttaatgggtcttatgattgagaataactagggagaggctggaaaatgattctacctattcatgtgggaggagaaggaagcagccttgtgggtatctgtgggacaagcattccaggcaagggggaacagcaggtgcaaaggcccggaggcaggaacatgcttgaagtcttttaaggttagcaaggttagctaggagtccactgcagctggatggagagaatgatgaggttgtcaggagtaaggggatacagagtgctgtgggccatggcaaagagcgtggatttgattgtagggcagaggggagcctttgaaggattcatcttgctttcccagctggagcatgtcctgggctttcctctccaggccctgtgaagctctcccatgtctcctccctggcctgtgtatgggcatagacttccctggggtatggattgtctggctcagatacagtagtcagaggctgcccttggtgccctgagctgcacccccagcctcattgtcccctccttccacttgtctttcagctgcagggaagccaaaggctcagaaactcaagtgctcatactgtgacaagtcattcaccaaaaactttgacctgcagcagcacatccgaaggtacacatgcgtggtgaggcaggtggctcctgggcaggtgtggctgggaccatctgtgctggaagcgagactcccttctcagcccctagcctgtggggtgacccaggctgcacttgcatgttcaggctgtagtccaggtcgggtggttttccctcttctatctcagaggctgtgggagggacctgtgaaagctgtgggacctgcccatagagactgggaaggtcagggatgggccgtgtaggggaagaaaagcactgaacccagaggggtttcacagatgtgttagtgctgtcttaggcctcccctctgcagaacaggctggcctaccagggctgccatactctgcaaataggactctgtgagctctctgctcactccagactaaccatgcagggatcccttctgggccttggtttttccatctgtggaaggggaggctgggcttgttcatttctcacacagtgaaatgcactggtacatgagatgattttttttgagactgagtttcactcttgttgcccaggctggagtgcaatggtgcaatctcggctcactgcaacctctgactcctgggttcatgtgattccactgcctcagcctcccgagtagcttggattacaggcatgcgccaccacgcccggctaattttgtatttttggtagagatggggtttctccatgttggtcaggctggtcttgaactcccaacctcaggtgatccacccgcctcggcctcccaaagtactggaattacaggtgtgagccaccgtgcctggccgatgagatgatttttggtggttcatgaatatggggttgaaaagttctgaaaaatgtagtgggaaaattattccctttgcaatttcagtccttaggaagtcatagagaaaacctcaatttggtataattggtctttagcacctttggtatacatgctcgtctcttataacaaaaggagagagagagagagggagagagagagagagagggagagagagagaacaaacctcacattccagccatggctggcaacagcttctatctagaccagggtttttcagccttgccactactgacgttttggatcttggatcacatcattccttcctgtagggagctgacctgcacatcgtggaatgtttaggagcatccctggcctctaactattagatgctagtagtactgcagctacagctgtgacaatcaaaaatgccaaatgttccctggagggcaaaactggcctcagttgagaactggtctacacaagtgctgtcgctgtccaatagaactttctgtagcgatagaaatgctcaaattgggttgggcatggtggctcacgcctgtaatcctagcactttgggaggctgaggtgggtagatcacttgaggtcaggagttcaagaccagcctggccaacatggtgaaaccccgtctctactaaaaatacaaaaattagttgggcatggtggcgggtgcttgtagtcccagctactctggaggctgagacaggagaatcccttgaacccaggaggcagaggttgcagtgagctgagatcgtgccagtgcactccagcctgggtgacagggtgagactctgtctcaaaaaacaacaaaaaagaaatgctcaaactggcgctgtccaatatggtagctactgactatacatggctgttgagcacttggaatgtggctagtgagtctgagaaactgaattttgtattttattttattttaatgaatttaatttttttttgttttttgagacagggtcttgctctgttgcccaggctggaatgcagtggtgcaatctcagctcactgcagcctcaacctcccaggctcaagcaatccttctacctcagcctcctaagtagctgagaccacaggctcgctccaccacacctacctaatttttgtattttttgtagaaacagggtttcatcatgttgcccaggctggtcttgaactcctgagctcaagcgattcttccgtctcagctttccaaagtgctgggattacaggtgtgagccaccatgctgggcttgaatttaaatttaaatagccccatatggcttatgtctaccttatgggacagtatagctctagatcttgcatttttttttgtttactttatgataagtggttttccacatagaataacaaaaataagccttttttaaagattattttattttcatttattttatttttagagacaaggtctcactctgtcatccaggctggagtgcagtggcatgatcatagctcattgtaacctccaactgatgggcttaagtgatccttccgcctcagattcccaaagtgctagaattacatacgtgagccacaaaattattttaagttttaaaaaagtgagttgatttgaagaaaaatgttaaactgtggtacaagtgctgtgctgtgacaacttgaatgttttttgcttcaaatgacagaagtccctatttatttatttatttatgagatggagtctcactctgtcacccaggctggagtgcagtggcgcaatcttggctcactgcaacctccgcctcctgggttcaagcaattctcctgcctcagcctcctgagtagctgggattatagatgcacaccaccacacccagttaattttttatctttagtacagacagagtttcaccatgttggccaggctggtctcgaactcctgacctcaagtgatccacctgccttggcctcccaaagtgctgggattactggcgtgaactactgtgccaggccagaagtcctcatttaaatgggcttgaacaattaggaaatgttctgtcacagtatgagatggtcagaggagggcggctccagggtttgttgatgagcagctcagtaacgtgacccggaacccagggtctttccatctctggtctgcctgcctcagcgaaggggcttgtcgccgtggtgtcagaatgtggcaagtggcatctggatgttctttctgggccttccttgtggctgtgagctcctgggctgaggcctcgtccccgttcctgcaggagggcactgacaagcttgtcttccacagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacaggtgggtggaagtagggaacgccatgcttcccacacctctcttctgccgcttcacaggttttattgctagctgtgtgaccttgggcaaaccccatgacctctctgggcttcaatctacctttatctataaaatgtggcataagatgaaaggaaggatgacaaacatacaacatgtgtggcattactctaatactgtacccatggcagacatcactattcaatcacctacccattttttgctgagcctggatctcacctcagaatctttttttttttttaacttatgagttatttctggaattttccatttaatattttcagaccatgattgactttgggtaattgaaatcatggaaagcaaaactgcaagtaaggggagactactataaaataaaaatttatgatcccctactgttaaaataaatgaatgaataaataaataggggataaaagaaagccctttctttttttttttatttttactttaagttctgggatacatgtgcagaacgtgcaggtttgttacataggtatacgtgtgccatggtggtttgctgcacgtatcaccccatcatctaggttttaggccctgcatgcattcggtatttgtcctaaggctctctctccccttgtccccagccccccgacaggccctggtatgtgatgttcccctccctgtgtccatgtgttctcatcgttcaactcccacctatgagtgagaacatacggtgtttggttttctgttcctgtgttagcttgctgagaatgatggtttccagcttcatccatgtccctgcaaaggacatgaactcattattctttatggctgcatagtattctatggtatatatgtgccacatttaaagaaagccctttcttatagtaaaatgtgaactgataaaagtagaaataatgattaaattagaaaataactatttgacagccaccatagtaatacagtcacatgctatgtaaggatgtttccatgagtaacagatggcatatgtgacagtggtcccataaaattataatggagctggaaattttctgtcatctagtgacattgttgccattgtaaaatcatagcacactgcattaccttttctatgtttaagttacattcatttaaaaaattttagatttagagggtacatgtgcttgtttgttacatgggtattagatgcataatggtggtggctgggcttctagtgtacccatcacccaaatactagacattgtaccaacgggtagtttttctttttttgagacagagtctcactctgccacccaagctggagcgcagtagtgctatcagctcactgcaaccgctgccttccaagctcaagtgatcctcctgccttagcctcccgagtagctgggaatacaggtgccctttaccacacctggctaattttcgtatttttagtagagacaaggcttcaccatgttggccaggctggtctcaaactcctgacctcaagtaatccacccaccttggcctcccaaagtgctgagattacggacgtgagccaccatgcctggctaacacgtagtttttcaacccttgccttccctcaccatccctgctcagaatctgttttctatatgttgctccaggcagtcactgtagttgatcagaagttgaaagctatttgacctccaaggttagttggtctccaaagctctttatacatgtgggattctcatcatttgtccctgagctaatgctcctatccctgatattgatttagtttctttcttgcatgaggactgagaacttactaggtttagagcagcgctgcccaacagaaatatagtatgaacaacatatgtaatttaaaatgttcagccgggcatggtggctcacgcctgtaatcccagcactttgggaggctgaggtgagaggatcttttgagctcaggagttcaagatcagcctgggcaatatggtaaaacccatctctctcttttttttttttttttttttctgagacggagtctcactctgttgcccaggctggagtgcagtggcgcgatctcagctcactgcaagctccgcctcctgggttcacgccattttcctgcctcagcctcccgagtagctgggactacaggctcccgccaccatgcccggctaattttttttgtatttttagtagagaacggtgtttcactgtgttagccaggatggtctccatctcctgacctcgtgatccactcacctcggcctcccaaagtgctgggattacaggcgtgagccactgcgcctggcccccatctctatttaaacaaaaagttctgtctttaatggcaaaaataatcttaaataaataaatgaaataaaattttctagtagctacattaaaagcaatttttaaaaagatcaaattaattttaattatatatcttatttaaccatatatgtgtatgtgtgtatatatatatgtgtgtgtatatatatatgtatatatatgtgtgtgtgtgtatgtgtatatatatatatatatatttttttttttttttttttttttttttttgagatggagtcttgctctgtcgcccaggctggagtgcagtggtgcgatcttggctcaatgcaacctccacctcctggtatttaacccgatatattaacattattattttaacatataatataaagattgaatatactttatattctttttttaataaatttttgaaatccagcaggtatatacacttatagcacatctggatatggactggacacatttctttctgttttttgttttgttttgttttgttttttagttagggtctcattctgtcaccccagactggagtgcagtggtgcaatcataactcattgtagcctcgaactcccggactcaagtgatcctccctcctcagcctcccaagtagctgggatgggggtgcaccactgcgcctggctaattgttaaaaattgtttttgtagagacagggtcttgctttgttgcccaggctggtctcaaactcctgagctcaagtgatcctctcacctcagcctcccaaagtactggaattataggtgtgagccatcatgcctggtgccacatttcaagttctcagtagccacgtgtggctcaggaccactttattggatagtgtaaggccagagtctaagccattcccatgtagacccaagggtgagcaatgccaggcacatgctaggtaatgaagggagtgttttgctgggaaagcaatgtgtgaccacttttatctgaccttccttcaggcttcctgttggaactagccctactgtgtgccttctgagttcttgtgaactccttttttttttctttaaaaaaaattttcttttgagacaagatcttgctctgtcacccaggctggagtgcaatggcatgatggtggctccctgcagcctcaacctcccgggctcaagtgatcctcccacctcagcttcctgggtaggtgggaccaccgacacatgcaaccatgcccagctaattttgtttattttttgtagagatggcgtctcattatgttgctgaggctggtcttgaactcctgggttcaagggatcctccttcctcggcctcctaaagtgctgggattataggaatgagccatcacacggccctaaagaataaataatttcttccattttttttgaaactcctttagtgcctagcaccaaaggtttaaccatttagcaaacatttatagaggcctactatgtgccaggccactgggcctgcagggatgaggccagaggcccctgatgtcaaggaaagtgaggaacagtgtagtgagggaaggatgatgaaacagatgattacaattttttttgtttgtttgtttgaaatggagtctcactcttgttgcccaggctggagtgcaatggcgcaatattggctcactgcgacctccaccttccgggttcaagcaattctcctgcctcagcctcccaagtagctgggattacaggtgtgcgtcaccacgcccagataatttttttgtatttttggtagagacggggtttcaccatgttggccaggctggtctcgaactcctgaactcaggtgatctgcccgccttggcctcccaaagtgctgggattacaggtgtgagccaccgcacctggtgatgattacaattattattattattttttgagacagaatctcactctgtcaccaaggctggagtgcaggggcacaatctctgctcactgcagcctccgcctcccaggttccagtgattctcctgcctcagcctcctgtgtagctgggattacaggcaccctccaccacgcctggctaatttttgtattgttagtagagatgggctttcaccatgttgggaaggctgatctcgaacttctgacctcaagtgatccgtccgccttgacctcccaaggttctgggattacaggtgtgagccatcgcacccggccagatgattacaattagaagaggggactggggaggcattaggagtacaactaggatggtgtttagaatttttaacaaccatggagaggtctacagtgtctgaggggaaggccagagaggggaggctcgaggcagcagctgtttctcactcagaaaggaagcatttctgtatttgagcctgggaatggccgtaccagtgcacagcagctgagtgtgagtgcagcaccttaagcacagagtctgacccaaagcgagtagcaggtgccgggtgaacacagaggagcacggagtaggggttctgtgcatccttcctgaatgggccggctccttgtcctgacttccctggctttctccacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtaggtggatggtggcagcaggggcccacaccacaccagtcgaaacctttcactggtgctagggtcttgaatgctgcctagaaaggggtaggaaccagtgagtcagaccttccacggctctattccccccgggttagattccgagcaggggattgatgaagtaaggttacccttggggcaaatcacagaaaactttgactctcctccagacctgagacagctgactccacccagcgtaaggactctgtgtctttccagctctggtctctgtcatctcagggtgtggccttgacctctcctgatggctcaccttgtactcctgtcctgggatggtgatcacttctttttttttttttgagacggttttactcttccgcccaggctggagtgcagtggtgcgatctcagctcactgcaacctccacctccatgttggccaggctggtctcgaactcctgacctcaagtgatccacccgcttggcctcccaaagtgctaggattataggcatgagccactgtgtctggctggtggtcactctttctaggcaccaatccagaaccactgttatccgtgagccaaaaggggttatctcttctttatcttttataggagcaagaaagcttttcctagaagcactttgtagatctctttttggtgaaacccagtacatgtgctctatcatttgacaatgcattattatgctacaaatgatagaaaactggcttcttagggttttatttctctcacattaaagaaattcaaagaagaaatccctaagtaggcagcgttgggcttatatagagcaggtcaaatatgtcaccatagactcaggcttctagctgtctgatctgccattcttagcttatgggcttcatcctcaaggttgcaggatggctgctatgtctccatacatcaaatgtgtattccagtcaagataaacagaaagcagagggaatttctcctgggaagcttttgcctttgtgttctggaagtgatgcagtcctcaaagactactgactgtatatcgttggctagaaaggagtcacatggttgacactagatgcaagggaaccaggatcaagtgttttttttttccccccgaggcagtctcactctgtcgcccaggctggagtgcaatggcacgatctcggcttactgcaacctccacctcccacgttcaagggattttcctgcctcagcctcctgagtagctgggattacaggtgccccccaccacacccagctaatttttgtatttttagtagagacggtgtttcaccatgttggccaggctggtcccgaattccttacctcaagtgatccacccacctcggcctcccagagtgttgggattacaggtgtgagccaccgcgcccagcccgtgtttttgttttttttttagacagggtctcactctgtcaccaggctggagttcagtggcttcatctcagctcactgtaaccgccacctcctgggttcaagggattctcctgcctcagcctcttgagtagctgggattacgtgcatgcaccactacacctggctaatttttgtgcttttagtagagatggggtttcaccatgttggccaggctggtctcgaactcctgggctcaattgatctgcctgccttggcctcccagcatgttaggattacaggcatgagccaccacgcccggcctggatcaagtgttttaactaggtatgttgctattctgagcaaatcagggttcacttttttaggtagaaggagtgcatgatattgtgtaggcaaccaggacttacgtactatttatcaaagtatgattttcgagatgttaaaaacatacttctcatacaaatgaggcctgaaagtgagtcagaattttacttaactcattagtgaggaaacccaaaggaagacaaagcctgttcaacagaggccatggatagctatgcctaataactgtcaatgaaaaaaagagatactgaagtcagattgtcaaattacatacaaatctggttaatgtcctgcaagacaacaaaacctgtgacctttggggttatcttctctatctgacaaaaatcaattacgttggattagttttttacaaattaacaaattaacatttaactgtagagtcctagtcaatggaaagtagtcagaagtagccacatcctgtagagagtgtgatgactgtgggccggctataggcaggctccttagacagcagttctcaaagtcccaggccagcagcaccagcatcccctgaggatttctcgttagtgatgcacatattcagacccactaagtcagatttctcagggccagggagggggtgaaggggtggtggtgggggggggggcagtgggaggggtggcgggggcacagccctcagcaacctgtaattctgaggcctgctccagtttgagagccggtattccagtatgacattgaaagggtatacactgtcatcttttcactgtatttccaggtcttgaataatttttctaaatatacctatgccacacagagcctgagggaagggtaatagggccatcacgactggctgagaggagggaaccctctaatcaagttaaaacaaggggctgggcacagtggctcatgcctgtaatcccatcactttgggagcccaaggcgggtggatcacttgaggtcaggagttcgagaccagcctggccaatgtggtgaaaccccgtctctactaaaaatacaaaaattagctgggcatggtggtgtgcacctgtaatcccagctactggggaggctgaggcaggagaatcgcttgaacctgtgaagtggaggttgcagtgagccgagattgtaccactgcactccagcctgggcgatagagtgcgactcagtctcaaaaatgaatgaatgaatgaataaaaaccctgggatccagtagcagcaggggggcagagggagcagtggtcagatcatttaccatcagtgtccaaggccaatgccacaggccaggggctgcagtggaggaagctctcctgcctcctgtcacctgcccagcgtcttccctcaaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtaagtgcctcctgcttccctctccctgggtggacgggtgggtgggcagggagcccagggcctgtggccttggtggttctgactgcttaggaccagtgagatatttgaaaggagaaaccgaggctcctggctggggtccagcctggcagagtgggttctgggctttggcactggtggaagaaaggatgctggctctccttatatcattcttatgtcttggcagacatttttcccaaaaaaaaatccttaaaaagaggaacctatatttccttgttcatagtgggaaaaggtttgagcattttattccaaactaaacaattatgacagtattattttgtctcataatctacaaaatttagcttacagtcaaagcggtacaccggttcttaacaattaaaaaagaatgggcagggtgtggcggcccacatctgtaaccccagtactttgggaggccaaggcagaaggaggccaggagtttgagaccagcctggcaacataatgagaccccatctctacaaaataaaatacattttaaaatgaacagttggctgggcgtggtggctcacacctgtaatcccagcactttgggaggctgaggcgggcagatgatgaggtcaggagatggagaccatcctggctaacacggtgaaaccccgtctctactaaaaatacaaaaaaaattagccgggcgtggtggtgggcgcctgtagtcccagctacttgggaggctgaggcaggagaatgacgtgaacccgggaggcagagcttgcagtgagctgagaccgtgtcactgcactccagcctgggcgacagagcaacactccgtctcaaaaaaaataaaatacaataaaatgaacggtaacatgtttaaaagcaaagatcataaaaataatattcatttgttttataatctataagatctaggttaaagttgaagctatatgctgattcctatttttattttatttttttctttgagatggggttttgctctgttgcccaggttggagtccagtggcaccatcacagctcactgcagcctccccgggctcaggtgatcctcccacctcagccacctgagtagctgggactaacaggcatgtgccccacgcccagctaatttttgtattttttgtagagacggggtttcgccatgttgctcaggctggtcttgaattcctggactcaagtgatcctcccaccttagcctcccaaaatgctaggattacaggcgtgagccactgtgcccagcctatatgatgattcttagaatgaacaagggatggatcaggtatggattttattggggtaatttattctgataatcatttatatcacttcagtcttccattgtggtcatgaagagggtccctttggcagaaatgatgaaaggtttcctcagttttgcaacatgctttttatccttagatcttcatgttaaagcagggcacagtggctcacgcctataatcctagcatttggggaggctgaggtgggaggatggcttgagcccaggagtttgaaaccagtctgggcaacatagcaagaccttgtctcaacaaaaatagaaaaattagccaggtgtgttggcacgcacccgtagtcccagctactcaggaggctgagatggtaggattgcttgagcccaggaggttaaggctgctgtgagccatcatcgcgccactgcactcagcctgagcgacagagacgcttgtcttaaaaaaaaaaaaaaaaaaaaaaaaagatcttcacgtcattctctttggacctattgacctctgatcatccttgttgagtttctctgcctcagttgttttctggtctgttttgccaggtcttcctttgttgatggtgttatttgcagttgtgcaacatcactttgatgatgtcatgaaatcccccatctgcagtcattttgctgtacatttgcctgcatcatctgggagcacctgcctcacaaaacccatgggggtagatagtagcaaaaggccaggagtggtgtttgtgtggggcctccttccagttcattagcaaatattttcccattacagtggtttttgcttctctgtacaaacttgtacctgcagagatttggtgtttctgttaatgaggcccctgtaactcctgggtgaagcttctggggttcagagataagtaaataccttgagcttaaaatgcatgggctgctcagggtgactggtgtgtaaacaaatgcaccctatcacttgataaaatgctatcatatatgtttataaggtatagagataccacaggggaggcaggctagagaagctgtcccaagagcagtgacatctgaactgagttttgaaggatgaataggagtttgccaggtagacaatggatggagtgtgttcctatcaggaggaaccgcaagtttaaaatacaacagcaagtgatgtattaatagaatgactgttatgtggagtggaagcgggagggagatgtttagatggggcctatgggaaaaagtggggccaaggcatgaagggccacgtagaaatcacaagagctctgagaagttggcagaggagctagaactcaagaaatggggtgtagggtaacttgcccccaagactctgggaaatggggcaagagaggcagggaagctgggcaaagctttggccagccaaggggcagagatttctggcagtgatgacttattcccgtttgcacttgataaattttctttggctcttgcccttctgatttgtggattatctgtgagttcctgtggctgtgtgactctggagtgagatgccaagtaaagggaaggaagcacctgctctgtgccaagctttgcctttagtgacatgaatccctgcagccctgggaggtaggtgatattctccccattttgaagatgaagacactgaggttcaaagagaagtgacctgcccaccagagtaacaacatcagcagagtttagattcgaaccctagtgtgagatcttggaagcctcatagccctggtcttggagtttgcaggttgaagattgagcccgatgctgatgaccctgtgcagtccccttgcagggtcatagtgccagtggccctttgtagacattggagctgttgtcctgtcccaaaagtaaggcccaatgagccaggcccccatttggatggcctgaaggtggaatggtgtcatgggtagtgataagggttctggagccattggcctgtgcttaaatcctgtcttgactgcaaatccagtggatgaccttgggcaaggtattcagccactctgagcctcggttttctcctctgtgaaatggggatcacagtagtgcctgccctactggattatttataaggatcaagtaagacaaggctgaggctcttagacatggtacctggaacatagtaggtactcaataaatgttattgctacaattattattatttgtgttatttaagtagaagtttggctgcatgcagtagaaacctcaaataacagtgacttatacaccatgagagttgattctgtctcatagtgacatttgagtggctgtggtggcttcatcatatctttagaagtccaagccctgtcattctggtttctgttccctgtcagccacattgccttggcctgcctatgtgtactttccccaaacctctcaaatgacttttagtcatgccactatatctttactgtatgtttaatatttccttttaaaaaataagatttggctgggtgcagtggctcactcttgtaatcccagcactttgggagtccgaggagggcagatcacttgaggtcaggagtttgagaccagcctggccaacacagtgaaaccctgtctctactaaaaaaaaaaaaaaaaaaaaaaaaattagctgggtgtggtggcacactcctgtagtcccagccactccggagcctgaggcaggagaatcgctcaaactcgggaggtggaggttgcagtgagccaagattgtgccactgcactccatccagcctgggtgacagagagagagactccgtctcaaaaaagaaaaaagagaaaaataagatttattgattttttcccccaattgcaaaagtcaatgttcaatgcagagaaaacaattttgtaaaaacccacacaaaaacaaaaaaccaaaactgtcacccagagatcgccactgcactattaacctcttggtggatatcctttggcatatatgtgtaataaatatgtttacagatatggatacagatataaatatcacagactatatttgagtcaggtgatgccaaatagagtcactgaatttggtgaaaattcatcacactgtcttcctgtagcgcaatgtccaacaaacagactgatttaatgggatcactgcacatgtggttttatcacttaaaactttttcacttaaaacagtaatatagctgggcatggtggcttatgcctgtaatcctagcactgtgggaggccgaggcaggcagatcacttgaggccaggagttcaaaaccagcctgagcaacatgatgaaaccttgcctgtacaaaaaatacaaaaattagccaggcatggtggcatgtgcctgtagtcccagttacttgggaggctgagctggattgcttgagtccaggagttcaaggctgcagtgagccgtgatcatgccactgcactcgtgagaccctgtctcggggaaaaacaaaaacatcagtaatatggacatctttgcatttcagcaacaatagacctgcctcattctttaaacagctactttgtattccattgtgcatggtgtactgtgatttacttctgtcatctcccattgttggttagtgaggttattttcagtttgtcatcagtataacaattatacagggaacaacttcggaagtacatctttgctcttttctaagttcctagaagtgattttgcaggtcagagttgaaagggttttgtttttttttttttttgagatggagtctcgctctgttgcccaggctggagtgcaatggcaggatctcagctcactacaaccttcgcctcccaggttcaagtgattctcctgcctcagcctttctagtagctgcgactacaaggcacctgccaccatgccccgctaattttttgtatttttagtagagacggggtttcaccatgttagccaggatggtctcgatccctgacctcgtgatctacccacctcggcctcccaaagtgctaggattacaggtgtgagccaccgtgcccggccttttttttttttttttaaagattaattatctacttcaaaaactatatgtatacagtgcaatattgtaaaactatcacaggacatagagtgaacaggaattctccatccactgtgacccacttccccatatcacgggcaatcatgttcgaaaagtgttctttgtaaacctcttattttgtcataattttattattgattgattgatttttgagacaggatcttgctcagtcacccaggctggagtacagtggcacaatcatggcttgctgtagccttgacttccctggctcaaacaatccatccccctcagcctcctgagtagctgggactacaggtgtgtgccaccactgccagctaattttggtattttttgtagagacagggtcttgctatattgcccaggctggcctagaactccaaggctcaagcaatccaccctcctcagcctcccaaagtactaggattacaggcataagccaccatgcctggccttcaatatatgtgttttaaagctttcctttgtttcatgaatttaacttatgtatgtattttaattttaatataattaattaattaattttttgtttagagacagggtctcactccatcaccaaggctggaaagcagtggcatgatcatggctcactgcagccttgacccttgacctccccagtctcaggtgattctcccacctcagcctcctgggtagctgggactacaagcatgcaccaccatgcccatctgatttttttttttaaactttttgtagaaacagggtttcgccatattgctcaggcttgtctcaaattcctgggctcaagtgatcctcctaccttggcctcccaaagtgctgggattacaggcatgagccactgcacctggcctttttttttttttgagacaggatctcactctgtcacccaggctagagcacagtagcatgatcacagctcactgcagccttcgcctccggggctcaagcaatcctccagctcagcctcctgagtagctgggaccacaggtgtgtgccaccaggcctggctaattttttattttttataaagatggaatttcaccatgttgaccagactggtctggaactcctgggctcaagcggtccacctgccttgttctcccaaaggtctgggattataggcgtgagccacacacctggccaatttttatttttttagagacagagtctcactgtgttgtccagtctagagtgcatcagctattcacaggtgtggtcgccttgcctcagcctccccagtagctaggactacaggcaggcgccatcactcctaggtaaatttgtttgtttgtttgtttgtagagacagggtcttactgtgttgcccaggctggtcttgaactcctggcctcaagtgatcctcctgcctggccttcccaaagtgctgggattacaggcgtaagccatcacacctggcctgtatttcctaaaaacaaggataacctcttccataagggcaatatactatagttaccaaaatcaggaagttgggctctgtgcggtggctcatgcctgtaatcccagcactttgggaggctgaggtagacagattgcttgagcccagaagtttgagaccaacctggactacgtggcaaaaccccgtctttaccaaaaaaaaaaaaaaaaaaaaaaagaggtgggtatggtagcatatgcctgtggtctcagctgctcaggaggctgaggcagaagaattgctttagcccgggaggtacaggttgcagtgagctgagatcgcaccactgcactcccgcctgaaggacagagtgagaccctatctcaaaaaaaaaaaaaaaaaaaaaaaaaaatcaggccaggtgcggtggctcacacctgtaatcccaacactttgggaggctgaggtgggcggatcacctgaagtcaggagttcgagaccagcctggccaacatggcgaaatgccgtatctactaaattataaaaattagctgggtgtggtggcgggcacctgtattcccagttacttgggaggctgaggcaggagaatcccttgaacctgggagacggaagttgcagtgagccgagatcgggccactgcactccagcctgggtgacagagcgagactcttgtctcaaaaaaaaaaaaaaagaagaaaaagaaatcaggaagttaatatcagtacaattctattatctaattacaggccttactcagaattttccaattgttccaataacatgctttagagaaaaagaaaaaaaaggtttttttgaaccagaatcacatgttgaattcagttgtcatgtctctctcgtctctcttgtgtcctataagctggaacagttcctccttctgtctttgtcttcgagaccttgatatttctgaagagtatagacaggttattctgtagaatgtcctcagtttgggtttgcctgattttaccctatgattaaattcaggtcatgcacttttgtcaggaatgtcacaacaaatactgtgtcctcctccgtgtgtcatatcaggaggcatgtgatgttgatttgctctattactggtgatgttaccttggatgacttaattcaggtgctgtttctggcaggagattttaattttcctggctattggtaaacaatctctgacacaaatctatgtctcccccaaacccagcccctgaagcatgtgagattctgtcctttcccatctcaccagctagttaagtctctgccctcctggtacctctgctcccaccccaccttccctttcttgctgcctggaggcatttagtatgtggcttctttctttttcttttctttttttattttttttgagacagagtctctctccgtcacccaggctgaagtgcagtggcatgatcttggctcaccgcaacctctgccctcctgggttcaagtgattcttgtgcctcagcctcctgagtagctgggattacaggtgtgagccaccacacctggctaatttttgtatttttagtaaagacggcatttctccatgttggccaggttggtctcgaactcctgaccttaagtgatccgcccacctcggcctcccaaagtgctgggattacaggcatgagccaccgcgcctggctagtgtgtggtttcagagtgcgcctggctagtgtgtagtttcagagtgcggtctatggggctcccctgggcccttcgcaggtgcagcctgcctggggtttcccacaggcagtactctacacagcctgccttttggtttttgctttgaattgttcacctacctgtgacattcctcactgataactcattgtaaataggtcaatatgctggcaaatgttttcttttttcttttctttttttgtctgataataccctttcttccttagctggcacatgttttcatgatggggagatggtggtgtcttttctcccttcagagtggttggtggcctgagactgctgttgtgaggacatgtttatgagctgtttggcacagttgtgttttttgactctgtattaggccattcttgcactgctataaagaaatacctgagactgggtaatttataagaaaagaggcttatttgactcacggttcagcaggctgtacaggaagcatagtgtctgagctagcagatctgccactggggaggcctcaggaggcttttactcatggcaggaggagaaggggaagtagacatgtcacatggccagagcaggagccagatagagagagagggaggcgccatacacttttaaacagctagatctcatgagaactcactcactatcctgaggactgcaccaaggggatggtcctaaaccattcatgagaaatccacccccatgatccaatcacctcccaccagaactcacctccagcactggggattatagttcaacatgagatttaggtggggacacagatacaaactatgtcagactctgtgacaatctcccttttttttttttttttttttgagatggagtctcactgtgtcgcccaggctggagtgcagtagcgtgatctcagctcactgcatcctgcatctcccaggttcaagtgattctcctgcctcagcctcctgagtagctggggttacaggcaggtgccaccacgcctggctaatgtttgtatttttagtagagacagggtttcaccgtattggccaggctggtcttgaactcctgacctcaggtgatctgcccacctcagcctcccaaagtgctgggattacaggcatgaggcactgcatccagccatgtgacaattgtaagaatgagtgacaggcaggtctgtttgggactcacaccccatattttgaatgaggaggcccagcaggtcagaaatgggaaggcgctgggcttggatccccatctgtctgactctttaatgtaacaagttctcactggtgctgggagcagcttgtgaatgggcaagatgtggtatctggaacagggaccacttgctagtggaggagacagacaataaccaagtaagcaaataataaataattccaggtaagaagtggtaagaagaaaataaaactgagtgatgtaatagggagtgactgggagtgcatcgtggggggcaacttgagacagggtggccaggagggcctctttggggaggtgacatttgagctgagatatgaaggatgagaaggcactgcctggggaagacttggggaagagtgttccggggaacaggaacagccagtgccaaggccctgaggtgggaatgagcctggtgtgttcaaggtaggtcaaggaggccagggtggccagagcagagtgagtgaggtggagaaaggagaaggatgaggtctgagaggtgggagtgggtcagaccacagggccttgtaggccaaggtgggaggtgggttaagcaatggtgtggcatggtctgacttactttttttttttgtttcttttttgagacagagtctcactctgccgcccaggctggagtgcagtggtgcgatctcggctcactgcaacctccgcctcctgggtttaagtgattctcctgactcagtctcctgagtagctgggattacaggtccacgctaccacgcctggctaatttttgtatttttagtagagagacggggtttcatcatgttggccaggctggtctcaaactcctgacctcaggtgatgcgcctgcctcggcctcccgaagtactgggattacaggtgtgagtcaccacaccaggcctttttttttttttcttatttaaatagagacaggttctctttctgttacccaggctggagtgtagtggcataatcatggctcactgtaacttcaaaacccctgggcttaagcgatcctcctgccttagcctcttgagtagctgggaagccaccacatctagctaatttttaaatttttcatagggataggggtcttgccatgttgcccaggctgattttgaactcctggtctcaaacaatcctctcaccttggcctcctaaagtattgggattgcaggtgtgagccagccactgtgctcagcctgtttcatttttaaaggtgcccctggccaccctgtggagaatggactacaggaggcaaggcaggggcagggtggccagcgaggaggctactgcacaagtccgaacaagagatgatggcgctcagatgaggacaggcagtggcaattgagaagagtggatggatttggaatgaattaactgtaggatgttgcctcctaatgttggccctggggtggccggggcgctgcttcctatgcctgctgtgtttcctccctcatctctcctgctccttccacttaggtgtgtcaaatgtgtcaacaaatactccacccctgaggccctggagcaccacctgcagaccgccactcacaacttcccctgcccacactgccagaaggtgggtgccactgtcctcttttctggggcctaggctataataagggcaaggaggtggggtggggtgcacacctcaccctttccttctcctctctcaccataggacacgcaggcagggctcaggggctgctccacagatgacacagtgtctctgcctggccatctcatccatcacattccagatgtggccatgtcggggctgctgctggagccaggctgggtgggctgtcctggtcccaggcctagtgtctgagcagaagcctcccagcttcctgatgtaagattatccttattacaattggctcttctttttaatttttttttttttttgagacagggtcttactctgtcaccaggctagtgtgcagtggtttgatcatggctcaccgcagcctcaacctcctgggctcagccccctgagtagctgggactataggcatgtgccaccatgcccagctaatttttgtattttttatagagatggagtttcaccgtgttgcccaggctggtctcaaactcctgggcttaagggacctgtccaccttgacctcccaaagtgctgggattacacgcatgagccactgcacccagcctaaattttttgtagagatagggctcactatgttacccaggctggtctcaaactcttggcctcaagtgatcctcccacctcagactcccagagtgttgggattacaggtatgagccatcatgcccagcctggattcttcttttcagtgactctgaaagcctcactaaagcctgttcctgataacatcaaacatccaggaagtgttccaatttctagttgtctcaaagcttcatcattttgtaaagttcatttgaatcaggtccatagattgcaattgattgacataacaaaagcctctattaatctacaggtccccaccaccacccctgaccactgctcccttttttctttcctctgaatttatttgttgaagaaactgggccatttggttcagcggtgttccccgcagtctggattttgctgattacgtctccctggtgtgtttaacttgcttcttcactctactcattttcttacaaccatatgtggcagattttccaggacagccctggtttcattttggcctcattctggatgtttcttattatctaacctaattttaagctttagaagttgtggtccgagtaaaagataccatgaattgagcaagaaccacatgccagatgctgttctgagcatttcactggaattgactagaggataggtgtactgttactatccccctttataggtggggaaaccaaggcagaaaggtcacctagctgggaaacgatggggctaataagcagtggggcagctgggtctgtgcccgtgaccaacgctctaccaaaatgaatgaatgtgtgaatacatgcccttcttttgcctggactggaaagagattttcacttctgtgttttctggctttaaaaaaattacctttcatacaaaaattagctgggtgtggtggtgggcgcctgtaatcccagcacttcgggaggctgaggcgggtggatcacctgaggtcaggagttagagaccagcctaaccaacatggagaaaccctgtctctactaaaaataaaaattagccgggagtggtggcaggcacctgtaatcccagctactcaggaggctgaggcaggagaatcgcttgaacctgggaggcagaggttgcagtgagccaagattgcaccattgcactccagcctggacaatatgagcgaaactgcatctcaaataaaataaaataaaataaataaaagtaaaaaattacctttccatagatttctttagtaatttgctcattttccattaattcttttacttgtcagtcatttgacccaggctctgtgctggggagtgaaagcccctctctgcctacttggagctcctgtgtaagcaaagggctgtcattcagtgggttaaatgctgacttaaaagtgtgggtggacattcaaaggcagaattggctttgccaggcatagcaccagggagctagggaaggcttgacaggagcagtgacgcccgagttgggtcttgaaggatgtgtaagagtttgtcagtaaagagagaaaggccctctgggtgggaagaacatccgggcaaaagctcagggcagacatgttttgtccgggcttgtggggagccatgaagttctaagggctgagtctgacattctgggtcctggcccctgatagccagaaaggaaggtgtctctataggggctggaaacgaggaacctttgagttcagaagatggccaggggaggggggcccggtgagtcagacctgaaggcccctcttctctcccaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtaggtaccctgcccctgagaactccagcccagcccctcccctccccctccccctctcctcatgcctttctctctcttcccatccccatctggctcttctccctgtctccctcagccccttttccctccacttctccatctccctccccatctcactcagtccctcccctcatctctctcagcccccgtctccctcctcctccccatctccctcctcctccccatctccttcctcctccccatctccctccagcacccttctccctcctcttccccatttcctttcccctctccctctccctactcctctccctcccccctccctccgcctcctcacctccctccctctccccatctccttccccctcccccatctccctccctctctccatctctctcccccccatctccctcaccctccccatctccctcttcttccccatctccctgcagcccccttctccctcctccttcccatctccctctagcctcccttcccctccctctccccatctccttctagccccctccagcctccctcccctgtcctctcccctctccctccagccccctccccctcctctctgtcgctgtctgtctccctccagccctcctgcctctccccttgctcctccttcctctctccttcctggcccctgatccacctgccttaattcatgaacaagggattcccaccaccgctaaagcagagaagagcccctggaggttgtgtggaagggactttttattctttttttttttttctttgagacaaagtctcgctcttgttgcccaggctggagtgcggtggcagatcttggctcactgcaacctctgcctcccgggttcaagtgattctcctgcctcagcctcctgagtagctgggattacaggctcccaccaccatgtccagctagttttttgtatttttagtagaaacagggttttgccatgttggccaggctggtttcgaactcctgacctcaggtgatcctcctgcctcggcctcccaaagtgctgggatgacaggcgtgaggcactgcacccagcctgtgtgagggactcttgactctgccccctgtggtggggacactgctctcactgtaagttcccactcaaacctgaacaaaacgccatctccttggttccccagttgaaacacactgacattttcttttctattaatctttagatttttttattagttaaattttttaattgctttttaattgaaaaggatctaaagattgagaaaacttgagggaaaatccttgacgggacaaaagcatatataaaaaaataaactccctctcacttcagatggacaatccaatgtttttccttttttttctttcctacgacctatggtaaaaaatacatttcatattgcaacccaggaagcacacataggatgtattgcaacaaaagttttacaaaacagtgttttctattttgtccttttcaattttagtttttttattttttatttttattttgagacagggtctcactctgtcacccaggctggagtgcaatggtatgatctcactacaacctccgcctcccaggttcaagccattctcgtgcctcagcctcccgagtagctgggattacaggcgcccaccacatgcctggctaatttctgtattttcagtagagacggggtttcaccatgttggccaagatggtctcaaactcctggcctcaggttacccacccaccttggcctctcaaagtgctgggattacagatgcaagccaccacacccagcctatttttaattcttaaaataaccaccaacagggtgtaacttgtggtttgcagtttgcaaaatactcctaattctcttccccaaaggtaactgttagcggtctagtctgcattcttctagttttattttacacatatataaaacgcttgcttacgtttgcaaaaatgagcacatactataacttatgtgcctttttttccttatcatataccttggcgatgttccccaaggaatgtgtgcttacagttcccctggaggctaaattctgtgggtccccctcccccgggccccccccagaagttgttaccaacagcaccttctttttcacatctgagtagtcttcctcaatgaatttttcatcttgtatttagccagttctctatgtatgaaccttttttttttttttttttttttttgagactgaatggcacgatcttggttcactgcaacctctgccgcctgagttcaagcaattctcctgccttagccttccaagtagctgggattacaggtgtgcaccatcacgcccagctaatttttgtatttttagtagatatgtggtttcaccatgttggccaggctggtctcgaactcctgacctcaagtgatccccccgccccagcctcccaaagtgctgggattacaggcatgagccatcacgcccagcctatgtatgaaccgttaaattacatttcagctattagtttgtacacacaatgctgtgtgggtcccttggcaagcttttggaagtgtatctgtagtgtatattcttaggagtggaaatgctaggttaaaatgcatgtgtaatactgagtttcagtttgggatgatgaaaaaattctagagacagatgatggtgatggttgcatgatggtgcaaatgtacttatgccactgaactatacacttaaaagaagcttaagatggtcaattttctgttatgtatatttctccacaataaagaagggaaaagaagtaatgcattgtaagtttgatattaccaaattgctctttatggcttttaaaaattattattcaaaagtaatacatgctgccaggcgcggtggctcatgcctgtaatctcagcactttggaaggtgaaggtgggtggagcacctaggtcaagagtttgagaccagcctggccaacgtgatgaaaccccgtctctactaaaaatacaaaaattagccgggtgtggtggtacgcacctgtgatcccagctactcaggaggctgaggcaggagaattgcctgaacccaggagatggaggttgcagtgagccaagatcaaaccactgcactccagcctgggcaacagagcaagactctgtttcaaaaaaaaaaaaaaaaatacaaaaaacgaaacaaaacaaaacaaaaaaaaccacacaaataatacatggttattataaaaatggaaacaatataggagtacataaagtaaaatgttaaatttccccttcaagttgtagttgccactgacactttggtctgtcctttccctacacctccccatctttcttcctgcatcttcagtttatttacagagacacatggccagggcttttttggggtgtgcaggttgtattttttctttcttttttttttgttggagcttacatatccagtagggattatatttttttctaagaaagacgagattgtgttaagctgttctactgctttctttccccactagcagtatgtccaggagatctttccagatcaggaaacacagattgacctttttaatctttttaatgaccacagagcattctattgtagggaccagcatttccgtatcgactgggttgatggtttttcagaagtactttattcattccagagggagaacagagaggaaataatggcaggaagtcacagcagcccagaaacagccccttccaaagggcaggctgtgaccccacggcaactttgcaggcacctcccttgatttcctgtgggttcctcaggtagcccatcaggcaagagctgccccaggacgggtttaacagcaggaagatctgggtagctcagatgggctctggatcacgctgctgggctggaatcttagctcccgcaaccataggggtagcccctgagccagtcccttcacctctctgaacttcagtcttctttcttatctgtgaaacagggatgatgggagtcagtgcctcctggttttttggaaggattcagttagataaggtgtgattcctcgtcccccagggtggaccgcattgccagaaatgacatgaggccaccttgcttctcaggccgtgcctcatccttgactcctctcctcctctcacagtcacagccagtccagtggcaagggctgccgactgtgccttcccaacatggctgtcctgggccacttcctggttatcctcacctccaccctcattcgagctggttaaaagcttacatcagagtccatccctctgctgttcagaccttctggtgcttctcttctggctcagagtaaaagccaaagtcctggctgggcgcggtggctcatgcctgtaatcccagcactttgggaggccaaggcaggtggatcacttgaggtcaggagttcgagaccagcctggccaacatggtgaaaccccccatctctactaaaaatacaaaaattagctgggcgtggtggcacacacctgtaatcccatctactcaggaggctgaggtaggaggattgcttgaacccagaaggcagaggttgcagtgactcacctgaaatcttgccactgcactccagcctgggtgacagagcaaggctctgtctcaaaaaaaataaataaataaaagccaagtccttagctctgcctcccaggtcctcccatgcggacctggctggctcgctgccctcaccttctgccttgttctctggccacaccagcctccctgttgttcatcagcaccgccaaacgcactcctgcctcagggcctttgtacctgctttccctgctgcccagaccatctccctgatgacctgaggtctctcctcatgcatggcctcatcagagaggcctctcctgaccatcctgtcaaaatagccctgtcttgtctctggcaaaacaaagccactgaagaatgagagaggctattttctcccctggccacctccctagaggagctgctcccctgaggggcccagcggggacccttgtgccctggatgccgactcctggtgagtgctggctctccctgtctgtgtctgctgcaggtgagaagccctacaaatgctcagtgtgcgagtctgcgttcaaccgcaaggacaaactgaagagacacatgttgatccacgagcccttcaagaaatacaaatgccctttctcgtgagtagagactgccatgcaggggggtgggtagcgggacagattctccaggggtgctgctggggagggtgggacagatgtcaggcctgagggcaggcctctccttttttttttttttggagacatagtctcactctgtcatccaggctggagtgcagtggtaagatcttgtctcactgcaacctctgccttctgggttcaagcgattctcttgcctcggcttcccaagtagctgagattacagatttagtagagatggagtttcgccatgttgcctaggctggtctcgagctcctgaccgcaagtgatccatccacctcggcctcccaaagtgctgagattacaggcgtgagccactgtgcctggccaggcctctctccttttatcctgtcctgggccctgcctgcctcacttcccaccctacctccttgcccagcccttagggtggacaaggctgtcccttgtgcccagggctagtggaggggccagcaagaggatcctaagcttggtgagctccccctgaccagtggctttgggttttaggacgcacacaggctgcagtaaggagttcaaccggccggacaagctgaaggcccacatcctctcccactctggtaagtggctcttgggcctgctaagagggtctggttcagctctagttcactgggatagacccgccaggaagagaaagagcagacatatcctgtgaggcttgttttccctgcctggcacattccagccagcactttcacttatgtgggctatgagccaggcctgtgttagggacttaagggtgaacagagatgaatcagacacagtcccccagtccaaggaggaagctgacctgagcagagatgactcagttggagcagtgcccagtgtaatagaggtgtggacgaggtgtggagggaatcagattccagccaggtccaagacatggccaggaagcttctttgatagggcagggcaggggtctccaagccactcctcagtttctcagcgcctcctcagagcagcctggctggctttccacatgccagccgaggtctaaaacaaggttcttcaaccctggcaccattgacaatttgggccagataattttttttttttttttttgagacggagcctccctctgtcacccaggtggagtgcagtggtgtgatcttggctcattgcaacctctgcctcccaggttcaagcgattctcttgcctcagcttcccaagtagttgggattacaggtgcctgccaccacacccagctaatttttgtatttttagtagacatggggttttcaccatgttggctaggctggtgtcgaactcctgacctcaagtgatctgcccgccttggcctcccaaggtgctgggattacaggtgtgagccaccggcgcctggcctgtaatcctgtagataattttgtcctgggggctgtcctgtgccctgtaggatttttagcagtatccctggcttctatctactggtgtcagtggcatccccccacagttgtgacaaccaaaaatgtctctaggcattgctgagtcctctggggggtaaagtctcccttgtttgagaaggtttacagaaaggagtcagtcactaaagaaagtgtgaaaactgggagagtaggtcaatgacttggacacacagggctgggttggagtcttagtgctgccatgttcctgtgggtggcctcaggcgtcacggcccctccctgagcctgagatgacctggcaaagcgagccaaggtgcagagagtgagcagctgttccaggcagaggagaatggcaagtacaaaggcgcagagggaggagccagcgtggcatctctgaggagagcgagtgtggctggcgcagagagtggctggaagaaggcagacgacgagggtggagagagctggggccagatcacacaggtgctggtggggaaagagcctggattttattcccagcgcagggcactgttgcggggtgaaggtctggatgcttctcactgactttcccttgccctccaggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtgtccgggtggcctgggccaagctgtggcagtttccttctttgcccctaggtggcagcactccccctctgaagcttgtggtggctgaggggtcccaggcccctcacacagggagccctggagagatgataagggaagcaaggctgggcacggcagctcatgcctgtaatcccagcactttgggaggccaaggtgggctgatcacctgagatcaggagtttgagaccagtctggccaacatggcaaaacctcgtctctagtaaaaatacaaaaattaaccgggtgtggtggtgcacacctgtattcccagctacttgggaggctgaggcgggagaatcacttgaacccaggagacagaggttgcagtgagctgagatcgtgccactgcactccagtgtgggagacagagtgagaccctgtctcaaaaaaaaaaaaaaaaaattagctgggcatggtggtgggtgcctgcagtcccagatatgctggaggctaatgtgggaggatcacttgagcccaggaggttgaggctgcagtgagctgagattgtgccactgcattccagcctgggcaactgagcaagaccctgtctcaaagatttaaaaaaaaagaaaagaaacgaaaaaaaagaaaggaaattgggaacacccatccacagaaaacagtccaggacaacaccccatgggggtcggggtttgtactcacttgtgggaattcaggatagttagccacctccaaatccgttgtaaacaagatcagaaatccctctcgtgtcggcatctggaggccatcaatgtcaccgcgtccagtgcttcctcctacctctcagctggtcccggtgggaggtggaccgggctcatgaggaggcgggaaggagaaaagggccttgactagtgttttcctgtttatcttcacagccacccttctgggctgttggactccatttgatgactgaattgttttgaaggctggcaggtccctcaggcatctgtgttggatctcagggctggaactcagagccaggcccagcttcccacatcctcaggaagggtgtgacgcggcaggagggacagagttgatgggggtgaggtgtgtaagtgtaccggcctgcacaaaggcccgagggggactggtggggacaggaagtcagaggggatgcccctggagctgggccttggcccggggtgctttgatgggtggatggataggggaaggtgtgctgggtgagagcagggcgcgtgcaaacaccttggggtgggacagtgccaggcctgctatgttctggggccggcggatgttccagggtgaccagaggtctcagaggagtaggtggataatgatcatggctgttgcttcaccttctccacacgagggacactgtgccaggctatttacagtcacgtcgcctcagcctgtcatgtgagtgctgttactttctgtattttacagctgagaaaacccaggcccagaggggtaaacttccttacccaagctcacacagccaggaaagctgcagagctgggactcaagccacggcagcctgcctccatgggttcttagccactttccacgattgaagtgtgggttgatgaatcagagagggccttagatgtgggttaaggaatctggactttattctccacataatgaaggggagtcatgggagacagtgaacatttttaaaagttgtaacaatggcattgaaagaaatgtgaagaacgacatcttcagccgggtgtggtggctcactcctataatcccagcactttgggaggccgaggcgggtggatcacccgatgtcaggagtttgagactatcctggccaacatggtgaaaccccatctctactaataatacaaaaaaattagctgggcgtggtggcacatgccagtaatctcagctacttgggaggctgaggcaggagaatcgcttgaacccgggaggcagagtttgcagtgagctgagatcccgtgacattgcactccaatctgggtgacaagagtgaaactccatctcaaaaaaagaaaaaaaaatgacatcttcttcctaatataactatttaagtggtttttctatagcttcttcctgtcagtgcacacaggcatacacgtctactggtaatcacgagaactaacatttattagttatcgaatgaatgcctggcaccatccccagcacctcaatgtaggcactacttttaagcccattttgcagctgagatgaggcaacaggcacattaaggttaagcagcccaaagtcacacaggagggaagtagcagagccaagccacagataaggacataccaagatcagctataatgtttaacagaaagttggtgacaaatcccagcactttgagaggccgaggcaggcagatcacgaggacaggatatcaagaccatcctggctaacatggtgaaaccctgtctctactaaaaatacaaaaaattagccagatgtggtggccctggagctggtcccagctacttgggaggctgaggcaggagaatcgcttgaacctgggaggcggaggttgcagtgagccgagatcatgccactgctctccagcttgggggagagcaagactctgtctcattaaataaataaataaataaataaataaataaataaataataaaaaagaaagttggagatagctgctccaggaccccagggtctgccaccgaactccaagatgctggacagagtggagcataaaaaggggctggcctaggcatccagggtctcactccacccccagaaagatcacagtttttttaccgggtgtggtggctcactcctgtaatcccagcactttgggaggccaagatgggcggatcacctgaggtcaggggttcgagaccagcttggccaacatggcgaaaccccatctctactacaaaaaattagccattcgtggttgcatgtgcctgtgatcccagctacttgggaagccaaggcaggagaatttgtagaatccgggagacggaggttgcagtgagccgagatctcaccattgcactgcagccagggtgacagagtaaactcatggacagactcttactctaagagtaaactctgtctcaaaaaaaaaaaaaaaaaaaaagagaaagattacagtctttggtatcaagcagagctgggtttgaattctggctctgccccctcctagctgtgtgactatggcgagtcacttcacctttctgaacctcagtttccttgtgtcagtgtggagaataatagtacctacctggcgaggttgatgtcacaattcacggaaataattcaggtaaagcagagatcacaaattggccgctcatggcagcctccagacagtttggcattcacagtgtctgaaaaagtaagccaacgtttaaaaacaaatttaaaatatactacagtggtgaagtgtcaggaatgacacaaggatgcctgctgttatgactccaatattacattagtggcctggccagaataatagagcaagaaaaagaaataaatagtatcaggattggaaagggtgagataatagcaagggtgctgaaataatagcaagatcaatatatacaaatctactatgctcctatactccagaagcaattagaaaatgtaaaaaattgggacatttgggccaggcgtggtggcttacacctgtaatcccagaactctggcaggctgaggtgggtggatcatgaggtcaggagattgagaccaacctggccaacgtggcaaaaccctgtctctactaaaaaatacaaaaaattagccgagcatggtggtgcgtgcctgtaatcccagctactcaggaggctgaggctggagaatcacttgaactggggaggtgaaggttgcagtgagctgagatcatgccactgcactccagcctgggcaacggagtgagactctgtctcaaaataaataaataaatatataaataaacaaaaaaactcatttcctctgataagttttccttggccaatctgtgtaacatagccccacctccatcattctcgaattccttaccctattttatttttatacgtcacccttgacattatattagacatttgtttattgtctgttgtcctcattagaaacaaaaggtccacaaaggcatcgacttttgtctgttttgttcctgaagtatctacagtgcttagaccttcccaggaattgttcaatcaatatttgtcgaatgaataaacaacagcactttgagagaagaaggctcactttacccacccgctcctctcaccccagggagaccagagaatctgtcatgtagaccgagatatgactgacccagggtcctgggaagtaatgtctgatataaaaggatatcttcctttgttcaaagagggagcagagaatatctgggccaaatgactaaggcaggtggcttggaagtctcgacagagcaggtggaagtcgacagagcaggtgtccctgtggcccagggaactggttggactagttttgtctcctttggggaggaaggagtggaggtggcagctacgggtgctcccaacccccaaggctgccagcaagtgacccccccacacacaaggctttcagggcctgaagggtggtgatcagggaggtgagcaggctccatctaaggattggcagtgacttcttactagctgagggtgcctcaggtaggcttaggcacagaacccaactttagggccttgcgtcctttgaagaatcacagagaataaacaggcccagggagagaaaaggtcttgtccaaagtctcatcaaggcaaggctgcttcccaggccactgctacctcagtccacttatttattgattaaatatttcttgagtacctatgacgtgccaagcatagttctttgatgatacatcatgagcaaaacaatcatttgtggagatcctttgtggaggaagcagaagataaacaacaaagtaaataagtaagttatagatgttaggaggtgacgaggactatagagaaggaaaaaaagtagaggtgagtagaggttttgagagtttggagggtgctggtgtgtttgaggaagagtagaggggccagtgtgattggagtgaggcactggaaagggggagggcaaggaggtgacaggaaaatcatgacatcatgtagggacttgagggacattgaaaggactttgggttttacttgagggacgtggagagccattggaggattgtgagcattcagtgactggatccgacatacatatgtatgtccagtgtcaaaacatatatatgtgtgtgtgtgtacatatatgtatatatatatgtgtgtgtatatatatatgtcagatgtcaaaaaaatatatatatataattttttttttcctgagacagagtctctctctgtcacccaggctggagtgcagtggcgtgatctcagctcactgcaacctccaactcccagattcaagcgattctcgtgcccctgcctcctgagactacaggtgcatgccaccatgcccagctaatttttgtatttttagtaaagatagggtttcaccatgttacccaggctggtcttgaactcctggcctcaagtgatccgcctgcctcggcctcccaaaatgctgggattatagggatgagccactgtgcccagccaaacacatattttttaaaggatacctctgcttaccatgtagagaatgagctggaaggaataaagatggagacaggaaggccaatgaggaagagtattaggttcctcttgcttctgtaataaagaatcagaaacttagtggcttaaaccaacacagatcttatcactctggaggtcagaagtctgatatggttcccactggactaaaatcaagtgttggcagggctttgtccttccggaggctctaggggagaatctgttccattgtcttttccggtttctagaagccacctgcattccttggcttgtggcacctttctccattcaaaggcagaagggcagcatcctgccagtctctgactctgaaacctcttgcttctgttttgtgattacattgaggccagctggataatccacaataagctcatcatttcaaactccttaacacttctacaaagtccatttaaggtgagattctggggatgaggacatggacgtctttgaaggaccattatcctgcccaccaggaggctactgcaatagtgcaggcaagagatgatggtggctttgaccagagtaaccgcaatgaagatggtaagaaatgatagctttctggatatattttgatgatagagccaacaggatattctaagggattggatgtggacttttccttcctcgtgcaggtagacttctagtctacctgtgccttgggcctgcgcctgggtgaggatgagggtttccctggggtaaagtccagggagtcacagtcattgactggagcctgtgtggccgtctagggcctgctgcatggcctgcatgtggtcagacaaatgggtatggagtaggccctgtaacccaccattagcacaagtgtagggtcctttctggtcaacagtttcacccacctccccctcactcctcacttaacccctcaagttctgctgggttgggcctttcctgcccccatcgcttactttgccccactcccctgggaggtgagacctgctcccaggcccaccacactttatttatttacctgtttgtaggtgtgagtgtctctctgttcattcattatttgcatgtaggcagaatagcacagtggctaaactggttgcctttacagtaagaatcccagctctgcctcctacaagtgtgtgatcttaggcaagctgtccaacctctgttaatgtataaaatgggaacaataaagcctacctcatatagttgttgtgtgggctaaatgaggtaatgcatgtaaaatcctcggctcagtgtctggcttagcataaagtgctgatgaagattctctgttattttctcacggttcaagtgccaaccagtccactcaataatggtgtgatcttcggcaagttattcaacctctccaagcttctgtttcctcagctgtaatctgtaactacctcatagaactatagttggatgattaaatgagataatctggctgggcgtgatggctgacacctgtaatcccagcactttgagaggccaaggggggagaatcagttgagtccagcggtttaggaccagcttgggcaacatagggagaccctgtctctacaaaagatacaaaaattagctgggtgtggtggcacacacctgtggtcacagctactcgggaggctgaggtgggaggatcgcttgagcctgggaggcagaggttgcagtgagccatgatcgtgccactgcactccagcctgggtgacagagtgagaccctgtctcaaaaaataaaataaaataaaaataagtaaataaatgagatattctatgtaagctgtcagagtgagagctccgtggatgttaatgattattattcctgttgttattatttcataaatatctgttgaatacatactctgtgctaaggcctttgtctgtgttgtcactgaatcatcagaatggcctggtgaggaatatagtgttatttctgtttcacagacaggaaaaccaaggcaggtaaagcacatggctgaatggcagagccccaattctaatctaggtctgtgtggtaggcaccaaaacatgttccctcttcattacttcaacgcacttttaaaaattgagataaggggccgggcgcagtggctcacgcctgtaatcccagcactttgggaggttgaggtgggcagatcatgaggtcaggagtttgagaccagcctggccaacatggtgaaacctgtctgtactaaaaatacaaaaattagctgggcgtggtggcgcatgcctgtaatctcagctactcaggaggctgaggcaggagaactgcttgaaccgggacccgggaggcggaggttgcagtgagccgagatcgtgccattgcactccagcctgggcaacaagagtgaaactctgtctcaaaaaaaaaaaaaaaaaaaaattgagataaggccgggcgtggtgtttgtagcctgtaatccaaaactttgggaggccaaggtaggcggatctcctgaggtcaggagttcgagaccagcctggccaaaatggggaaaccctgtctccactgaaaatacaaaaattagccaggtgtagtggtgggcacttgaaactgggtggtagaggttgctgtgagccgagattgtgccactgcactccagcctgggcaacaaagcgagactctttgtctcaaacaataaaaataaaaattgagataaaattcacatgacataaaattcaccattttggtcgggtgcggtggctgatgcctgtaatcccaggactttgggatgctgaggcgggcggatcacctgaggtcaggagtttgagaccaccctggccaacatagggaaaccccatctctactaaaaatgcaaaaaattagccaggtgtggtggcaatacctgtaatctcagctactcaggaggctgaggcaggataattgcttgaacctgggaggcagaggttgcagtgagccaagattgcaccactccactccagcctgggcaacagagtgagactccatctaccaaaaaaaaaaaaaaaaaaacctcaccattttaactaaagtatacaatgcagctcttttttattacattcacaatattgtgtaaccatcgccacaatctagttacataacattttcgtcatcccaaaaagaaaccctgtacccattaagcagtcattctcctttttccccctctctggaccctggcaaccactaatctgctttctatctctatggatttgactattttggacatttcatatagggtcagcctgggtgacagggtctcactttgtcacccaggctggagtagagtgatgaaatcacagctcactgcagcctcgaactcctgggctcaagtgatccttccaccttagcctcctgagtaactgagactacaggcacacaccaccatgcccggctaattttatttattattattattattttgtatagctggggtgtcactatgttacctaggctggtcttgaactcctgggctcctgcgatcctcctgccttggcctcccaacgtgctgggattacaggcatgagccacagggcctggcctcattcctttgcatttggatacccagctgtcttagcaccatttgttgaaaagactatgcttcccccatttaatggtcttagcacacttgttgaaaatcaattgactatagatgtataggtttatttttgtactcttgactctattcaattgatcgataaacttctttattgtagctttgcagtaagttttgaaatcaggacatgcgaatctttcaactttatttttctttttgaatattgttttgactattcagggtctcttgcgattccatatgaggtgtgggataaacttgtccatttctgcaaaaaatgcagctcagattttgaaagacttgtattgaatctgttgagcaatttggagagtgttgctgtcttaacaattaagtcttctaatccatggacatggaatgtgtttccatttatttatgtcttccttgatttctttcaacaaggtttggtacttttcagaggacaagcctttcctttccgtggttaaatttattgctaaatgttttattatttttgatgctattgtaaatggaaatgattcttaatatcattttcatattgctcgttgctaatgtacagaaatacaactgatttttgtgtgttgatattgttgaactttgctgaactcattttagttctaatagctttctgtgtattctttaggtttttctctatatgagatcatgtcatctacaaatagaaatagttttacctctgcttttccaatctggatgccttttatttatttttcttgcttaattgccctggcaagaactttcagtacaatgttgattggaagtgatgagagtaggcatccttatcttattcctgatcttagggggaaagctttcggcctttgtcttcaccattaagtgtgatgttagctgtgggttttgcacagatgccttttaccaggttgagaagttctctcctcttcctagttggctgagtgtttcaggttttgtttttttgtttgtttgttttttgtttaatcaggagagaatgttggatgaactcttttttacaactaaaaatcagcgaagtcctctgtatttaatttggtataattatgtgagaccaagtttcataattaaggttttatttcataatttttttgattttttgggacagagtttcactcttgttgcccagactggagtgtgatggtgtgatctcggctcaccgcaacctccgcctcccaggttcaagcaattctcctgcctcagcctcccgagtagctgggattacaggcatgcaccaccacgcctggctaattttgtatttttagtagagatggggtttctccatgttgaggctggtctcaaactcctgtcgtcaggtgatccgcccatctcggcctcccaaagtgctgggattacaggcgtgagccaccgtgcccggcctcatttcataattaatgttttcaaagaaggttacaaatatatggctgggtatctttaaccatgtgactttagtcaattcctacttctttgggcctcagtttcctcaactgtaaaatggaggtggatagtaatgcttacttcatggggcttagagggatgatggagataagatgggatttttgtgtgcaaaggcactttgcaaataaaaactattcttctgttgctgctcttattagagatactttgtgtgtgtatttttgttgttgttgttcgtttcttttttgagacagggtctccctctgttgcccaggctggagtgcattggcgtcatcatagctcactgtagctttgaactcctgggcccaagcaatttttccacctcagcttcccaagtagcccagactacaggcttgcaccaccatgcctggctaatttttaaatttttttctagagaagagatctcactatgttgcccaggatggtgttgaactgtggcctcaagcaatcctcccaccttggtttcccaaagtgctgagattacaggcatgagctgccatgcccagctagagatgttatttatttatttatttatttatttacttatttacttatttttgagatggagtcttgctatgtcgccccggctggagtgcagtggcatgatctcggctcactgcaacctccacttcctgggttcaagtgattctcctgcctcagcctcctgagtggctgggattacaggtgtgcaccaccatgcttggctcattttcgcattttttaagtagacttggggtttcaccatgttggccaggctggtctcgaactcctgagctcaagtgatccatccacctcggcctctcaaagtgctaggattacaggcatgagccaccatgcccagcctggagatgttgttttaaattgtaatataacatgtttaataaagtacataagatacataaagggcaatcgtcttaagtataaaaactgattaatttgtatacagccatgtgaacacctctggatcctgctattgaacctgttagcaccttgtaagggtcctcttcctggtctgtacctccctggaggtaaccattattctgattcctaacaccatggattagttttgcctgtttttgagcttcgtatatatggagtcatacaagcttttgtatctggtttctttcactcagcataatatctgtgagtcatccaaattcttgcatgtatcagtggctcattctttttcacacagttttgaataagttaatacgagttggtcaaagtttgaaaaggctgtgcatttgtctgagagaccagaaaaatacaggccagcaaagcccagggctctccagtattgagccagtccactctgtgaatctctatttatggcagctgaattctcagccaggatggcagctactttgcccatgtgtcaccacttcccatcccataccctgggtagacatcacaaatccatcttgagcacttttttttctttttttgagacagtgtctcactctgtcactcaggctggagggcagttgcatgttcacagctcactgcagcctcaacctcctgggctcaagtgatcctcctgcctcagcctctcgaataactgggaccataggtgtgtgccaccatgcccaggtaatttttaattatttcttgagactgagtgtccctatgtcgcccaggctggtctcaaactcctgggttcaagcaatcttcccatcttggcctcccaaagtgctgagattacaggtgtgagtcgccatgccgggccaatcttggcacttttttttacaagaacttctgatgcagcctcaaaattcttttcaacccagcggtccaggtggccaacactaattgcttgtagttggtacttgatatagtttggctgtgtccccactcaaatctcatcttgaattatatctcccataattcccattgttgtgggagggacctggtacgagataattaaatcatggcagcggtttctcccatactgttcttgtggtagtgaataagtgtcatgagatctggtggttttataaggagaaacccctttctcttggctctcattctctctttgcccgttgctatccatgtaagacgggacttactcttccttgacttctgccatgattgtgaggcttcccctgccatatggaactataagtccaattaaacctctttctttttgtagattgcccagtcttgggtatgcctttatcagaagcatgaaaacagactaatacagtactcaagattaaatctgaggcttctgctgtcatatccccaagatatttttctgggctcccagagttagaacatgaggggctctgttatcaccctcagtttaccacacagctgtatgaaactgatggtggtgaggtccacagcatcttcctgttcatatatcctttgggtaatggctccaacccagcaagtgttttgctacctatgtacctgggagcaacttgacttagataagaggtgatgaggcagactgcttagatgtggaggggctgctgcacccatgaggtggcttgactgaagcctctttgtttttctcttttactttgctaaaacattgcagtgtctcaattacggaacaaacacaaatgtgacttaatgtttaacaatactcctgtgaattcttgacagttctagcatgtctctcacatttgaaaaacttattccaaccacaaaattgggtgaaatgaactctaccatcctctgggaatggctgcctgtatgtgcagggttggaggttgtggctgattaaaacaacaacaacatccaactcatggcttttgtccaaatgtaaatcatagtctgagggaggagataagactcacatataaactaatagaggaaaagtccagctaagctctcatttatttgaaactctgatcctgagcaacttcacatatttgaaaagtacaggaaggaataaaaaatacctttgagaagctgtatttttcttcatgggagagcatttcagctcctcatttagaattggtttattctttgtttttgtttttgttttttttttgagacggagtctcgctctgtcacccaggctgtagtgcggtggcgagatctcggctcactgcaagctccgcctcctgggttcaggccattctcctgcctcagcctcccgagtagctgggactacaggagcctgcaaccacgcccggctaatttttttgtatttttagtagagacggggtttcactgtgttagccaggacggtctcgatctcctgacctcgtgatccgcccatctcggcctcccaaagtgctgggattacaggcgtgagccaccgcgccggctattctttgttttcatgcaaggttaacacatgcaaaagattggaagcagcaaattagaatggtaggcttggggcaactactggctactaacagcagcctcactgctaatggatggagaagtgattttttccccctttttatccaccactaagagtctagagaagtgatgcttgacaccaaagacaatggaaaaacaatgaaatgtggtaccacaattagctgcgtctgtttattgcagaggcaaaaaagtcctcaacgcttctgccacttttgaaagttctgagtctggttcaattcttattgcctataaagatgacagaatacctaagaataaaatacacatttttgagcatccgctaggtgccaagtctatgctcagcaagtactttacattctatatctcacataagcttcaggtggtcctgttacgatcatctccagtttatacttgcaggaagggaggcacagaaagtaggggaaataacttgcccaagtaagtagtcaaggctgggttttgaacctttgctatcaaagttcagtgccaaggcccttagcttctgctaggtttcaaaggatctgttaggtgaatgaagagtagaaaggcattccaggtagagggaagaacatttgcaaagacaggtctagtcagtcagtcacttgatttctctgaatcttggtttactcccctataaaataggaacagtattatctgtcctaggctgcttatgataattaaatgtgtttttttttctttttttttggagaccaagtcttgctctgtcacccaggctggagtgcagtggcgcaatctcagctcactgcaaactctgcctctggggttcaagtgattctcctgcctcagcctcccaagtcactgggattacaggcacgtaccaccatgcctggctaatttttgtatttttagtagagacggggtttcaccatgttggccaggctggtctcgaactcctgacctcatgatccatctgccttggcctcccaaagtgctgggattacaggcgtgagccactgcccccggccaaatgtgatattatatgtacagcactttgcacaatgccagaatgtgcatcgatggtgcaatcacagaatgtgcatcaatgttaattattgttgtttttcaaatacaatagttctcctttatcctcaggtgtacctgcaagtggatgcctgaaaacataaatagtactgaactttatatatactgtgttttttctatatatatacatctatgataaagtttaatttataaattaggcacagtaagagattaataacaactattaataaaatgggacaattataacaatatactgtattcagttttgtgaatgtggtctctctctcaaaatgtcttactgtactgtattcacccttcttcttgagattatgcgtgatgtcaaaatccctatgtgatgagatgaagtaaggtgaatgacacaggcattatgaggtagtgttaggctactactgaccatctgagatgtcaggaggaccatctgctttgggtgatcctggatcattgagctatgacgatgtcagtggttggatatcaggatcagacgatgtcaaccaatgattgggggtccttggataattgcgtttttgccaaaaacttttggaagaacattattactggaagttgtctctttctttctttttctgagatagcatctcagtctgttgcccaggtttcagtgcagtggtgtgatcatggctcactgcagcctcaacctcctgggctcaggtgatcctcccacctcagcctcctgagtagctgggactgcaggtgtgcgccaccacacccagctagttttttgcattttttgtagagatgaggtttcaccatgttgcccaggctggtctcaaacctgtgagctcgagtgacccgcctacctcagcatcccaaagtgctgagattacaagcgtgagccgctgcacctggccatctctttctatttaattcttttttttttttttttttttgagacagagtctctgtcgcccaggctggagtgcagtggcgcaatctcggctcactgcaacctctgcctcttgggttcaagcaattcttctgccttagcctcccaagtagctaggattacaggtgcacgccaccatgcctggtgaatttttgtatttttagtagagacaggatttcaccacgatggccgggctggtctcaaactccgggcctcaagtgatctgcccacctcggcctcccaaagtcctaggattacaggtgttagccactatgcctggcctctttctttttaattcatagaagtgtggctgcagaagttgtaatcctttggtgaccacacgagtggttttaatgctgtgttctatctgaggattgaattccataattttgtcctttaatgtctgtgcaatttgaaacactcggcaaattttgataacacccatattgctggttctgtttctgtttctccttcattttcctctttctttgtagatgacttgacaagttcttccaattccacatttgttaacacttcccagtggccttcaatatgatcttccacttcttcatcaagcatgtccccaaatccttctccaccaacttgtcttgctgtagcctctccagtaatatttatttatttatttgtgacagggtctcactctgtcacccaggctcgagtgcagtggtgagatcacagctcactgcagtttcaaactcccaggctcagatgatcttcatggctcagtctcctgagcagctgggactataggcctgtgccatcatgcccagctaaattttgtattttttgtagggatggggtttcgccatgttgcccaggctggcctcaactcctgggctcaagcgatccacctgccttggtctcccaaaatgctggaattacaggcgtgagtcaccgcacccaacctccagtaacttttttttttttttttgacacggagcctcgctctgttgcccaggctggagtgcagtggtgccatctcggctcactgccagctctgcctcccgggttcacgccattctcctgcctcagcctcctgagtagctgggactacaggcgcgtgccaccatgcctggctaatttttttgtatttttagtagagatggagtttcaccgtgttagccaggatgatcttgatctcctgacctcgtgatccgcccgcctcggcctcccaaagtcctgggattacaggcatgagccaccgcgcccggccttttttttttttttttttttgacacggagtctctctctgtcgcccaggctggagtgcagtggcgcaatctcggctcactgcaagctctgcctcctgggttcacgccattctcctgcctcagcctccagagtagctgggactacaggcacccgccgccaccatgccaggctaattttttgtatttttagtagagacggggtttcaccttgttagccaggatggtctcgatctcctgacctcgtgatccgcccgccttggcctcccaaagtgctgggattacaggcgtgagccaccgcgcccggctccagtaattttttttttctttttgagacagaattttgctcttttcgcccaggctggagtgcaatagcacgatttcagtttactgcaacctctgcctctcaggttcaagtgattctcctgcctcagcctcccaagtagctgggattacaggcgtgcgccaccacgcccagctaatttttttatttttattttttatttttagtagagatggggtttcaccacgttggccaggctggtctcaaactcctgacctcaggtgatccatccgcctaggcctgccagagtgctgagattacaggtgtgagccactgtgcccagcccatccagtaatttttatattttgcagtctaaacctattcctaagtcagtgcaaccatccattactttcagtaagtggcttggtgccactggttttaggagattccttgctgaagcctttatacaggctcaatgctttctggggggtaacaggttgctgtcagttggaacacattttttgttcgtgtcttccacgtataagcttaatgctttttcttttcttttgtaaaaaaatttattttctttttttcccctgtaagtaaggatacaacttaatgccttttctatcttaactaagcacttatcacacactgtggctgtaacttttgcagtttgaggtacgacagcaaaaccagcatgaatttctttttcctctttcacaattctagggctagaagattcgttcttactgcagacctcagtaagctcagcatacgattttttttcttaagctcagaacttccacatttacatttaaaggaagcactttacagcttcattttggcatatccaaactgccagcattactactcttgcactttggggccattatatagtaaaatgagggttactcgaaccaaagcactgcaacaccgtggcagtccatctgataactcctaagctggtaagtaactaacagatggtagaggtatgttggacaaagggatgattcacattgcaggtaggatggaacaggatagcacgagatttcattaggccaatggaaattaaaaacttatgaactgtttatttctggaattttctatttaatactgtcagaccttagctggccaagtgaaactactcaaagtaaaatctcagataagggggacactaccgtacttaactggagaagatactgctttgcttctgtgaccacagaattgacaggttgaaattggaaacaactgttgccttcacgcttttaagacaacttcacatgaatatacatgtgaagttcaagcatggcagtatcccatactagcaataaatttttgagcagtgttgcacacttactgtcatttctcttactgttctgccactcctacagagcgcaggccaaggagactacatttcccagaatgccacacgccctttgaccccagctacagcaaaagacgcgccggggagcgcctgaagccggaagactatagcttcccggcatgcagcacgcttccccctattagatttgaggcgcggccggcgcgttgcccactgggagttgtagtcagtggcgcgttgccctgacgcctgccgggccgggcgtgggggcctgtgggaggtggcgcggccgggcccagctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcggtgaggctgcccggccccttcagacttgccacgggctccccccaggctccccgggcccggacttcaccttcatcagactcgcctcggggtctggtctgaccctggaactctccgggtcagacttcttgccgggtctgggaccccctccccgactcccttcaatgtctccccgatccctggacttttccatcgtcagacttattctgccctctcccctcagcctctctccaccccgccaggtcccttcagaccccaatctcacagcactttcctccgccctcactctgtccctttctcttccgccttttccttctcgcctcacccacctgcctagctactgcccctgcctcctcctcggctcatttctgcccccatcctagcatttctgtgcttcctggtcctacctgtgccctctcccgactcctcggtggaatctgtgagctgccccttggcctctcccctgtcctcttgtctcagaattctcgttgaaaagcctccttgctggagagaaaaggggactgggggagatgagacccccgattcctgctctattcacttgctgagtgaacttgagcaagttgctttccctttgaggcctcagtttccccatccgtcagccagagttcggcctctgttgaggcctaaggtgttttccagcgttgtgattcactttttgttgcctcgtagcttgaccttaccaaagtttcccgtggcgcaagccttcaccccatgactcaccgcttccccatccgtctgaaccagaaatagagactcccgactgctccccagtccccactactaggattcagggccccagtattgaatcttgaggcactgcttactttacttcctgttgtcgtatggctttctgggcattccaagtgctttgtgtttttcttaagtgagatgaatgtgaaaatgctttaaaactgtaaagcagtttagaaatgtttgctttttcttgttatggccatgtgagagtgaatcacagaacgacatcccttccccttgagaggggtttaggattgaggtaattcactcagaagtctgctagtgactagcagtgcgaccttgagctcatttacctttctgaaaggaaaatcatggatttacagtgctcagcacatagtaggggctaaatcgatgttttctccattctaataggagaacaaaatagcctatctggaggatgcttctctgctgatagtcaacagatattctggaaattctttttagtgcctgctgcatgcgctgtattcataggggtgaacaaaacacggcctcaaccctaatgggagagaagacagaaacaggaaaataaatgaagaaaatattgtccgggggtgataagtactaaacacacaaaaagatggtctgatagggagtggtggagtgggagggatgccactttggatagaatggtcagggaaggcgtctttgaaaaggtaaagtttgaactgagtctggagaaggaaccagctctgtaaaaaaaaaaaaaaaagggggaggagccttctgggcgtggaaagcagcatgggaaaaggctcggaggttagcaggttgtaagaaaccgaagagagagacccttgtgtccagaatgtagtgcttggagggagagtggtatggaataaagggggcggggcttggactttgaacctgttggtgaagagtttgaattttattccaagtggatggaaagtttttggagagtattttgttggaacgtgtccttattgacagagtttttaaaacatcatctggctgctctttggagagtgggtgggggatgcgggtgggagcagggagaacagtgaggaggcagctgcagtggtccatttgtggcttggactccagcttagttgtggagatgggaacagggttatattttgctgtctctagctttttcctctgatgactctccctcagtccagatcctctgtttatggtcatcagaatcagtgtttttagctttctgcattttggaatgcaggaggagggtgtcagtttaccattttcctctgatcttttggtctggagctagcttagtttctggagtttgtttttttgtttgtttgtttgtttgtttgtttttgaaacggagtctcgctctgttgcccaggctggagtgcagtggtgcgatctcagctcactgcaacctctgccttctgggttcaaatgattctcctgcgtcagcctcctgagtagctgggattacaggtgcacgccaccatgcctggctaatttttgtatttttagtagagatggggtttcaccatgttggtcaggctggtcttgaacacctgacctcatgatctgcctgcctcggcctcccaaagtgctgggattatgggcatgagccatcgcacccagccgtttctgcagttttggcgatcgaattgactttcaaggggctgcaggagagctcgccagccaactgtggaggaccaatctcagttgtcagacttgctgaaggcaggctgtctccctgagtttgcttgagaggatgggagctactgtaacctacccttctttttagcatcctctaggaggaaggtcttagtgtggggaggtgaacactaccacattaccattcagttagtctgcttattcacctgccactatgctgggaccttgagagtcagagatgaaaatacactgtgtcagcccttcaggaactcagaattggaagtgtggggtgggagtgtatgtgcgtgtgagagagcaggaaatgattataacagtgcagaaacatgagtgtgtacatgggctgaggctgcagaggaggcggcacctgtttggggggaaggataaagaagacttggcagaggaaggagaacgtgaggtgggtcagcaaggagttgggtgtgtttgggaggcagtgacagtgtcgcctctggagtctgtgggtgggacaggagataacactgagagtggcctgtagtctttggaccttgacctggaagtagtgaggagcccttagctgtcctttatttttatttattcattcactttaagcaacagggtcttgctctgacatccaggccgaagtgcagtggtgcagttatagctcagtgcagcctggcactcctgggctcaaatgatcctctcacttcagcctcctgagtagctaggacttcaggcacatgcctagctaattcaaaacatttttttttgtagggacaaggtctcgctctgttgcccaggctggtctcaaactcctggcctcgagcgattctcccgtattagcctcccaaagtgttgggattacagccactgtgctcagcccttggctggcttttaaagcagagagtcatcatatctgtttggaattttgaaagagcactctagcagcagcttaaaggaagaagtgtagactgaccaggaagggactggaggcaagaatcccatcaggggcaaggatagtgcctttcagacctgggtttgagctgcagcttcatcatttccttgctgggtacctggggcaggttactctgtacctcagattcctcctccacaaatcagggtactagtatctgcctgattggatgaaaatatgttacgcatgccaagctcctaggacaatgcctgccatatggtaagtgaccgataaatgcttgccattatcattattacaaggagacttgcaattcttcaggtgagaataaagggcctagtgtagaagcatgggaaactggaagagaaataatacatgtctgagacttttctgaaggagaatcaaaagagacttggtgatttgttgtaattgtgggagtgggcaggacgaaggagagaggggagtggaggatgattccccagttcatagcttgggcagctggttggatggtgatggcagtaatgaagttgggaaacaggagaaggagcgtgtacttgataattgtatagtcctggtaggtttggaaaaccgctcagcatcccctgaaactgtgaggtccatgaagtaagatgtgatggtcacattcatcactgtgtccccaccacctagcacagtgctttgcacatggttaatggtcagcatttgttaaatgaaaaaaacaatcttgtgggtaagttctgttattcccattgtacaagagaggaaaatgaggctcacgacgggacgaactcaactcaaagaccagttctgttgactgtgggcatcttgtgttgtttactcccatgatgactaagggtgtcatcatgaccatcaccatgttcattaaacactcagttcattaaacacccacctgtgcaaggtgtggtgctgagtaggggaaaaagaagtaaagcagaaacaggctattccctgctgggtgtgtagccaaatgtagatgctatctttgaggcatacacattggaaagatgaaacaaacttcagaagctttgaaacagacctcagaagcttgagtagagtatttgcactgtgtaggtgtgtcccaggtagtggttccagtgaggagcctagagcaaaatttggattgcttttttttcccaaatttcatttctttttctttagtcatatattcattcttaagcatgtggcaggcccttactgtgtcctaggccccatccttggtgctgagaatgcagacgtgaaccagatgtggtctctgccatccaagggacttaaatatcatcatttatgaaataatattcatctcacatgcctatggtgaggattaactaaggtaatatatgaaagagtgtggcaaattgtggatattgagtaagtgtacttttcttttctgataaagttattgttgatcagacttctttggtttagttgtctctttcattgagaactggatagaaaccaagatcagagtttaggtgaactgacagaaatcacccaaagctaggtcttttttggtacctttctaaacaatgccctttggttttctccctaagaaaggtgatcatacttttctggagaacatgtgggaaaaaaaagaaaagaaaaaaatggaagatgatcaaatatcaaagattcttttctttttaagtcttggtaactagctaaggaaatatctactctagatggttcagatttccctttttttcctgttttagtaaagatgaaaacagttgtagacaagatcatagtttaacaagagaattggagaagattaggaaatggagagtggcatctaaaacaccctatactggtacatttctgtgaatttatggatgcaaatcagttcatttacaggttaatttaggtttagctgagaatgtctgatggatgcatagaggccagaagctcacaagagatatatcttcattaagttctgctcattgctggagtgagggtggttttctcatgtttaataaagtctctctcaaacatgagcatatgtgaagacactgtaataagtttatagtcttatgagacaaagaacgtggctctttggttctctggaatcaagatctcaggttgaaaagcacagtgtcttaatggcgcatgtgccagcagtatctcttatcccagaggcccagggatagaaaactcgaaatccacccagggaagtgagcagtgggaatttccctcagtgacgcttaagtttcttgtttggaaaaatggttggctagattgagtttggtttacttcctaagacagatggagtaccagaggccctatgtgttggctatccaaacacactggttcctttaattcaaatgacaaatccttattttgccccatttggcagggagattagatatttttaattgcctgccagagtaggtttataatgtgatttgtaactcaagatagattttgtttggaagtttaactaaacgtgaagacctgtgagcaggactgttttgcttggagaaaccttgagttgtccagagttgggtttgagtgtggagcgaggtcttggagagcatcctatgaagatgtgtgcgagccagccatctccgaggcgtaaagccaggacctaatttgtttacagtggtccagagccttgacatgaagccagagcccaccaggaggaggggcagagctcttggggccttgaggaatttcttatgaaaacttagtcttcttgctcagaattattttgggttgtgccactgtctttaagagtgtgagagagaggatattagaaaacaactttagttggtcattttgcagatggatgattatatttagaaggggaaaatctgagcatagcaatgggaaactacagatctagctgtttgtagtactggcctgtttttaagctgtttggctcaagtcagcaatcatttattacgtttcttctaggtggaaggtgtggtgatgtgggcaaaagattcccagtttgaatgcagctttacctttcatcagtagtaccttggtagttacttatatttctctgagtctcaattccccactgtgtgaaaagggaaatactaccaatacttacttgttagggctcttatgaggatgtggaataagttgatgtatgtagagtgcctgccagaatgcctggcaaataggcgagatgaaactgtttccttggcttcccagggatagtcttagggacagtaaggctataaagatggatgagacactgccttctccccacaagggcccacacagttcatcgaggaagacacacaggtaaaagtaactatgagaaaaggcaaaccccaagtttacaaatgaagtgttagaggaaaatacagcaggaagagtttaattcatctctgaggttgcaggttcatctcacccagccacccatccaatgcccagattccctctgtggcattcctgccaagtgattaacctctgattgaacccctctgttgacaggatttatattaggtgccctatcctctcacactatagcatagtctgtctctggacagctccaactgtaaaatcacctttcttaattgggactgatatctgtctttctatagtacctacctctgctacaggttgggataatagctccatagggaagcagcctgggctggtgaaaagaatgtgggatttggggacagaagggttggggcaaatcccagctttgacactagacatttgtgaactagaaaacgggttgtgatttctgcctcttggggccacagagaacaggtctgatcccgcttctacatcacagatcaaggaagattgtgtttatgtctcaagcctgcacttctctaggacagccattctacatttcattgactgtccattttttggtgcttctgttccttcctttttactctcctttggatgtgctcctgttcaccagtgttgctcttttttgtttgtttttttttgagatggagttttgctctgttgcccaggctggagtgcagtggcgccatctcatctcactgcaacctctgcctcccgggttcaagtgattatcctgcctcagcctcccgagtagctggaattacaggcatgcgccaccaagcccagctaatttttttgtattttcagtagagacgaggtttcaccatgttagccaggctggtcttgaactcctgacctcaagtaattcgcctgccttggccttccaaagtgctgggattacaggtgtgagccaccgtgcccggccagtgttgctcttaaggtgtggagtggacagagctgaataatctgaatattctagccaaagtctgagcagcacaaccctagaacaggcagggccgagccatttgtttaggaactagtttggttatgagtgctctttagccctgatacttccggtatcactgagacagggaaaagtgatcgtattttcctgtggcttattcattagtaaagggatgagcatctaggaacccctaaagtttgtttggtccttcttaaagagtcttagctgaaggattgaatgatttaagttcttaacaagagcatctgctggcttgattccttgacagctgatatttctagctctacctcctccctcttccttacagggcagagctggcttggagggcttatttgagtgatggaggaaagctatacatccctctggttgtggttgtttagctcaaaaggtcagtgatgtggtatagtggaaaaggtgctagctttggggtgagaaggcctgagttcacattccacctctgccgcttgctagtttggtaacccagggtaagcctcctcatgtctctgaacaacagcttctttagctacaaaaatggaatacagaattgactacacaagctttctgctcaaagtgtgggctatggagacatctaggaaattgttagaaacgtggattctggccaggcgtggtggctcacgcctgtaatcccagcactttgggaggccaaggcgggtggatcacgaggtcaggagatcgagaccatcctggctaacatggtgaaaccccatctctactaaaaatacaaaaaaaaaaaccaaaattagctgggtgtggcagctggcagctgtagtcccagctactcaggaggctgaggcagcagaatggtgtgaacccgagagccggagcttgcagtgagccaagatagcaccactgcactccagcctgggcaacagagcgagactctgtctcaaaaaaaaaagaaaaagaaaaaaagaaatgtggactcttaggccccatcctgacctactgaagcagaacctgcattttatgagatcctcaggtggtttgtatgcccatcaaagtttgagagattttaaaacagatctggatattttacactttggggactctgatgttgagatcccaaatctttgatcttaatgctgtataggtacacatttgcatttaatttcagttgatccattttcaaagatggtagctagaaacttgcttcattcatgaatctatttgatagataagtatgtagtaatttgagctgtatgctagatactgtcctagttgctgagtaaatgcagatgaagacaggtccttgcctctgaggtgcttaaaatctagccaagtgacacaagtaaacagataaccagggtacagtgtgatttgttctagaagcatacttaggattcagtttgtgacatgcagtggagggaactggaacaacttcattgtggggggtgggggacttcaatttatgttttatcgaatagttattttggggagtaatggaatgttagagcagaaaggaactcaaaatgtatgagtgcttgaaactttaaattaataggaagagttttttgcgaaagaaaaaccaggaacgtggaactatttgcagtactttaaaaaagtactttatttgaatcagaagcctcttagcggggacatgagaatggatcagtgtttaacttggtcataaaataattagctttggaatactaaatttagagtatagtttattctgataattaatttgcttaattattcagttaatgattcagttaaaattataattgtcttcctacggaaggaagtaggaactaagaaacctgagcagtggattctctactgtctgcataagcaatcattataaattcctggtttggccgggtgcggtggctcacgcctgtaatcccagcactttgggaggctgagatgggcggattacctgaggtcaggagttcgagactagcctggccagcaaggcgaaaccccatctctactaaaaatacaaaaattagctgggcgtggtggcaggcgcctgtaatcccagctacttgagaggctaaagcaggagaatcgcttgaaccacggaagtggaggtggcagtgagccgagattgtaccactgtactccagcctgggtgacagagcaagactccatctcaaaaaaaaaaaaaaaaaaaatcctggtttgtagtctttataatatctaatagttgtataaataaaaataagactttacatgtgtgtagcccagttgctattccctgcagaggtttggagaggagttgctacccagactaggatttactctgtgactcctccagtaggctgaggaatttgatcagcatggtgtgtcccagagttccctggacttggagacattgactgacaagactgacatttaaaacccagattaggctgggtatggtgactcacacctgtaatcccagcactttggaaggtgaggtgtaaagataacttgaggccaggagtttgagaccaatataggcatcaaagcgagaccctatctctatttttttaaaaaagttaaaaataaaagcccagattattgctattttctttcttttcttttctttttctttctttctttctttgtcagtcttgctgtcgcccaggctggagtacagtagcaagatcttggctcactgtaacctccgccttctgggctgaagacatcctcccacctcagcctcctgagtagctgggactgcaagtgtgcaccaccatgcccagctaaatttttgtatttttttttttttgtagagatggggttttgccatgttgcccaggctggtctcaaactcctgagctcaagccatccacccaccttggcctcctaaggttttgggattacaggtgtgagctgctgcacacggcctattgctattttatttatttatttatttatttttgagagtactgagtctctccctgttgcctaggctggagtgcagtggtgtgatcttggctcactgcaacctccacctcctgggttcaaacgattctcctgcctcaaccttgtaagtagctgggattacaggcacgtgccagcacacccagctaatttttgtatttttagtagagatgggggtttcaccatgttggccaggctggtctcgaactcctgacctcaggtgatccacctgcctcggcctcccaaagtgctgggattataggcgtgagccaccgtgcccagcctactgtcttaattctctatcaggtgaactagttgatttcatctctccaaagcatgttctccctttagaattttgcacataggcagcatgtcatcgcagattgcttggcaagtctggaggtaggactttgggtgtcaagttgtaatgggctccgatagccttctgtggccttgtctaaggagggaactgatgtcagcctggcattcagcttgctgctcctagctgacagggctgcagggctcacagctgcggacagccctcctcatgcttagattttagaggtaattttggaggtgtaaaggacacagcaatataggcccaggcctagttaagtacttttctttctttctttctttttttatttttttgagacaagagtctcattctgtcacccaggctggagtgcagcggtgcgatcttggctcactgcaagctccacctcctgggttcatgccattctcctgcctcagcctcctgagtagctacaggtgcccaccaccacgccgggctaattttttgtatttttagtagagatggggtttcactgtgttagccaggatggtctcaatctcctgaccttgtaatccacccgcctcagcctcccaaagtgctgagattataggcatgagccaccgcgcccggcccagttaagtaattttcatcatgcttaaaaacattgtatttcaaagaaaaattttttttttttcaaaaaaagtatccccaggaaatgaaaacatttcccccatctttgggaaataccatgtactttacaaacttgatcatgtttgatcttttcagcaactccatgtgtgagtggtattatcctattttagagatgagaaagtcgaggttcagattatatgagtcactgggcagatctagctctgtgacttggggatcctgaggtgggctgtatcacagtagattttctggtgtgtttgatattccataggatctcagctctgtcgcccaggttggagtgcagtggtgtgatcatggctcactgtagcctggacatcctgggctcaagtgatcctcccacctcggcctcctgagtagctagaactataggcatgtaccaccaaacttggctaatattttattttatttttcagacagagtctcactctgttgcccaggctggagtgaaggggcacgatctaggctcattgcaacctccgcctcccagattcaagcacttctcctgtctcagcctcccaagtatctgggatcataggcgtgtgccaccacagctggctaatttttgtttagccatagggtgaagccaatagggttgcacgatattggttaggctggtctcgaactcctgacctcaggtgattcactcggcttcccgaagtgctgggattacaggtgtgagccaccgcacccagcctaattttttattttttatagagatgggggtgtcactatgttggccaggctgttcttgaactcctgggctcaagcagtcttcccacctcagcctcccaaagagttgggattacagggatgagtcaccacacccggccccagattgctataatccttgagtgctcgtaatttatcaatagacagaatcttgtcattggaaatcaatttttataatattccctgtacaatatgagcacctatgcttattctgcagaggaatacttcacagtgttttatggcttccaaagaactttcacatacataatctggttttgaaactcagagaagccttatgtagggcagattatggtttttagccccattttttccctttttttagaggaagaaactaaggctcaaaacaattaaattgtgaacctagaggcagagtcaaggctagagcccttcttgaggctccaagtctagtgcgtttctgccactctgtgcatccaccctggctccttcctgttaatgctgcatttcagattccccccagcttcagcaaggctgtgtcagtagtgggtgtggtcaggttgaggagcacaaggttggggttggggtgtgggggtcccaagagtgactggaccgtgttatacacagtgggactagtgccaaggagacgaccaagaggagactgttattacattctggaatggcttgacagcctttattcacttgtcttcattcattcaattcgctacatcaacattgtgcatttccctgccaggtttctatcttttcccgcaataagctcattttctctgtgacctctagagtagggtttctcaaccttgactgctgacattttggactggataatttttttgttgtgtgggactgtcttgtgtattgtaggatgttcagcagaagctttggcctctaccttctagatgttcttaatacctccccatccagttgtgacaacaaaaatgtctccagatattgctgaatgtccccaaaagggtggggggagggtggcagaagctcctaggttgagagccatggctctagggcttgtcaagccactgcaaatagagctctagagtgttagaggctggtctaaggataagggggtcataaagagcagggctgggtggagcctgctaggtacttttcattctacccttttgttgttctgctggggaaaccaaggtctagagacttagcccaaggccacctggctctgctttctagaggtctggctagggctgggaacttgacctgaatccctcccactcaggactctgatcaacccatagtccctagtcttttcaggttgaagaaaccttttctaatttcaaaaaatatcaagaatgggtgtatgataatagttgtacttttaatacccgttaattgagaagatcagatattaattcccttcaaccgatattcactatatacccaccgtctttcttccctaggattgtgtctgcgtaaatggtagatggtcacatggtagttgtttttattattgtgtgatatattcatcatttagtgcacaggcagggcacagttgggcacattcacagagcgctggagtgaccactgtgaaccctatgagctcacagtccataggttgggaactgattgacacattataccaggagacttgagagaacagcaggtctgaaactctgggcttttcctgaaaccatgagctgtcttcacacttgagatggaaatctccacactctggaaataaaaagccaacaggctacccagagtgctcagtgctgctctctcaacagctatacactagggcatttgtgataaaagaagaggtatttggctggaaacaagctttaagtttctagcattagttggtaaatggtgcatgggtctaaggggagtataaaataatggccttgaacttgggaatctgtgtttgcagaacctctcatctcaaagcactgagcttctctgacaagaaccattgttcttatttcagaggtaagaggcagagaggccaagcccacacaaagggtctctgaaaaagagccagctccttccaggtttaggagcttggacccctgcttggcatcctagggtggagctgtttggttttatcaggtgatggtgggaaaaggaaaaaaggttgttaagttccacccagtttggcaaatattttgagtgtttactgtgagagactcaatttgaagggatggtgtgggtcatagttcttaccctccaggaactccctgtctggtgagggctgtagagaaagacagtgcataactctccgtaaaataaggcacgcctaccattggtattcagtcaaagtatggtaggagaaggaaggaggaagaagtgaattccagctgggagactctagggtagcaccagggggatggcagggattctgagctgggacttgatgaatgggatttgggaaggaggaggctggtaggaccattcgaggccgaggagactgtgggacccaaggtacagagattagcatatgctgtgtttgtatgtgggagggttgaggggttatggggtatagatgaggggtagtggtggctcaggtggggtgagagtatgggttgcggcctccctgaggggccctggatgccaagctgaggaatctgtgttagtttgaatttagcgagacacataccaaatggatactttctgtctctagagagcagtttgctgggaccagcagctatctccctacagcacccaggtgaagcttcccattggttaggttgtctgtccattactgcttgagggaatgaggtgtatctggggactgttcccttataaggaagtccatcggtcactaccctttctcttgtttgttctcccaattccccttctgctttatttgaagtccagccattctgggcagcttggtagaggcagaacagcaatttttctgttttcagagtatctcaggttgcatgtcaaaggtaagcaggcaaatcctctttgcttaaagtagcttgacccagcctcatttattaatcaggtccttggctaatattgtgcatttcactcccagctggctagctggctaactcagttagttgtgatctttgggattgtttaatcttcctttcatgtttatctttggtttaagagaaagctagttattctttttggttgatgacagtgacctgtatttctgaggccatacatttcaagttcagcccagacttgatctactatcccattcccaaaactctgagaatgaactcttactctcctccccctttcctgagctcctggcctcctgttagctgtcctacccctgggtgccccctccatcacccagattggtctggcagacccctaagactttgagacgctgcacagtagttcagactctgtcactgtatgtctttggacaagtaagggccttcctacctctgggcctttgttttgtcaacaacaaaatgggaagatggattaaatgagtgctgagatttctctgctgtaacattctgttagtcaacaagtgccacattacagtaaccttaccttcagacagccaggtgttgctccaagcagtttcactgcataaaaagatggagtagctcagccttcatcttatctgttaatagcttaggtacctgcctgcttattgtaaaagtcgaggtcagccacaggctgttttgtagaaggtactggacatttttctgttttgattccttggatcagaggccagaactgaataatggtttttagctgctcccctgatcctgcatccaggcaagcagcgcagatgctggaaggcatcttttctggtacctgagccttgtttggttcagtagcctgcctctgacttttactgccagccttttggcaaatcagaggcacaaatttctgttggggctcagcaggttcaagccctactggacaaacccccagcagtgaccagttaagcacactggggtaagacttgtgataggacttgacttcctcactgacccgcctttggggccacaggatgtaggggatttgtctcctgtgtgaggatcatgaagaaaggaaccagctgctgagggctggcctgacttgagtcattttatttcaatctgctttttaggatggcgatcgaagagaaaatcaatggtcctggtggtgtcagaaagagcagcgggcttttctgcaaaggcctcatgcttagcataagtcctggctccatcatgagcagctaagcctcttaggaatatggtaaacatttacccacctggttctaaattaggccctttaaaacctcaagtctccactagtgacattaaaacagccctctcccttttattaaccttcacagtacattcctgtctcttaagcagttctggaaaatcaaactttagcacacatcttgtccatacagagggaaatcccaggcccagagaggttaggtgacctgttaaaagtaatacagctcattgaagggaaagctgggactggaactcatgacacctatctcctcattccagtgaattctactgtagcctcacctgtttctcaacagacgctgtggtaaatgtggccaaccctgccagaatagttttgaaaataaagttaaagtgccatgcagaaagccagctgacggggagatggagcaaacagttgctattttagggggttgttttcttttgaattataactggcagtcagtggtgaggcgggcgggcacagccgtggtggaggatcacaaactacagaaatgttgcgcctacatttctgactctctgtgtgaccaggctgaacaaggcactgtctttccctgcatcagggtttcctccatgcaagggatcagaataattcctactttcggctcattttacaggactctggggagggttaggaagtctataaagagacctaagaaacagttggtatataaatagtaatttttggtgcttcttgtctttttttttttttctttttcgttgaggtataacgtatagtaagcagataagtctcaggtgacacctgaatgagttttttaaatgtatacacttgtgtaaccatcacatagatcaagatatgagaacattccagcactcagcagtctggagggtttatagcagtctaggacttgagaagagaacaatatttgtttattctggccccttttagaatctcagaggccatttatccttctgttactcattcaacatgtttcccaaacaccttgtagtacagggcacagtgctaggtattgctgggagtacagaaatgaagaattgttggcctctgtcttgggctcacagcccattagggattatgacttgaatccaagggagaaagcgagaagagctgcgaggaagcttggaggagagaggctgcttcttgctgggagagaggagggtgtgtggtatttatgtagacacagaattttccccagttctctctgtttataaacataggaaagggaccagattatgaacttcagccccttctcagccagttctttgcattctcagaccacattgggtacttggagaggtgcaggcccagccgagaatgcccatctgtggtgtttgctcagctttgcctttcccttgggaagcagaaacaaactcaggcaaaaataagagacacttccctccctttctttggcccctaggctctaaggaactgatttcccttctgtattgggtcttaaggctataaggccacaaatctgtgaattaattttggcctgaatttctttctttgccctctttggttgagtaattaaaaatttcaatttcttatgtgaaaccagaccccagaaagactttcctgatcattttcatgtatgagaaataagttttagattttcttttaattggctaatatatgcacgtacagctctgtagttggtaggaaaggaggaggctgtatccagagtagacacatggtgatccctttccttaaagagagtctccggagatagtttaagaccagtgcctaatgtagggtcagcctgaagagataacaccacaggacatctgagcattatagaaccacatcttggtacatgtgtagacagacagtagatagtagataggaagggaagaagggcagatggctctgcctggctgaatcttgttcaggttctgatgagttactgggtctgggaaatataaacgacttgagagatcatctgggcccattcccccactcccattttacaaatgaggaaacagactttgatttgaccagatctgactggcagcagagctggaaccagaaccaggtctcacgtgtggtggagaatgaagacattctggtggagtgctcagcaggatgtggaaggaagcttggctgggagagggtggtggtgaagaggaagatgaaaggagtggcagaagcatttggtggttccctcagcatatggagccaggaaaagcaaggcgctgggtgggagagacactgaggctgttgatcatctcaggggagggacctgaaagccctacagcaagagggtatgggggatactgtggccaggctgaaagattttgaatggcttggacatctatagtgcttatcttccttgtgttagttagcttgggctgccataacaaaataccatagactgggtggtttaagcaacagaaatttattttctcagttctggagactcagtcgatggtcaaggtgctgggtaattccgtttctggtgagagccctcttcccagctggaagacagctgccttcttgctgtgtcctcacatggcctttctgtggagtgtgtgttgtgcattgcagggagtggatagagagcgggggcgtctctcttcctataaggctaatagtcctgtcagattagggccccatccttgtgatgtcagttagccttaatgacctccaagaggccccatctccaaatgcagccacactggggccagggcttcagcatatgaattctggggggatacaggtcagtccatagcactccttagctttttgttttctgattgactactttaggacccgtgaggtattgtttttcttggtagggaggctgctttctgacattcctttctttacattattttctaaacaatcagattataatctagcactgtgaattaattgttcaaaggaacagagttttttttttttttttagtttttttgagacagggtcctgctctgtcactcaggctggaatacactggcatgaaaatggctcattgcagcctggacctccacagctcaagggatcctcccacctcagcctcccaggtagctgagactgcctatgctcagctaattttttttttttttttttccagatagctttgtcacaagactcaggctggagtgcagtggcgtgatcttggctcactgcaacctccacctcctgggttcaagcgattctcctgcctcagcctccagagtagctaggattacaggcacgtaccaccacgcctggctatttttagtggagacggggtttcaccatgttggccaggctggtctcgaactcctgacctcaagtgatccgcccacctcggccttccaaagtgctgggattacaggcatgagccactgcacccggccgtccagctaagttttaaaagtttctgtgaagatgaggtttcgctgtgttggccaggctggtcttaaactcctgacctcaagtgatccgcccaccttggcctcccaaagtgctgggattacaggtgttagccaccgtgcctggctgcccagctaagttttaaaaatttttgtggagatgaggtttcgctatgttgcccaggctggtcttgaactcgtggcctcaagtgatcctcctgctttggcctcccaaggtgctaggattacaggcatgagccactgcacctggcctcagagattatgttctctcagtgtttcagtgtctggtaattctgtgcagtttggagtttgttctttaattttattattttcacatatacagttgtaatcgacagtgttcagcagggaagatcggataacaaacccatgaaccagactgtttttgttttttaattgcgctaaggtatacataacattacaggtgtgagccaccgtgtctgacctgtgccccattttttaaggacaaggcaagactaccttttcccgaaagagaatcagcttcctgtgcccttcaccccttgctgcctcctgggcaaggaaaatcatttgtctgcaaccccttcatcatgtctctcttgattccaaaagcataaaaggctggttgggttttccctcttgccttgcttttctaacaagcgcgcacattggaagtatttttctgccggcatttcactctcttcccaacttccccacaaacgtccccagcccccatacctccgttgtcatctcggttgccagggtgctctcatgcttgctcaggcagaagggggcccttgttggcatggattcagctggaagcagaggaagaaaagccagtcggaaaagaaagagtgcatcccagcctgggaacggaaacccaaagcaggctgtttcccctctgtcccagccaagaacctggtcacctctcagcaagcctggctaagagcatccagcctgggacctggcgggtgggggaggagctcaatcagtgccttcattccacccgagggccacaccaaagcgccagtgccagtcataatcaggttgttcttagtaaatgatttgctttttaaaatataactgtctttccatgtctggggatgaggaagaaataggctgttgtttttgtttgttttgattaggtagtcatgtaaatggtacataattttaaaagtgccttcgttgcctcagtcactcccttcctagaaatgaccaattacaaggccctgaggtagtctctgcaattaaaaacatgtaccatacctatgtattctcctgagacacgcccatgtatgaatggtagtaattaggttacctttgaatcctgtgctctttatagttttacaataaatgattttttttttttttttttaaagagacagggtctcgttctgttgcccaggctggagtgcattggcgcaatcatagctcactgtaacctcaaactcctggtctcaagcaatcctctcgcctcagcctcccaaatagctatgactacaggtgtgcaccaccatgcctggctaattaaaaaaaaatttttttttttttgtagagacagggtcttactatgttgcctaggctgatctcaaactcctggcctcaagcgaacctcctgctttggcctcccaaagtgctgggattgtaggtgtgagccaccacggccagccagaagtgatttggatttgacccactctgaagtccctgaactccatcttcctcatatggatttagagaaggttaattcaaacttcaggtgctaacttgaattttgaagcccatggccccacagaaagatctgggagaatagtttctccctccctgccttatcttctcttccctgagttactggtctctctgagaaatggcatctccaccacctggttgccccagccaggaacttggaacttattcctgactcagtctccatttccttctgttgtacattcaaacaggtgatacaggcccatggtcttccctcttggtatctctcaagttcaccctctcctggtcagcccctctgctgtggcctcagttcaggctcttgaaatccacaccctctggattattgcagtggttgccagccccttctccccacagcagccagagggatctttctgaaatgtaaatctgatcacgttcctgtcctgctttgaatctttcaatggcttcctgctaaccctgggatagattccagcagctccttaacaagacatccaagtctgtccttgagtttctctctttagcttttatctttccttgttccctcccctattttctcatgcctctcttttcctgctgcttggatatattcctctgggctctctcctaccatcctttaaaatgcatgataaccccaaaggttagtttcccccctctaggcatccacagtaagtgtcctgtgctgacctctgtcatgtattacattgtccatatctgctggcctgtgaattccttcagccttgggactgtatcatttttgtccctagttccctagcagggtatcatgagcaaagtgtaattcctggtacagtagaatgagcaaaggaattgcctgtttcatctaagccgttgcatcctttgtagtattggtatgaagttgcttcatcttttctagtattgtcatgaagttgttcataatatcccctttttatccttttaatattcctggagtctgtagtgatatcacatttatcattctcgataccagtaatctttttttcctggtcagtctggctagaagttcaatcttgttgaacttctcgaagagccagaattttatttcattgaccttctttctcttttgtttcttttttgtcttttattgatttttcacttcgatctttattccctttcttctgcttactttggattttgtttgccctttatttgtatttgtatttttttttggagacaggttatcactctctcacctaggctggagtgcagtggcacaatcatagcttactgcagcctcaaactcctgggctcaagtgatcttccttgcctcagcttctcaagtagctggggcagtacaggtgcctgccaccgactaatttttgaaaaaaatttttaatagaaataaggtcttgccacgttgctcagtcccaagctggtctttttctagcttgttaaggtggaagctgaggtccatttgagattgttcttttctagtgtaggcttttagttcccttaaggtaccacattggtggcatcccacaaattttgatatgttgtgtttttattttcattcagttcaaaatactttctgatttcccatttcatttcttctttgacctacggcttatttagaagtatattatttagttcctaaatgtgtggggatttaacagattttctgttcgtgattcctatttattttatttttatttttgttttgagatggagtctcactctgtcgcccaacctggggtgctgtgacgtgttctcagctgactgcaataacctccacctcctgggttcaagcgattctcctacctcagcctcccgtgtaactaggactacaggcacacgccaccacgcccagctaatttttgtagtagagacgagtttcaccatgttggccaggctggtcttgaactcctgacctcaagggatccgcccgcctcggcctcccaaaatgctgggattacaagcgtgagccatcgcacctggcctatgattcctaattattaaattccatcccaggtgatagaagtaatgagattctttaaaaatattgctccactgtcttcttgctagcatcgttttctatgagaaatctttgtcatctttatttcagtatatgtaatgtatatttttttctttgtctgctcttaacattttattactgattttgagcacttttaatatgatgtgctttggtatatgtggtcttcttcaagtttcttaagctccagggtcattgagcttcttgtatctgtgggtttaaagttttcatcaaagtggaaaatttttggccgttatttcttgaaatgtttattcacctgccctcctcctttggggactccagttacatgtatataggttacctgaagttatcccacacctcactgctgctctgctgatgtttaaaattattttttctctctgtatttcattttggatagtttttattgctattcaagtttacaaatcttttcatcaatgaagtgtctgatctgctgttcatccatgtaataattttaatctctagaagctcgatgtaggtgtttaaaaagattatcttagtctatttgtgttgctattaaagaaataccagaggctggggtatgtataaagaaaagaggtttatttggctcacagttctgcaggctgtataagaagcatggtgccagcatctgctgctggcgagggctcaggctgcatccactcatggtggaaggcgaaggggagcttatgtgtgtggcgagagagagaggaggaggtgccaggctctttttaacaaccagctctttcgggaactgaataagaactcacttactcctggagaatggcattaagccattcctgagggatccgcccccatgatccagatgcctctcactaggccccacctctgacattggtgatgaaatatcaacacgagacttggcagggtcaaacaaaccgtatccaaaccatagcaaatatcttccctgtttctccttcgctttttaagcatatagactatagttataactgttttcatctctttgctaattttgacatctgtgttagtttgggttacttggaatttgttgattttactctgcatcatgggtgttatttacccatttctttgcataaatggtagattttgattagatgtcaaatgtaaattttgccttgttgggtactgaatatttctgtcgtcctatattctttatgttttgggggcacaagtttttggtaacaatttgccttttgggtcttgggtctaagaattattaggcaggcccagagcagtgtttatctagtatagagctagttaatccctactattaagacaaggccctcctgaaggccctccaagaagaattatgaggcttttctaatctagctgaggaagaggcactatgactggccccatgtgagtacttaatattatttattctctgtcatccttttgagtggttctttccctggccttagatagctttttcacacatgggtgctgatcagtattctgctgaatacttgaggaggaccctccgtggctctccagggttttctctctccatgcagctctctcctcaggtactctcatgaactccagctgcgttggtctccccagactctcagctctatctcattaattcaggaagttgctgggctctgcctgggttttccttgcctgctccttggcctggaaactctcagcaatcaactgggtgtgatcgtagggttcaacttggatcactgtccttttttgcttgatgtccagtgtctcaaaaactgttaattcatttctcttgggctacggataaatctagtccctgccatcctgtcttggctagaagcagaaggaagagtctggatttgaatcctgactctgctggttggttattcacaagctttgagataatctctccgggcctcaaatctcttcatctgtaaaattggctagtaagacgaattccttattgtcaggattaaatacaagaataaaatacgaggctcagaacaggtgttagttcatgtgagaaaggaagaactggccgggcgcggtggctcactcctgttatcccagcactttaggaggccaaggtggattggattgcttgagctcaggagttggagaccagcctgggctacagctatttcggaggctgagatgggaggatcatttgagcctgggaggtggaggttgcagtgcactgagattgtgccactgcactccagcctgggcaatagagcaagaccctgtcttacaaaaacaaaaaaacagaagaacctaggatcaagatttttaagatttgagcttcaaccattaggaattgagaagagggaaggatctaggaaaaaaaaaaacctcaagaaggaatggcctctggggcaagggagccaggctaggggatccctcaaggctgacaggagagaggaatttcagagagaggagggaggcagtgccagaacttgtaaggagacggagggtgaaggtgtctgtgttcacattctaactatagttacctttgcttcctgagtgacatttgtggctcacattggatctgagtgctacttcctctgcccagttgaagcagcttaattcagaggctaaagggagtttctgatctttctaactcagtttgtgaagccagttaaaataagaaagactgcttatttcattgggcaggaaaaacttgattatgtgaagcagtcaggaaatggagcatatggatgttaattacattttctggatcacacaagatcaaccagaaagagccttttgtgtttgtttcaatcctgttattggaaatctcagaactatatgggttcacctattgttagagctcaaggaagacctagagagagcacctaatccgcccttcttgtgtccttgatgaggagtctgaggccctaggaaatgaggggacttgctcagtgacatactttagtcatggcagagttggaactagaagccagattcggaatcacaggacccgtgttgcaggttgtgtctagatacaagtctcctgttcgggcacctggcttggattcctccttgtcaagtacctttaactttgttactttgaggaggttgttgaacctttatgacatcagttgcctatctttaacttgaacacagccttaactgcctgaaggcaagggattatatcagataactcctagcagtttcctccggatgtaagattagtgtcaggtgttacagggactggtcaggacatgtaaatgagtaatgtgtccaggtagaagttggtgggcagtggtgggctctgagacagactggaaagtgtgtgccccttccaaaagggatggctgctgctctgctctagtggatcgttgctaggtggcagtgtgggctcagtgttgccagatactccatctttacaaaaggaagccaaaaatctggatttttatgtgtaatatgtaatattcaaatttacgtattaagacacgacttaagacatgggacaaatgaagacatatctgtgggctgcatgggtgctcagttttagcctctgatcgctgtttaaatgaaattctgcagcctggctggtgtctaggaaagaactttggccttggattgcagggcacaggctgaatgactatggccctcactaaccagggggaggtcactttccttcccagtatcctggtttccccctcctggctctgagttatcttgatcaccaagagctactccagggctgcctgctgggtctaggaagtgaaaccccttctcttcctgatcagctgccctttggggagcaggaggaggcagcccagataggccttgcagggttccctttggtgaccctgactcccgtggccatttctctccttccttatgccctgggccacgcctgctgacccagtctggaataatctgctgcttactttgggtctctgctacttccctccaggtatagtcacaggggaggtcctaggctcattgtccctaataataatcccctgaccctttggttttagggttctagcaattccagtgtgggttgacacaggaaaaaagtgggcaagtgacagaggttcttgtagctttggtccctgggtcctccagaatgtggaggaaaggctgtcttaggacctgggaaaagatctggaagccattatagggtgagaggacgggggcacccacaaatgaggaaatggcagggtcaagttgggcgttatggagtgcccctcccttctccctgtctcagtgctgttaggggcacaaagatggaggttccaccctggaggagcttatggtttagggtagacgtgagggaagaagacatttattctttaaaacagaaaaaaagctcacagcaaactttccagctatgtagagtcatcgacctaagtgtagagaggatggtaataatggttggatttttatcccatgtgtttttaaccaatttaaaatctactagaaaaaaaatttttttccaggtagaggtttttactgcataccatctggactgtcgctagtggacagtttgtgggcagaacaggcagcccgctgaatgcccttggtgccagactgctgctaacttgtggggtccatggggaggggaaggccttcagggctttcagatccccaggctcaggcagaagcaggcccagctgcctgcttggtgcggggtagacgctcttctgcaaagaaagaacatgccctttgcagataggcagcttggctttgatcccaggcctgccactgcctaactgtatgacttgggcaggtgataaactctttgagcctcaataccctggcctttcaagtggtacagtaacagtacctacctcatagataggttgttgggaagaactagtgagcatggaaagtatcaatttttcattgccatgaaagcaccaatcatggcacccaggaagcttctcataaatgttagctgctgttatatattaactttttctccaccatgccataactgtatactctttcttagacatactgggctaggaaaggggacaggataccactgcgtggtggcaggcgcctgtaatcccagctccttgggaggctgaggcaggagaattacttgaacccgggaggcagaggttgcagtaagcggagatcgcgccactgcactctagcctgggtgacagtgtaagactccatctcaaaaaaaaaaaaggggggggacaggacagggacaagaagatgcagagatccccagagacaatgttggacacaggcaaggaaagagaggcgggggggaaacaggcaagacggaggagagaatgctcatattcatcaagtgtttgcatagtgattatctttctcgtctgtccttagggtagtggtttcacccccatcttgcatctgacaaacatgttcagagatgtgaaataacttacctgacacccaccttcagggctgggattctggcctggtctactgataccaagcctcatattcttttctttgtgccccagtgctggccagcatcagccaagggcaggggttgatgaagctggcattggccaaatgatcaggtggttttaaattggtttctcccaagctgtgttttacagatgttggtgtgtgtcttgttggtttttcttgtcttttctttcctttcttttttttggtgagccagttaggtgtcggtgttttcttcctatcaaaataggatctgggaagtcctgcagtaagtaataccagtgaccaacatttacatgtcatgccctgtgccaggtgctttacatacatacttcattttaatcctcacaataaccctatgaggtgcgtgttgttatcatgagggttattagtgagattaagtaatctacttgatggtggaggtgaaactggaagctagacaactggactccctaaatgaccgttgtaacttgatgtgatccagcatttcctaagcttgtttgactgcagagtgtgttttatcatgccttttacggaacacactttgtttgtattgtttaaatgatttggagcgtttgatattctgttaggttgttagttgtggggcttatttctttcatctttgtccctttcaaacagataaggggcttctttctttctgtctagaattttcccttgcagtgagtactgtactccctatgtgtttgctgatgaagtcagcagggtttcagactctgatttcctggtcatacacaagtacttattttaccatctctaaatggagtgcattagctccaggccagggagagcaaattagaggaacagggagatacatcacagagaaggaggctgctctggaaaaagctgtctgcacctctagcctgaactctccagctgtgtgggaataaatacagcaatgtcagggacagcgttccaaggcttttgcaggatgaggcccttgtcctgcaggtgagcctgcgacagtgtcagagcaacgatggacacaaaacagcctctgtctgggcttccaatatgcatttggtgcattttggtttctgataactttctgtttgcccatgctgtcccaggcaccctcacacagggtagagaaatgagagcctagccttgccctgccttctgaaactgcaggtgtatcaacagcactcattaggggaaggtattcttgaaccagcccgattagcacctctttcccattcttttttcccccccttctatctggggacttaggagagcaaaccaggtagctttttggttctttcatgtgtcagcatgagctttaaaatggagtttatcaagggcagagtttggaaactggatggaagaacattaggcagactgttttccttatggcacggggaactgctgatttatttgtagcaactaaatttggagacaacagacttgaggtggtggaaagagtcctgggctggaaacctgggtactagtcctggttctttctctgtctcactgtgcactgcggggtcctggcaagctgtgccgcctgttctggacatcatttttctcagttatctaatgaggggttggtcttcgttatctccaagagctcctcaagccccctctattcttgatgccatgatcgtaactcttacttagtcaaagtttggtgggatctctaatgccatgtggtacaaggatggtcactgataaccatctttacaggagaatgggtttctttgacactggtggttaactgtgttgttttgactttgggtcacccgagatcagacaagattgggcatgttcagggtggtatggccgtagacttgattttgggtcttttcttgcccatacacacagggcagatgacagatcacagatgacacccccatcacttcctccgtccagcagagcaaccagtggcttcagggccaggcatagttctcctggctaagggcaccctgaatatctgagtttattcactggcagaatgagccaggaggagctatctgagtgattgctggaggcaggcaaagtggggccccctcagccttgctcggctccctgcctgccagtagccctactgggaccaggctgctgagggttcttcagaatgctcacttaggctggagtcctggtgttgcatttgtgtgtaagtgtcctcaggacctcaggagtgtgttcatttgctttgttgttcacgctgagagtgggaaagcagcagccctcttccctcccagccctgtaccttctgttagatgacttcaaatgtagactctggggtcttcagaaggactgtagacactgccattcgtttagtgagagcatattattgggccctccttccctccatgcctgaatttctctatactagtaatgagtgtatagttatgacttcttggcatctattgaggtgccctgggctatttgcccctatactgaacgcccccagatctgggacaggcagacttgccgtcctcagcagcttttcagagaagtcgtgtttgactaggagaaaggaacgtcctgtctagttgtatcgaactgatgtgttctctaaaaatggtttctgtaatcactagctgttgcctcacagaaagggtttccatcctgggtgaacgtctttttgactggtctctgcttcttagggtatctgttctgtatccttcctctaaatagctgtttggaggggctaatgaagcaactgtctggagaccaatgtttatttcaacatggttggagttgtttttgcttcagctttcacagccaataaagctggttattagattctgtaattgctgctgtaattactctcttggaactggcaaaggcataattaaatatggagattccaaggactgttttttcccatctaaaagcaacctcttaaacttctattggcctggcttagatttcaattgttaaagccattgtgtttataaatggtgctgggggttctctggcagaagatgggtttctttagacacctcttttttgaatatttgatttagctgaacagcttctctttaactcggtacttgttttttaatctaaccatcaggaatctggaaaagttaaggcaaaacattaagaaccagtatatatttaatatttatgaaaacattgggttggttacagatagaagcaaatttctgtggtcagaaataaggttggcatggaggaagttttactaagtgtaatagtattcaagaagaatggcgttttacttgtggaagcactctaatacctctgagcctttagtttgccctgttacacctcaccaccggagccatgcatttgtaagatataggaggtggttcaagtgctgtgaatatttgtctacatctgtttctgcagcccagatgctgaccccatgtctattttcaaggtaactttactcatgaagcatgtttaggtgtttctgtgggggaaaattaatcatgtagcctttctctttggagttctaaactagttgagaaacacagacagcagatggatctagataagaaaaatcaacatcctggagagttcactgcgaagaggggaagaggctgtgtgaaccctgcaggcaggaaggggagtcctggggggataccccgggactgtccctcatactgtttgctcaggtcctatccccagtatgagagagcacaccttacagccaggtgcttgcgggaagtccctgttttatgggccaggaggaatgcagtggaaagatgctgccaaatgattgttctagcctgtgtttcagtaagacgtcaattctgtgggtcagaggtgcacgggagataaaatatgggtggatcccccatgaagaaccctggatagaatacatgaaaaccttgtaagacaaatgaaattgcaggttcaatttagtagatactaagcacttactgtgtatcagtcattgtgctggattgctgatctgcaaagatgaataatatcagcattatttcattcggggtggggatgggctcttggtttcctccctggtatatttgcgtatttgcttccagatcatttatttgggggattttagaagtgggaggtggaggtcagaggaagttagggttggcatacaaggagtcactgccagtggaaaatatattggagaaaaagcagttctaaatctatgatgttaatagggaaataactttggttttaaatataagaatgtagctgactgtataaaatcagtttcataagcattttaccaagctcctgctacactcgggatgctgaaaagcaaggcagctctgtcaaagagtgtttgctctttttttttttttttgagatggagtcttgctctgtcgcccaggctggagtgcagtgtcgtgatctcggttctctacaagctccgcctcctgggctcacgccattctcctgcctcagcctcccaagtggctcggaccacaggcgcctgccaccacacccggctaatttttttgtatttttagtagagatggggtttcaccgtgttagccaggatggtcttgatctcctgactttgtaatccacccgccttggccccccaaagtgctgggactacaggtgtgagccaccgcgcccggccgagtgtttgctcttatgaacggtctcagagtcacttgctgtcgttctgagactgtgaggaagagcatagagctgggagttacacagactactcccctcctcacttggcagaaggatgacttgggtgagctgcatcacctttctgatccccagtctccttgttcatttgggatctctggatgattaaatgaaataggaggcggaagggactgccgttgcttgttcaccatcactcagcaggctcttggaaggccttggtgaatcttttttttttcttgcccccgagatggagtcttgctctgttgcccaggctggagttcagtggcacggtctcagctcactgcagcctctgcctcctgggttcaagcaattctcctgcctctgcctcccgagtagctgggactacaggtgcgcgccaccatgtccggctaatttttgtatttttagtagagatggggtttcaccatggtggccaggctggtcttgaactcctggcctcaggtgatccacccacctcggcctcccaaagtggtgggattacaggcgtgagccagcgtgcctggtatggaaggccttggtgaatcttaatgatgggctggactgtgggtgatggagctggctggaggggagttgagaaaggggcacctgtgggacattggcacttgatctcggaaggattcacaatcacttggtgattagagtatgtctagggtatggcttttgtggaaaaggaacacagcaccaaggaagtcacaggaagcaggcctgcagccccacgccctggggcacttacaggactctcccaggacctcttccctctgacattactgatggcaaaggcggttctgtagaccttgtgctagggctcccaggacttgggcttatggagagaattctaacgtcttgcctctgcaggaccgggcaggccatattaaaccatatggcaaagggagctactgaggatttttcagcaaaggaatcgttggatttgcattccctcttctgtgttcccacagtccccatgtcacttcctgcatgactggacgatccctccagggcagtatcctacctttttcattaagtggggggcataacataatggcagggcagggactttggggttccatacctggtttaagtcccctctctgccagttacctgggctgagtcacaggacatctctgaacctcagtttcctcatcaactaaccttatcatctaaccttaaagggttgctattttgaggcccttatgaagtgagcatgacttagtgctaacagaagatgagagtgaaggtcttgaggatcccctggtgtgactgcatgatgggtttcttgaagtcttgggccattccagccaacatcagaatcaagggagattacggattcagtggcttttcagattttaatgaggcacatctcattgttgttcagatgttttacgagttctctttatgtgtgtatgtatgtattttggtcagcatttgttggaaagactggctgggagaagttttctgctgcttttggaggagctgtgtgctatacgcaggccaagccgttttcccttggcaaatggtccttaggacggaatcccaggccaacgggtgtgagtagaaggagcatgggacctattcatgtgacatatggagaaaccacagcctcatgggggagggggttttgacctccagtctgcaggagatggctgtggtccagaactccaggacatgggggagtgtgcatgctgagtgcatgtgtgtgtgaggctagtgctcctgacccagcccagtccagctcagccatttcttctgacagagtctgtgctaagcctccttcctagcttttgatgcccattgcaggggagcaaaaaatagcttcccttctagtttctttggctgggctacaaactgaattgatataagacagattaacaagagaaaaaccatatttagttacatatgtacatgtggaaatcccacaaaatatgagacttgaagaagagtcagatgcttgaagcttatatagcatcctgagctatagaaaagaataggggcttgggggttgttgtgggggacataacttatgggagggtgaggggaagaattacttatggtgaataaaggatgtgttgttatgcagataaaaggtctcttaggtaataaaagttgtctggagcagccctcttcctggcacagatacttttagtaatgtagattttcttcttagatgtactgtttttttttttaaacaaagggacagctttttgagctactctagtttcttagaataaccagctcaaaatatgccaaagaagtatattttgggggtggtatattctggtctcctacagtcatattttggggtggtgtgtcctgtgccccaacatcatctaagatgtgtgctaaagatatttttcggtgtgaagagtggaactgagaccgtgaggggaaggaaatctgggtttcaagttgggagatgtggttttggtcccagttctgccacagattcaccttggtcaaattgcttgccttgactggaccttaacatgaggtgatctccacagcctcagcgtgctaggaggccaaggtagatgatgccactgacccaaccaaatggccagactctaggtttggccgtggcaaggagttctgtctggctttttagtttggtcttgttttcgatgatggaggatgctgtagtagccatcttcaggcatggggcttcttgcttttgaatacatttccagaaggaaattactgggtcagaggataagaacatcatgatggttgttgctgtgtgttgccatgttacttttcgggagcattgtaacaatttacacagttgttggctatgagtgaaatagcatttttaacccaaactgatctagtatttgatatagtcattatatttatgatttctttaatttaggtggcataaaatagtactttgaagttgctttataataatgggagccgctttttttgagaggcatacacactgatgaatgtgccaggtgtttacatacagtatgtcatttgctgctcacactgaccccatctgggaagccaagtagctcacctgagtctgtgagctgggctttgaccctaagggagtttgaccccagagcatcttcttcctcaggtggctgtccatgctttgatttgtgtgtgtgcgtggttacccgagggttgaactttggcttgtgtgcttgtttactggccgtgttttgaggtatgtgaattttatgtttttgtagaaaattgaatgtgctctttgtgtagaatttatgaatcctctgctatagtggaagcaacaacagaggtgcttccagtagagttggggaaaagactcagtgacactagaacctcaccctgtgccgggactctctgaaaccctgttttctccctcacgcagcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatgtacgtgtccacccgcccctgcgccacagggcagtgctagtcccggaatgcctcgtacccaggccatggccttgggcagacggatcccttgacttacctattcgagcacctgagtttgttttaattctcattcttttttggaactccgaaaatggatgacgtgcctttgaaaggagatctcatgggatgtaaaagtactttctgagtaattcagggttattgtgatgagcatagtttcaagctggaaaggcctttagaaggtcctcttgtccagacctgtgaatgtgaaggtggggaagctgtgtcccagagagggaagcggatttgccctgtgtgacatgggagcttggttagaactgggattagaatcggtgcccatgatttttccctgatgctgtcaggggccctgaaatgtgtggttcatccaagagctttggatctctctgttcctatgtctgcttttgatggcgttttctgcctcctctcttgctctccggctgtagctgtcattgacagtgatcttgccctcagcagtccttcttcccctatatggctacctctcatggcagtggcctaagaaactagataaccaagcttgttacagttgtaactaaaggccaaggtaaggaggctccaaatgaaggcctctctcttgaatacaatctgcatttgggctgggtgaggtggctcacgcctataattccagcactttgggaggctgaggcaggcagatcacctgaggtcaggagttcgagaccagcctggccaacatagttgaaaccccatctctactaaaaatacaaaaattagctgggtgtcgtggcatgcgcctgtaatcccagctactggcggctgaggcaggagaatcgtttgaacccaggaagtggaagttgcagtgagccaaaattgcaccactgcactccagcctgggcgacagagtgagactctatctcaataaaaaaataaaaaataaaaaataaaaaatctgcatttgttgtagtgcttagatttggcagcatatatttgggggtgctaggtgccttttttgcttccttttgggtactcagctgtgctgtccaatgggtgggaaaatgcaccctatgggcttgccatctgtttttgtaaataaagttttattattatttgagacaaggtcttgctgtgtctgtcacctgggctggaatgctgtggcccaatcctagctcactgcactctcaaaatcctgggctcaagccatcctctcacttcagcctcctgagtagctcagactacaggtgtgtgacattatgcctggctaatttttaaaattttctgcagggatggggtctcactgtgttgcccagactggtctcaaactcctggcctcaagtgatcctccctcctgggcctctcaaagttttgggattacaggtgtgagtcactgtgcctagccttaaaagttttattgaaatacagtcatgccccttaatttacatattgtctgtggcagcttttgtgctacgcagcagggttaagtatttgcaacagagactgtctggccataaattctaaagtgtttactgtctggccctttgcagaaaaagcttgctgatgttgctctagaaatgtgaggttgcaggagaagtagccttcaaataagtgaggttttgtctgagggtggatgttcattggaccgagctgcttgaatgagaaccatatatgcctcatttctgtgttctcctggaaacctagcagagtgcagctcattaaatactgtgcaaatgttgacgtatatgtgtgtatgttggcttgagtaaatataggtttatatgattgtcagtgtgtagaagaaaattctgcatatttgcggaatttgcctttcctttggggtcctagaggatccataggtggactgagtagatggaaggcccattagacagcatggctgtcttctgtgatttgtgcttttacttccccctgtacagagttacccttggacttgaaaaagagctattggcccaggagttaaagccctgcggtcttaatgtgatacctttactaatttgtatgtaggaccttgatagtgccacctgtagggtgttggactgggtagtgtcttaaagacattcccgtccccttgagtctatgattctctattttaaaggggaggaggcaataatgccaagtaacccctcacagggagtcattgcagggggtgtggctgggaagctgattttgtggggcccagtttctgctcccgccttgccttgcaggccccctttacgcagcctaatcgattgatatgatacctgtccattgcatttgaagggacatcgataaagttgatgagttaatgcaggacattgctgaccagcaagaacttgcagaggagatttcaacagcaatttcgaaacctgtagggtttggagaagagtttgacgaggtgagtagttttgtacagatcccataagcttcacaaatgataccctgaggctgtcccttgatgtgctcttgaaggctctcaggcagggagcatttggacttggacagagacagggcatggtgttaaccctccctgaattctgcattttgagggacactttctctatttggggtggaagcttaggtagagtaaaggcacattcatcaggacccttcagcaggcttcaggtcactaactgatttgaacaagtagctagcctgcacctttccagggtgggccctggcacagagctgggcagcagagatgaccatgccctggagaagttcacaggattttccctgagacagcttcagcatgagggaaaggtagagcaaagagggggcacttacccctgacccggggtatctgtctagatctcggccatctgccagtttctgctgtagcaatttgggaccttgagtctcttaggtttttaaagtatggtaccagcccctgttgaaggtatttcactgtgtgctagatttgtgtctcctgaaggttaggtcctttctgctggacctttgtgctttctgacccctgctgtataaccgagaaaacagcgtgcagctcttacctttggctctcaacaccagggttttcatgttttcacactggagttcgatggatgaatcgagttcatttcaaatcagcaaacatttctgagcattcactcgtgtgcccagctctgagccaaataaataggaaggcaaagatatgatcccctctcccagatgctcacagtctagtgcaggacaccagaggtctacatcagtgatgtgcagcagtgatacgttccccagtagaagctgctttaggatatttgaatcacagggtctggaacctggaattcacctccccgcagaccttctcagaggggtgtgtgtctccatgagcattaattaggtaggaggcatgaccgcgggggctgggattcccagggagggcgctcactttgtgtttccttttactaggatgagctcatggcggaattagaagaactagaacaggaggaactagacaagaatttgctggaaatcagtggacccgaaacagtccctctaccaaatgttccctctatagccctaccatcaaaacccggtgagtgcttctagagtcatggcacaccgtgaggtcatgtggcaggtgatcttgtggtcggttggctttggtttgtggtcggttggctttggtttgtggtcggttggctttggtctgtgtcctgagcttgcccaagattgagaaccagacaggatccattgtagtggccacagaggccatgtcacctggctttttctggtttctctctggaacagtgtttcttaatcttgacgctgtggacatggccagatacctctctgggccgagagatggagggtgggggcggggttgtccggtgcactgtggatgttcagcaccatccctggcctctgctagatgccagtagcaaccgccatgagttatgtcaaccaaaaatgtcttcagacatggccaaatgtcccttggtaggggttgggaggatcacccccagttgagagcctcttttctagaatgattttcctatttcactaaagaagagaaagttccaggcactgtgagaaggtgtgagagcgtgagtccaggacagctctttccctgcccctctagtatcctgtgctgcgcaccctgcaaaagccccggcccctagagacagcccctgggggaaggaaacagctttgactcctttagagacctgattctataaaaccttcatttcctcccttcatttcttcccttcccccatcccctcgcacaatatttcacccccaggtagaagtaatccacacagaacttctagaaaaagcgaggcaatttgatgtggcatgagagagaaccctgggggcagtgcatgaccagctgtggtcacctccctctcccatgtataaagagggaacggcctcctcaagtagagtcagctgcctagagtcctgtgtaggcagaggccgtccagcaagcctcctggagctgtgtggccatgagtcaagccacttgaggtggagttgggggttggcaaggattagatctcttctggggttcttcccactctcctcccaccttgcaggctctgggaccgaagccttgtgggaatcctgagggcctctgtgtagaatccttgttttgtctgggcctgctggaggcggagggtgggtgctgccaaactgtgcttggttttccagagttgtatgttgcagcttttaggcaccaaggagcagtctccctacagcctggagaggagtctggccacagggcagggctgtttgacagacaccatggagcacaggcagccctcatttccggccagaacatgttgaacgcaccagtcatcctaaatagccttttctgtcttcacacagccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcatactttgctgttgtgtttaatctatcatttgcctcgggagctgaccctttccagaccagcaaggtgtacagtggagtctggaaacatggaagacttaaccatgacatgtgtcaacagtttgaaccaaagagcagagcttgtctcaccagaagtctgttcaagtcctagattggccctcaccttgcctggggactctctgggtacagttcagggtgagttggttcttgggtacttcagggtcttccctatttcttctctgccagtgtccatgggcagtgccagcaggagccttactgttggaagccatggtgctcccatcagacaaggctcatcaggaacattgaagaaatggcctttcccatggggaggaagtgtagggcactgactgagaatctaggacacagaggtcacctcaggactgctgagactcaacatatgactctggcccagccccttccactctgtccccttttctttggtcttgtatccccttgagagtgtgatgcatgctgtggaccctcttcagaaaggtggatctctacatatttatccttaattttgcatgcaaatttgcagtattgagaggacacccctgtccccctgtgctcactcccaaaccttttaaagtaaaaccaacctgagttcaaaatgagacaccatcattgctcactgggcgccctggggcaagttgcctaccctccctggggctcctgttctcacctggaaagcaaggggatgggaacagatcagtcctgaggtcctgtctgtgttgagcggctcatgccctgtccctcatccctcattgcggcatcccagggctgccacacttagaactgggagggacttgaagacagtggcttaaaaattcctgacttgtgtggaggttggatctggctagtctcagaagttctttcacctcaagacaaatctagtggcagtgcttgctgccagcttccacccgctcagcctgcagctggtgtggcctctgggtatcgctggtgtgggagacctagtggactttcttttttttttttggagatggagtcttgctctgtcgcccaggctggagtgcagtggcgcgatctcggctcactgaaagctctcctcccggattcacgccattcttctgcctcagcctcctgagtagctgggacaacaggcgcccaccaccatgcctggctaattttttctatttttaatagagatagggtttcactatgttagtcaggatggtctcgatctcctgacctcatgatccgcccacctcggcctcccaaagtgctgggattacaggcgtgagccaccgcgcccggcccccagtggactttcttaagctcctctcatcagctgttacagggcgtcttgccctaggtctgtgtgaggggaacttgcagactcaaccctccagctctggtgaacccagaagccaggtccagggcagggtctgtgactcctctgagcaagagctgcttatttctaccgagtgtgggtcttgtgccagggcctgtggagtacagtgttcagtaatacccagcccctctcctgttctcaggaggttcttggggccagagagagaagttactgagtcaggattccttggctacaagcaacagaagcctcaacccactggtataagcaatggagacatttacttatttatgaaaacttagtcaacagatatttattgagcacctactgtgtgctaagtactgttcaaggtgccaggagtacaggtatcagagtccctgccctcaaggtggttacagtctaacaatctcaggacaagaaatcttggtggtggggcgagggggtggttctggatttggggtagtggctgaaccatgtcctcaagaaccaggttctttgcatccttctgctctggcaccctgcacacatagaggctttttcttttcttttttttttttttgagacagggtctcactttgtcacccaggcttgggtacagtgctgtaatcatggcttactgcagcctcaaacttctgggctcaagcaatcctcccacctcagcctcctgagtagctggcacacgccgctactcccagctaatttttaaattttctgtagagagggagtctcacgatgttgcctaggctgatcttggactcctgggctcaagcgatgctcccacctcagcctcccaaggtgctgggtttataggagtgagccaccacacctggctggaagtcttgctgtctcttggttgtgagatggcccttcctcacatgcgcagtgtcaagaagcagcaggcccagcacccgccagcttttccttcacctgagcccatgttaacaggccaggtttccccagagtcatcttacaacttgtcccttatgcctcatggaccataactgtcacattgccacttcttgctgcaagggagtctggaatgtttgtacgggacaaaagggacaaatagggctctcctgtagggctaggggtggagcctcccttccctgaatatattaatgtccacttacttgatgctgaatagaattgggcttctgttaacaaggaagaaggagggatagttgctgagtaggtggcaccgacagtgtgcaccatggaggcagaaccaagaacataagacacgtatgtagttggtgctaccagtttcttccaaaaagtggatctgatcgtgacacttggtcctttcgaatccctcagtctgcctccatcctctcctgttctgggcagactaaaggtgcgtcaccattatccaaggagcttgtgaaaaatcccgagctgggtggagactcaagaattgcattttcactgctgggtgtgcgatggctcacacctgtaatcctagcactttgggaggctgaggcaggtggatcgcttgaggccaggagttggagaccaccctggccaacatggtgaaacctcgtctctactgaaaatacaaaaattagccgggcgtgggggcacatgcctgtaatcccagctactcgggaggctgaggcaggaggattgcttgaacccgggaagcaggggttgcagtgagctgagattgcaccactgtactccagcctgggcaacagagtgagactctgtctcaaaaaaaaattgcattttcacaaactcctgaggtaattctgatgtaggtgggctggagcccacactcagaacactcaacgtcgacaggatcaagtcctcagaatggctaacttgacctcatgacctggcccccattttcatttccctttgaaccccaaatcctgttacccagacttccctgtctcttggagcatgtgctctgtccctgtggcccttccctcctggacacagccctccctgtcctgcaaaagctgctgcttcctcctctgctgcccacctgtcaacgctgtctcttcatcatttcccactcccttaccagatggcgaggtcactgtacttcctggcccctaggtccacctggcacagatcaggtacgaagacatttatgtgaacaccggtgtggtggaaagtcagagggaagtactgtcgccagggtgtgccaggaggaggtgggatctgagcttgcacgtgaaggagcagattttccacgtatgcctgtgaggcggagcaccatagaccaagggaacctgctgagggagacacggcagggaggccaggggctgccttgggaggagttggctgggggaaggggcttgcttggagtgggtgggaggtagaactgaagagggaggctggagctagatgggatggagggcatgagactaaggcaattgcaggcaggcaggaaaggacgggaggaaagggaaggaggaaggaaagaagggacagaaaacaggaagaaagggagaaaggaaattaggttctcaggcaataatttggggccaggagaggatagagatgaaacttctaaggttgccttccatttccctcagtgatgtgaagacagctttgcagcagctgtgatcctgtggagtcaaacctcactgctccaagtagggacgacaccaggcaggtgtgtggccaggccacctcagcagcctgtaatgtggacacaccaacttcagttaaaacagcaaatgtattttctcacagttcaagggatcagaagtccaaaatctaggtatcagcagagcgtctggtggaggaggatcctctttggcccttgtggcttctggtagctcccagcattcttgggtgctccttggctggctgctgcatcgtcccaaactctgcctccacctccacatggccttctctgtgtccttttctgtctcttacaaggatgcctgtcattgcatttggagctcactctaatctaatatgatctcattgtgatcctcaccttagttacatctgcaaagactccatttccaaataaggtcccattctgagggttcgggtgggtgtgaattttgggggacattattcaacccactctagctgtgagctgggggcctataagcccgcagcagggtggagagagctcagtggggcagacacaggaagcacaggtctcgtgagccccatgtgctggatgtgaagcccaaggctcagagaagctccagggcccactgctaatcagtgacagtgaagaagccatgggttccttagcttgtgaaggccattcattcattctacaaacatgttttgggtacttctatgccagctgtctggaagctcacagtttggtgggaaaattagaaaggccgtagccatccacttcttcatcatcatcaccacaggctgggtcctctctgtagtgagtcccactgggaagagggttcctggctcaggagggtttgtgggaggacatgatatctcagccaagatcggaggctgatgaggtctcagcaggggaaaagatgtaacaatagagaggtcggagggtcgcgttcaatgcctgtgcaagaaaggcctggagccacccttggcctgcttgtgaactccagatgaaccatgacacacagtcaccagacctgcagtaaacatttacgaaatgaaattacagatgaggaggccgaggcgccaaggtgcttccaagtgtcacagccaagtaccagcagagcaaattcatgaacccagctcccctgtctccccatccatgtctcttccggtctggcctgggcaccccgtctcagaaactgcttccttccttcctgctcagctgtatgctggccttgcccagaccgcagaggagccaggtggagctgggttagacacgcaagactttgggtcttgcagctgagactctgcaccaatcccaggctagatttccatgaggcactggctaaactggtccaaattcccgcagagtagctctgagggagaagcagaggagaaggatcccccttcagagtagaaacatttagggaacatacacgaagaacagacaatctgtaccttctcactgaacccacacaagaactatttcagggcagaaccattcgttaccccattttgcagcagagaaagcccaggctcagagagataaagtgatttgtccaaagccacagttgtggagtcacaagaatccagtcacacacatacctcctccccaggccttccctgctgctgtggtgggggaggagccgggtcacagagatgcatccctgactcccttagaaggtgttgaccctgaatgtgaccaaaccctgggattttagaggccagctctctcccatggccacttcctactgacagtgaaaaggccacaggcaacaggacctgggatcacccagggtcacctggaatggagcggcagggtcagccatgcagaagagttggggctcctgtcttttccacaaggggctgatgaggggatcccctctggggctgggtctcccttcccaccctgaggacctgtctgttttcacccagacaatctcactgattgtctgacaaagtaaagaagcaaatgaattacttattctatgaaagccattcattcaacaattttctttttttttttgagatggagtctcgctctgttgcccaggctggagtgcagtggcgcaatcttggctcactacaacctccgcctcccgggttcaagtgattctcctgcctcagcctcccaagtagctgggattacaggtgtgcaccaccacgcccagctaaattttttttgtagttttagtagagatgggggtttcaccatgttggccaggctggtctcaaactcctgacctcaggtgatccacccaccttggccttccaaagtgctgggattacagcgtgagccactgtgcccagccaaacaaatgtattttggttgggcctggtgggtcacgcctgtaatcccagcactttggaaggctgagctaggaggatggcttgggcccaagagttcgagaccatcttaggcaacatagcaaaatcctgtctctacaagaaataaaaaattagccaagtgtggtggtcgtgcttgtggtcctggctactcaggaggctgaggcaggagggttgcttgagcccaggaggttgaggctgcagtgcggcaggatcatggcactgcactccagcctgggtgacagagcaagaccttgtctcagaaaaacaaaacaaaacaagtgaacaaaataaatacccaaagaattttttgagtacttctatgcccgctctcacaaagctccttgtttggtaggaaaattccttatctccctcctcagcttgggcgcctatgtagggacacttggttccctcatacaaagcgtggacagacatcagggtacatactcattgctgtttcgcttctccattgctgcaagaaacccgcccctgaaacttagttgtgaaaagcaactattttattttattttattttattttattttattttctgagatagagtttcactttgtctcccaggctggagtgcaatggcacaatctcagctcactgcaacctccgcctcctgggttcaagtgattctcatgcctcagcctccagagtagctgggattacaggtgcgtgccaccacaccgggctaatttttgtattttaagtagagacggagttttgtcatgttgaccaggctggtcttaaactcctgatttcaggtgatctgcctgcctcggcctcccaaagtgttgggattacaggcgtgagcacccacactcggcgcaactatgttattaagctcacagattctgtggtcagaaatttggaaagggccagtggaatgatttgcctctgctccgtgataaccgggaccgcacctgggagacctgaagactgaaatgacctccatggctggaggctggaattatctggggacctctccagtcagtggtgtgctacgtgtggtagttgatgctggttgttgactgggacgtgccctggggctgtcagcaggaacctgagacctctccatgtgacttgggcttcttatggcgtggagacttcagtgtagccagagctcagggctctaaaagtgattgtcccagctagcaagggggaaggtgcgtcatcttttgtgacctagacttagaagtcatgcagaatcacttcactgcattttactggttatcagtgagttgcaaacccacccgggattctaagggagaggaattaggctccacctcttgatggggacatggctagttctaaaagagcttgggggacaggagatattactggggctgtctttgggagctaaagtctgctatgatagctaacacagagcatttagtatatgccaggtattgaatgaactcatctggtctctgaacccctatcaaaagaatatttgtgagtatataccatatttatttattaataaattatataaatgtaccactgtactaatatattgtgtaataatacacaactccttgaagttttaaaagcctaggatagaaataattataataaaaaatttcaatgttttctttctgtattcctaaagagtttaaggatttttttatttttttaattttttttgagacggagtctcgctctgtcgcccaggctggagtgcagtggcgcgatctctgctcactgcaagctccgcctcccgggttcattccattctcccgcctcagcctcccgagtagctgggaccacaggcgcccgccaccacgcccggctaattttttgtatttttttagtagagacggggtttcaccgtgttagccaggatggcctcggtctcgatctcgatctcctgacgtcgtgatccgctcacctcggcctcccaaagtgctgggattacaggcccgagccaccgcgcccggctggcttgtgtttatttaaggaatggaagcgttcactcaagccagacttcaggggcaaatgtacattgggaatctccaagggacatctcccaaactacctgaccagggtgtgggttccgccgaatatcttttgggaaacgctgtgcgggggtccctagagcgtgtgggtcctccccatccctcctcccgggtttgaggggccgacgcggcagcgcgcccaggggcctgcaggtggcgccatgtcccaggctgtggggccccgctcccgtcgaaccacggggagaccgtgggctcctcccgggtggtctgcgcctggcgcagggaggggcctagaggaggcggtggagtggggcggggaggggtgtctgcttagcatcgggcgctgctcccttgccctcccttgctttcccctctctccatgcttcccactccccctactgaccccctcactccttcgtcccccgcctgcccacagggacacccccatggatagggagagggctgtgtcctagctcctgccagagtctggaggccgcgagtctagggtgtaggagaagggggccaagccagccaggaggtggggccattgtaacaacaatcacagcaatagtcactatgtatggaggcccactctgccgtgcgggggtggggagctgcagttgtgggctgctagctcatcttctaggcggtcttcctgttccaggtccctctgctgcccccaggagtccagcaaagcaggacagctctgtggacatggatacctgtgtgtcccccacccccagccctgcatctggcttagcgggaaggcaacccgctcgtgggagggtgggagtgggtcccaggctggggacttcacttgttgccctggagctggttctccaagagcacagaccctaaaccactgccctctacttccctggtgagctccccacccccataccttaggcaaatttccttttccaaccccactccaccaattttctctgcctcctccttctgtgaggtttgtgggcccagtgtggcctcagggggctgaggggatctcatggagttgagcctcaccttgtccagtgcccagcaaggcctggggaggggtgcccagaagccatgtttttgtcatactgccaaggaggaccttggatgcacttggggaagcgctgatgaagaaatgacttcagaaaaaaagaccctgatttgtaatctttgctgatttccatgtaaattctcttaccgtggccagcttcaagctaccaacatgacaaaacatttcttaacattcagccattcctgtggtccctggaatatgtggagaaaagaaattgaaccacagcgtcccggacctggtagaagccgcctccagcacaacagtgagaaggtctgtttaggactctgcttgtttcagaaagatcccggctttgctttggtcaggatgggctacatcactgaggggcccagtgcaaagtgaagatacagggcccctttttcaaaaattattcagaacttcaagacagcaacaatagactgttaaaccaagtgtgtggcccttctgagtgagggccctgtgtggttgctcaggttgcacacccatgaaacctgccctggctctgttccaggccaccaggatggcttgcctgccaggacctcctcactggccttcctgctgtctccctggcctcctacaaaccattctccactcagcaaccaggggttgctctgggctggatcttgtcactcctacacctgccgcttgtccttgagagcaagggcaaggctcctctgcctggcctggttctgagacactgggctccccagttacatatccttatagctccgcacacatgtgttcctgcctggctctcttccctgtagaaactacatttccttgtatgatctctccctttataccatcagcagtgtagtcctgtgctcagtaccgctgcaggcctgcacttagtagatactcaggatgtgctaaattgaacaaaatgaattaattgatgaaaaggacaattggatcaggatagggctgttccaaatgttttctggcaacagactcatttcatcaaatgagatcttacagggaagcccacgacatgaaacagaaaagggccgctgctttgcctgcaatgggagggaccagacgcctgactccggaggccatgcagtcactgcctctgcagaacctggtttggcggcaccaacattgccactttcctttgttcttcctgcatttaaccttagccgacccctcctggctgacattgacgatctggtttctgttcgtattagccggactgagaactttagctgtcacgttggttgtacatgtggattatgctcctgtctccccttctccctgtacctgcggatcactcggccatcgcttggctctgagaacagcggctgggctgagccatgggcagaggatttggtgtcctttggggaggggtgctgatggtgagcacaggggcagggctgcagtgccccccgcccccagcacagccaggctcccccactcccctccactttggtcaaatgaccttccgtggccaggggcgaggtgctccctctcactgagctctaacctcgcttgaacacccaccagcatttattgagcgcctgctgggtgccagcatgttgccaagggctacctgggttttatttccatgggtcctcacgacaactcttaggaatggctgttatcatattccccattgtacagatgagaaaatggaggctcacagagggagaggacttgaccaaggccacacagcggatgattcaaacttctgacccaccctggcccacaatgggcagccgagctagagaccagtactttatggatgaggggagaaagaggaaccaggacctcatgctgcttctggtggcctggctgcatcctctgaccctgggacgcgctcctggctcttacctgggaggcagcatagcaggtggcattggaagcagaggggcctgagctagaatcccggctctgtcgctgaccagtctggtgacccagctatgtgggggtctcaccagcctcactctcctgcctgagcaagggaagcagagatgtcagtacccacctgcccgggtgggggcaggtgaaggagaggttgtcttggcacacggcacatctgaacactcgctggggtggctatgaggggtcctcacgctttacccaccttgggcccatcttagaatgaaagaaaatggaatccccaaggaggtctctttcctgtccttcctcagtgcatctcagagttggaccctgaggggaccctctgcttggggctgtcctgggctgggcatcctcccctccctgctcctgatgtaaaaactccaagggtgggtgccgcatgaggagggccaaggtgctgcgttctagtccttgcctggccaccggctggtgcctagaccctctctggacctcagtttccccacctccagcatgggtctcctgcagagcccgtgaggcagcagaggatggatttgagcctggctgtgtgcggtcagggcacctcccatacgcgagggggtggatcagtctcctggggttgctgtgacaaatgaccatgaactcagtggctgaaaacaagacacacattcgctcacaagcagtctcgtatcaaggtgtcagaagggccacgctcctgcagacgctccgggggagagccctgccctgccttctctggaaaagatgcagcgatccctggcctttctgggcttgtggcctctgatctctgctctgtcttcaggtctcctctgtgtgtcttctcctgcctcttataaggacatttgccattggatttagggcccactagggtaatccaggatgataccatcttaagatccctaacttaattatatctgcaaagactcttttcctaaataaggtcatattcacagcttccagggatttggatgttgacatatctttgggagctatgacagtcagcctcacctcacaggctccctaccagagaaaggcaagtgagggccagcggattcctctaaggaccttggagagtgccgcatacagtaagctcaacaaatgtgaaccctaagaaagagacatggaggcacagggaggaaaagatcacggaagagcttgccctggccatgctgagaccccttccccccagctttgggccttgtctctgggggtgggccaagccggacccctccagggcagggcggcagcacacaccgccagccctgcatctctgcatcccattctggcagagcactacccagaaacatattttacccataaacgggccaattaagaaggcaaatgttttcaaacaggaggatttattggcatagaatgtgccatccctctaagcaagaggagtgggggtgtgtgcggagccatctggaggggagttgtttatcatatttatttagttacaagttgctggtttagaactggcagagctttgtgaggtgggatcgcagttccctgggagggcacaggctcgggtggctttgtgcacaggggtatgcccgtgtctgtgcagacacgtatgtctttgtgcctgagcgtatgtgaccgtgcacctacatgtgggagtttgcctgcctatgcgtgtgcataccctttattgggtctgctctctgtgtgtacacacatgtgcctctgtgtgtacacatgagtgtaagagggcctagagatgtcctggtgcatgcgtgtgcacatgcgtgtttgtgtgcatgtgtgtgcaattcttctttgtgtgtggatgcaggtgtggccttgtgtgcacttgcctgggacagatcctaccttacccaatttgacttccaggcagtcttggacatctctgagagtctcttccctggcaatttcccacatcatcctctttctttgatctctttctcttccccgtgtgtcttctcttctctttctagaccaggggacaccagtaggtcacgtgaatgagagaagaaggtctggcctgggctaggcctttgatgcagactcattgtgtgtggcaaaggtaaaggaattgtcttggcctctgcaaacatacatgctctcctattttacctaaacacgtggctctgactctctgagactactctgtttctcagcatctgatagagatatgggacaaagaatcattacaagtgccatgatcgccaacaagaactacttagcctgtggttctgggagccaatagacaagggtggggctgtggtgaacaggagagtgcgtgcccctgtctaagggacagccaatcctcggtgatggttgctttgagaaatttccagcctctgttgccaggtcttctgagtttctaagaaaaaccagagatttgtatttttaagagagtgtgcttgatttttaaacattggctcaaagatttttgaaacattgcaggccaaatggaacttgtgtgcaggatgaatgatcagggtgctcatctgcagcctcccccacgctccatgtgcacccctctgatctgtggctgtagggatcattgtcaagctcatgaccaacatctgtgcctcgattttgggtctagacccactatgagtcagaccctgtcatcctgggctcatgtcttgtgagcacaatgaacccagcatgtccacgaagcaaagcagcatctttcctccatcagtgcctcccttgagtccccgaatcagaggcagccccgccatcagctctggagatggaatctgggtgtcatccttgggtcctcaccacccctcagcctccgtgggcattgaatcagtcacccagtcctgctggctttgcctccagcacacatctctacagcctccgtcatctctctcctgaatgacagtgacagcccgctccagcttctccaggcttctagttgtgtctccctgctccttccctgtccacctctccagccttgtccttccctctccctgctggcactttaagcttcagcaacaccagactgcttgtgttctattttattgcctcttgcctttgcaatgacgtctcctcttcatggaatgcctttccaggcctctccacttcccccgactaactcctctttatcctttgagatcccataggaagctccctctgcaaaagggtgataaataaatctcacctggcaaggttgttctcagactgcatgaggtccttcctggcacagtgcccagcacacagtaggtgctcacttgatgtgcctgcctccccgtccgctggcctcccctgcctgccactctctctggagggaggaccgtgggcactgactgggccctgagggatgagacagagtagcccccagacaggtgatctcacagccttccccaggcctggacccggtgactctcaaatgacatcagccacggaacttcaccagcagatcaggtgggcttttccaatcagccctctcctgttaaatgggcattttgatattttcactggatgtacattagtcacggagaattctgatttgcacagcctgtgttttagagtgtgatgttctaggctgtaaagataatcagctctcataagagatagtttccctggtgccaagggtgggggactggggtggcgacagcgtgattggaactctaaatgtctgaagtgactgtctcaagtcccctgagccacaattcaatcagcctctccaaacgagaaattcaacagtgagcgttaaaaaaacagtggaggatgaaaatgaaaaaagaaaaacactcaaaatggaattaagttttgggggcattggatggaagttttaaaaatgaacagtcacagccccccaaaaggtgcatcttctccagtgcggcggaagcagggaagggtttgctttctgggattccggaagaactttcaaagtttcttcttccttttttccccctcctttccttcctccctcctttattctcttccttccacagatgtttcctgagcacctactgtgtgcagggcaccacgctgggcactgcagacctaacaatgaacaaggcagatgttgttcctgctcttgcaaagtttataaccctcccctactgttaggcctgagggtcgtttccagtttttcatggttgcagataatggggcaatgaacatttttgcatgcataccaggatgaggcatggaatgaagttttctgttgccccagaaatggtgcctgaggccaagctacagacaaaggcatcaagtaccccacgttatttttttattttatttttgagacagagtctcgctctgtcattcaggctggagtgcagtggcaccatctcggctcactgcaacctccgtctcccagattcaagtgattctcctgcctcagcctcccgagtagctgggattacaggtgtgtgccaccatgcctggctaatttttttttttttttttttttttttttagtagccgcagggtttcaccatgttggccaggctggtctcgaactcctgacctcaagtgatttacctgcctcctaaagtgctgggattataggggtgagccaccgcacttggccaagtcccccacattctaaagagcacagttaaaactgaggccagacacacccttctgggcttatacagtccagccagtttggttatccccagcgtcccctggctcccctggctcctcacctcattctgctccataagcaggaaactgacaagagatggagagaggggaattattggatcataagttgtcatcccttggagggggtcagttattgtcccctcccttggagggggtcagttattgtcccctccctgtgggagaggagaggggatctctaaagggaccccttgcagagatggggaggcgtccactagatgggcagacaggcatctcgggccacattagaaggtctgtgtctgcttagacagtggcccagcctctgccctgggacctccgtgagattggactaggtattggtgggcagagaggggatgcatggaggaggctgtggccaagtcgaccccagagaacaaggctggctgggactgtttgccagggcaaggacttaaggggaagcaggaggctgggtgtggtgcctcacgcctgtaatcccagcactttgggaggctgaggtgggccaatcacctgaggtcaggcattcgaggccagactggccaacagggtaaaatcccgtctctactgaaaatacaaaaactagcttggcatggtggcaagagcctgtaatcccagctacttgggaggctgaggcaagagaatcacttgaacccgggaggcagaggttgcagtgagctgagatggcgccactacactccagcctgggtgacaaagcgagactctgtctcaaaaaaaaaaaaaaaaaaaagacgggggtgcagcaggaggtctggggtggctgcgtggggtgcgagttgaggggtgggagaagcagggccatggtggtggtctcatgtcagggcccctgaggacacagaggccccagggcacagctggggggcatcctgcacaccctcttccctcacttggccttggctcctggacgctgtctctgtctaccctctcttgctcctctacacctgccaggccaggccaggggctgcctctgggttctcgaggccccagggttcctgctgcctcagcacagccctggcctgtcactgccaggtccacgtccatctctggttgatagcaggggctttgtctcgttcgctgctatatccccggcgcctggcacagggctggtaaacagcaggcgcttgctacgtgtttgtgacgggacctttgttggaggagcactgagctgaggggaaggtcggctcagggtcccccggctgcaggatactgtcctcggcagaggggagggccggctcagggtccccaggttgcagggcgctgtcctcggcagaggggagagcgggctcagggtccccgggctgcagggcgccatcctttgccagctctttatcgtccctcctctttatgccctgcgttggtctggctttcagtttacaaccaaataaataaatcttcatcctcatagagagttttcctctgggcagtgctccaaggaattggaaatgctcccagcctaggtttatggcaaaggagcctccgggaggagatttcttgaggctgtttaggtgaccccaggcctttaccaatgctgtgccctctgccaactgtgtgggctgaatacgtcctccgcctatgaggcctgaccgaaaccccacctcccccaggaagctgttcttgatcccccagctgtgtcgggggttcttctatccagtcctgtaagcacccttcaccccggcatcatcaaaacaggattttagttgtctgtgtctgtctttttcattagactgggcactccctgagggcagggactcagcgctgtgtccccagcagacatcaggtgctcatcacgtgttttcgaaggcagttgattgcttgaaccaggctagaaggtgatgtacagagtgtctagaaatgagttaagtgtgaggttgagatgaggtagggcacacgaggtggagaaataaagagagggaagggcaggccagggagagggcgtggtgtgagcagaggtaccgcagcaggacatagcctggcgtgcggggctctcaaacagtgaggctgccggctgagcccaagctccaggcatggggcggtaagccaagagatggtaactagggttggcgcgacagatgtggagagtaggtgacagactcaactgaggtcctagaggtggaatccatgggggtggttattggagtaggggggtggcggggatggcgcccagtaccctggctcacgactgggtggctggtggagacacagaggaggagttgggggtgggggtggggagcactatgctcaatgttggaccctccgagtgggacgtggggcattgggggagatgcccaggaggccctgtggtctggagaaaggtccaggctggagaaggagcaaggacacagctggcaagggggcgcctgaggccgtggagtggacagaagccgaggaggagggggacttcaccctgagcttacagctccttgcataacttaattgccaatatgattaaacatgtaaataattatttaaaaataaatatatttagaaacttaaaatttggattcaggaacattttaaagaaaaagcacagatggccgggcggggtggctcacgcctgtaatcccagcactttgggaggccgagtcaggcagatcacgaggtgaggagatcgagaccatcttggctaacacgctgaaactgcatctctactaaaaatacaaaaaattagccgggcgtggtggggggcgcctgtagtcccagctaatcgggaggctgggcaggagaatggcgtgaacctgggaagcggagtttgcagtgagccgagatcatgccactgcactccagcctgggcgacagagcgagactccgtctcaaaaaaaaaaaaaagaaaaaaaaggaaaagcacagacataacagtgaattgcacattgcctttcccaaatatgctcacattatgttctgaaaagttccctctgctccctgcccactccatcccactccccagggagtaactgatttctctttccagcatggtccaaagggcttgtcaggggtttgctgtcaagtgagtgatgtaaaccctcccctccactagccccagtaggcatctgtagtgttcactgctcactggcatgtttcaggataaactcttttgtggaaacaagaaaaggagaaaaggagcttgggcctgtgttgctgggagttcacttgagggcccctggagctagagaaggtgggacaaactgttatctacatcacacagccctcctcagaggggtgtcctattgtcctcattttacagagttggcgactgaggatcagagaggtgactctcctaaggccatggaactgatgagtggccgagcttggattcaaacccaggtctgcccagcttcaaagcccaggctcttgctcctatttttaggagaagatacagaccaagtttattttacataggattcagagattcaggatcctggagttctagtgaccatttgacagatggagagactgaggcataaccagggctagaacccaggcctactgcccctgagtctgaagttttgaccatcagcaatcattcagggtgaagggatcttgcaggaaagatgacaacttgacggggccagggttcagaggtgtgtgcagatgggaggttcagaagcttccctagaggctgcagccaattccccccacctctcccctccatcccccacataacacacttggccccctgtgaacccatggttcctgctcagagcaggcggccaaagcagtgtctttgctgcaagcgagggactgagctgttcaacgaagagtcatgtccttcatcttgtcccctgcattttacaccaccatgtaaaattttccattaattcctcggaataaaatgtagtggctgttaatttttgatgcctgggaagtagccagctgagcgcctttttatgcctgaaactattttctaccattagaagagtgtaataaaaagttttctttctttgattttattttttaattagatgagggggtttaggcaagtctgctgtcagagctgtggctggcagctggaagcccaggacgtggcagaggaaggacacaaacaccttcactctcaaataccttccccacagccaggcctcgcctctgagccaaccaggggggccaaggtctggcccaaatcataaaaaaccccgaatcttcattgcttttccagaaaggctgtttgcgagaagtagcatgcttctgcgagaagtttctgtcctgggctttggcttcatacagacgtgtgaaattcctcctctgtgtctctgagtcgaagtcttggatcctcagcttaatagctgagggactttgagcaagtcccttcccctctctgggtttctcctctgtaaaagctcccagggttgttgactaaggagacattgattaaaggagaaatgggtgtcaagcatctaggccatagtagataccctggaaacaacgatgatgggggaatgtgtttaagaggcgggaaaatgccgggcatggtgacttatgcctataattccagtgctctgggaggctgagacaggaggatcacttgaggctaggagttcatagaccagcctgggcaacatagtgagatcctactctaatttttttttttttttttttgagacagggcctcactctgtcatccaggctggagtgcagtgacatgatctcagctcactgcaatctccacctcccaggctcaagtgatcctcccacctcagcctctcaagtagcagggaccacaggtatgcaccaccacatctggctaattttttctattttttgtagagatggggtttcgccatgttgcccaggctgatcttgaactcctgagctcaggttgatccacccacctagccctcccaaagggctggaattacaggtgtgagccactgtgcctggcctacaaaataaaaaaataattaactgggcatggtagtgcacccctgtagtcctaacaacttgggaggctgaggtgggaggattgcttgagcccaggagtcaaggctgcagtgagttataattgtgccactgcactacagcctgggtgacagagtgagaccctgtctacaaaaaaaaaaggaagtgagaaggcttcaggcttcttcatgttccttgatggggttgtggtggggccgggaggagctgggtctaggctggcaggtgcaggcagagatttaggggaaggctgggcgcagcctcacctgcctgcaggaggagacctgtgggggcaggtcctgcttcgccactggcacttcctcctttcaagagtgtgtgttcctcctctcttctgggggaatcgtccctggccgctccccactaccccctcgcccgctttaggatccagacgatgccatcatctcatttcatacccagactcctgggtccatccttgctgggaatttttaaactggagacagggaagaggaatcccttcctctctggtcatgtagtcagaaagacaggagcccagagctactggtcaccatgccccccacgctcaccccatggagaagcctttctgtgcaaagacaggagggctagggacatgaagagaagcagagtgtgaggctcaaatctcatcagcctggcgaggctataactcaattaaatgcaaatctcggtgttgctgtgcaggtgttctgtagctgtgcttaacatctacaatcaattgactcaaagtaaaggagatcatccctggtaatgtaggtgggcctcatccaatcagttgaaggcctcaagagcaaatcagcttccccagagaagaaattctgcctcaagattgcagaataaaatcctgcgtgagtttccagcccggggcctgcccttccaatttcagacttgcaaacccccacaactgtgtgagccaattccttaagagaaatctagctgtctcctttccgtgtcttctattgattttgtttctctggagaaccctcactaatacacagaggaaagaaggaagagaaggagaggggatcctgacagtgggaggccctgtttcctcttgtcctggaggccaccacctcatttgtgcaccactgggtggacactgccagggccctgcccacttgcccttgggctatgcctttgaggtggggacttctttttttcttttttttgagacagagtctcactctgttgcccaagctggagtgcagtggcgcgatattggctcactgcaagctccgcctcccgggttcaggccattcttctgcctcagcctccctagtagctgggactgcaggcgcccgccaccacgcctggctaattttttgtactttttttaattagagacggggtttcaccgtgttggccaggatggttttgatctcctgacctcgtgatccgcctgcctcggcctcccaaagtgctgggatcaccaccgcgggtgcagtgagccaccgcgcccggccgagttggggactttcaatgcctgcaggctttctctggcggtctcccagggacgggcctgcctgcttctcctgcgctctcaccgaggggccaactggacttgcctcccagaagacgtctgtctgaccgcaagagtggcagttgtgggggcgctggacggaccaaacaccctgtgctccggcttacaaacggcgacgagtccatcaacctcctctgggttagagtcctaattcgcagcccccacccactgctgagctcagggctctggaaactgactgcctgattcagccaacaggatacatggtgctggagcctgtgctgatgagcccattaggggaaatgggggctcccaggcacgatgagctattccaggtcatctcaccaagcctgggcccgaatactcccatggagcccagtgaggagggcagcgggacgctacactgacttcttcccttgcaaaggtgcggggtgaatctgtctggagcagggcgggcagaagacatcttcctaagatgtcttccacggggagcggtgggcctctgggatgcccaaggtctctgccatcactctctggtctctacactttcagagggatcgtggagcactgaattgcatgggatcttaagatttcatctactctgggtgttttcaaaacttttttttttttttaagagttggggtctcgcagcctggcgcggtggctcacgcctgtaatcccagcacttcgggaggccgaggtgggtgaatcacaaggtcaggagatcgagaccatcctggccaacacggtgaaaccccgtctctactaaaaatacaaacattagccgggcatggtggcgggcgccttgtagtcccagctacttgggaggctgaggcaggagaatggcgtgaacccgggaggtggagcttgcagtgagccgagtttgcatcactgcactccagcctgggggacagagcaaaattccgtctaaaaaaaaaaaaaaagagagatggggtcttgcttgttgaccaggctggagcacagtggtttgatcatagctcactgcagcctggaactcctgttctcaaataatcctcctgcctcagcctcccaagtagctgggactacagttgtgtgccaccatagccagctccaaatttatctttaaaacttgttataggccaggcaccatgacttatgcctgtaatcccagagttttgggaggctaaggtgggcggattgtttgagctaaggaatttgagaccagtctgggcaacatggtgaaaccctgtctcttcaaaaaaaaataaataaataacattagcttagtatggtggtgcgtgcctgtagtcccagctactcaggaggctgaggtctgatgatcacttgagcctgggaggtcgaggctgcagtgagccatgattgcaccactgcactccagcctgggtgacagagtgagactgtgtctcaaaaaaacaaaaacaaaaacaaaacttgttacagagccctttctccaaggaatatcttacatcaaagccagatatataagagaaaccatgagggaccgactctatttgaggtggggaactgggagacccagctctttgatggctcccttcactgtggctgtaagacccttggagagatcaagttcagccacctcattttcccagtctgcttccacctgcctaaagtcacccccaaatctgacactacatggcacatgtcagtgggatgctcgaggaataaaagccacgtgggtgttctgctgttgctcaccaaccacactgcagtgctgggagccgtatcctggcaagtgttcaaggtggcgctagggaacagagaaggggttgtgagggtgtcgtgggcacaggccccggagggacagtgagcttaataggagtgtgtgtgtgtgtgtgtgtgtgtgtgtgtgtgtgtgtgtgatggtggtggtggtggtgctggtggtggtgtggggattacaaacaggaaggaaatctcattagatgggctgggtcttggtccaaagaccagataaactaggatgtcacaggtggggacagagtccaagattcaatgtcttcagaactctcctgatcaatagttatgagattccatgattcacaaagacagggaccatgtttcatttatttaacacatatttatttacctctttcaaacaacaagctgggggaaccgatcttactgatttagttagcatctatgggaaagctgtggtgtcaatcagggctcttttggttgaaaatgagagaacattataactcattccccgtccctcaatgaattgggactttgtgggcacctgaaactgaaaagttcaggagtatcttcaggttgaacttgatcaaagactcaaataacatgaccaagatgggattcacttctctatctctttaatcattttccttcttgttgaagcacatcctttaatcttttggtgagggcctgtgggtagtaaactctaaatcatgtatatctggaaatatatatatatatatatatttttttttttttttttgagacagagtcttgctctattgtccaggctggagggcagtggcacaacctccacccactgggttcaagctattttcatgcctcagcctcctgagtagctgggactataggtgtgcaccaccacacccagctaatttttgtatttttagcagagacagggtctcgacttgttggccaggctggtcttgaacttctggcctcaagtgatccacccacctcagcctcccaaagtgctgggattacaggcatgagccaccacgcccaacctggaaatatgttttgatctcactcttcagtgacagtttagctaggtatagaattctaggctgacaagtattttttcactgtgtttggagatattagtctactcctttctggctcctattgttgctaattagaagtctattttttagtctaattgtttctttgaaaggaatctgtctttcccacccttctggcagcttcaaaagttttctctttacccttaaagttgtccaagtgcaattagacatgcctaagcgtagattttatttatttgtttatttttgagacaagatctggctctgtcacccagactggatcgcagtggcataatcatagttcactgcagccttgacctcctgaactcgggtaatcctcctgcctcagcctcccaagtagctgggaccacaggcacatgccaccacacccagctaattttaaaattatttgtagagacagagtctccctatattgtccaggctggtcttgaactcctggactcaagtgatcctcttgccttggcctcccaaagtgctgagattacatgtttgagccactgcactcagcctagatttatttttatcccactctgaactatggcttttctctgtgaagacagtgctttcttcaatttgaaaaattcttatatattatattttactatattttattttattttattttatttttttgagacagagtctcactctgtcacccaggttggaatgcagtggtgtgatctcagctctctgcaacctccgcctcctgtctcagcctcctgagtagcggggattacaggtgcccgccaccatacctggctaatttttgtattttttagtaaagacagggtttcatcatgttggccaggctggtctcgaactcctaacctcaagtgatctgcctgcctcagcctcccaaagttctgggccatgcctggcccctattatagtttcctttattgcttttcccacatcctctttactgtctcttattggaattcctattcctgttgtacatcctattagatatataatggatcatttcatttcatcctccatcttaacttcccctttatgtttcacatttctttatctctctctgtgctgtattctgggcgaacacctctgataggtgttctatagcccccaatacttctgagtgtgattatattggagatagggtctttgaagaggtgactaagttaaaatgaggctatcagggtggcccctaatgcaatctgactggtgtccctataagaggaaatgtggatgcaccaaggggcaggaaggatgagcatgcgcaagggagaccatgtgaggacacagcaaggaggtggccgtctgcaagccaaagagcaagacctccgataaaaccaaacaccagcaccctgatctgggacttctagcctccagaactgaaagttaatagattgctgttgcttaagccactctactgttttattatgacagggccagtaaatgaatatgacagactactgtcaaacccacctattgagtttctctctttctttttgctttgtttgttttttcagtttatcttgggtgacttttttttttctatggcccagggcaagacacccacttctaggctgcagcccaaggttattgggcagtttttccagtcccaagaagaaacagctgacttccagctttttcctgatgtagggagcctagtttcagctggagggctctcacagggccaggagccttgtctttcgtcctcacagaggcattcaaaccccagtgccattcagaagtctggatatggcagccccaggtgacttagtggctccatgaagctgccagggacttggacacctttgatcttcacattttagcacccttggggtgcggctttaaccctcttgttgcacttccaggcatctcatctccaaatgccccatgtcttctgtcttttgtttgcttctttgttttgagacagggtctcactccatcacccaggctggagtgcagtggtgtgattacagctcactgcaacctcaacctcccaggctcaagtgaacctcctacctcggcctcctgagtagctgggactacaggtgtgtgccaccacacctggctaacttaattttttttttttttttgagacagtttcactcttgttgtccaggctggagtgcaatggtgaaatctcagcttgctgcaacctctgcctcttgggttcaagcgattctcctgcctcagcctcccgagtagctgggattacaggtatgtgccaccacgcccggctaattttgtatttttagtaaagacagggtttcaccatgttggtcaggctggtcttgaactcccgacctcaggtgatctactgacctcggcctcccaaagtgctgagattacaggcatgagccaccgcacccggaaatttttttttttttttttgtagagacaggtcacgctatgttgcccaggctggtctcaaactcctgagctcaagcgatcctcctgcgtctgcctacaaaagtgttgaaactacagccacaagccaacgcgcccggccttatgtgttatctcttgccacatagtggcctctgctccaagggaagcgggaagagtgagttttttcagtggtacctttcctccccatcctgaaaacaaatgtgattctcctcctaaagaagtagagcaagtgggtgtagagttgttaacatgcaatgtctgccacataaaacatgatccccattttggtgaggaaatcacagcctggagaggtgtggtgatttacacagcctggattcgattgcactgagcctgccccaccctcaccctgctctgattcagggaccctggcctggccctcatctttggtggttgctgtcgtcaaggcactggccttgcgtgatggatgagcaggcagcctcattaaacacaaacccttgttggtttcccaaagcccacaggagcagcgaggcccgggatctgggagcagggaagctgaacaggaccccatctgtcctgttccctccggcttctgctcaaacaggcatttgtctgccatggcaagagggcagcctcagacacttcatctctgggcaattagggggctgcacgtgagaagagtaatgactggccagaggggatttatcaggggccagtgtggctgggcggggctcaagatttgacatccacctcttttccgaggggaaggagctggttagcatccctgcctggcagtggagcctcgttagctctgccttctactgtcccttccccctccaacgctctgctccccaccccacctccttgtctctgccctagatcagaggccaggcactagctggatggtcacacctgcctcctccatgctgccccctgtgaaccactctccgcactggctgctcacaagtctgatcacgtcacacacctcctccctacctttaaatccttccatggctccctactgcccaaatcataagcagctgttgtgttcgggtggtcctaggtgaccagcttccccacgagcgatttctctcctttggtttgattcgtgtcaaagatgagtcttagacactgcctgatgctcaaacggtttatccttttcttaaaaaaaaaaaagatgggatcttgctgtgttgcccaggctggtcttgaactcctggccttaacccatcttcctcccttggcctcccaaagttctgagttacaagcatgaaccatggtgcccggcctcaagtgatttattttggctgtgctgttacgagacagacatcaatgacacgggccagatacacttaggaggtcagaggaccagctgaccaggagggtctctgtgtagagaccatcctcagagtttgggggatccttctcccttccctagacctgggttcagtctaggttagtcgccaggtgtttctttcaaaaaagaagtttaagctattcttgtaaggggaagctttgtttcaaggtttatgaaagttgcatctgtgctgaggtggtcttgttttctggaaatcccctggccagggttggaaatcctggggccaggctgtatcaactgctaagtgacacctggtgtccggcctgtgagatgcttaagtgggtcctatggctcttgttaatctcacagttgcagtatgtctctttttatactatgacagcaacctcagccctggtgacctcagctcccgcgccgcatcctctgtactcttgctcttcaatttttaagaatgagtttcatgattatgggtttcaaaaattacattcaggactgcgtgtggtggctcatgcctataatcccagcactttgggacgccaaggtgggtggatcacttgaggttaggagaccagtctggtcaacatggtgaaaccctgtctctactaaaaaaaataaaacttagcagggcgtgatggtgcacacctgtaattccagctactcaggaggctgaggcagcaggatcacttgaatctgggaggtggaggttgaagtgagccgacaacatgccactgcactccagcctgggtgacagagtgagactccatctcaaaacaaaaacaaaaacaaaaacaattcaaaaggcacacagtaaaacaaggctaactcctgcatcgtcctcacctgcctagtccccatcacctgccacatgccttagttccttgtgtatccttccagtttctttatgcaaatgtaaataggacaaatatgtcgtcatatttaccacccccacacatgctttatatacaaatggtagcttatcaggaacgtggttctatactttcatttttgcacttaatacatcttggagatctttttgtatctgcagagagaaggctgcttcattctctggtacagcttgaccatcatttccttagccagctcccaggtagtggatgtttgtgtggcaggtgctgctgctgccctgtcccatatctcccacctaccagagctcaccagcagccctttcatttctccaggctttagcccacacaggtctctctgcctgggatatgcttctgcttcttcatctcaaatcaagagtctggcagccccgccagagacactaacctaactagttcaggcagggctagcactttgggcctcagggtctcccttacctcctctgcctcaggaatgatcacagtggattaaatcctctccttatctgcctgcctggctgggagcacctgggcaggggtcagagctgtgggggggcaatggggaagatgagtcagattcatcactatgtcccagcacctcttaccacatcccatggcctctagtgaagcaggagaaggattgtataaaatccaaactccttcccgtggcctacaaagccctgctgaccccgtccctgcctgccatcacccccaacctcaggtccagccagtgtggccttcttgttcctcagagacctcaaactcgatcctgcctcagggcttttgttcttatactttcctctacttggactctcttttccccagatctcctgattagacctcagctcaaatgacacttcctccaagaggccttccctgaccaccttgactaaaatatcctactcacccctgccaactttgggaacccaaggcaggaagatcagttgaggccaggagttcaagaccagcctgggcaacatagtgagatcccatctttgaaaaaaaaaaaaaaacacccccactttcttagcagttatgggatgaattgtgtccttcccaaagtttataggttgaagccctaaccccgagtacctcagaatgtcactgtgtttggagataaggtctttaaagaggtgaataagttaaaatgaggccagtagggctgggtcttaatccaatctgagtggtgtcctttttgtttgtttgtttgtttgttttgttttgttttgtttttgagacagagtcttgctctgtctcccaggctggagtgcagtgatgcgatcttggttcactgcaacctctgcctctggggttcaagcaattttcctgcctcagtctcccgagtagctgggactaacaggcacgtgccaccactcccggctaattttttttttgtatttttggtagagacagggtttcaccatgttggccaggctggtcttgaactcctgagctcgtgatccacccatctcggcctcccaaagtgctgggataacaggcgtgagccactgtgcccggcctggtatcctttttaaaagggggaagcaacacaagggatgagggtgcacagagggaaggccgtgtgaggacatggggaggaaagccgaggagggaggcctccaaggaaaccctgcgggtgccttggtcttggacttgctgcctctggaactgtgggaaaataaatttctgttatttgagccaggggtcctcaatcccctggccatggaccagtactggtccatggcctattaggaacctggcacacagcaggaggtgagtggctggtgagggagagaagcttcgtctgtatatacagccgctccccatcacacgaatggctgcctgagctctgcctcctgccagatcagcggcagcattagatgctcacaggagtgtgaaccctgttgtgaactgttcatgcgggggatctaggttgcatgctccttatgagaatctaatgcctgatgatctgtcactgtctcccgtgactctcagatgggaccatctagtcgcaggaaaacaagctcaggctggacctggtggctcacgcctgtaatcccagcactttgggaggccgaggcaggtggatcacgaggtgaggagtttgaggccagcctgaccaacatggtgaaaccctgtctctactaaaaatacaaaaattagcagggcacggtggtgagcgcttgtaattccagctactcaggagggtgaggcaggagaattgcttgaacccaggaggcggaggttgcagtgagccaagatcgcgccattgcactccagcctgggcgacagagagagacttcgtctcaaaaaaaaaaaaaaaaaaggaacacaagctcagggctcccactgattctacattatggtgagtcatataattatttcgttgtatattacagtgtggtaataatataaataaagtgtacaataaatataatatgaatcatccccaaaccatcccccccactatccatggaaaaactgtcttccacgaaacccgtccctggtgccaaaaaggttgggaccactgatttaagctacccagtctgtggtactttgttatgcagcctaagctgactctacatcttccagcgcatttcttccaatgcactgtctgacatgacttgtttactgtctgcctccccgtacaagggcaagtcatttaattgtcttgctcatggtgtagccccagctcctacaacagagcctggtacatagtaggcactcaataaatactcacaggatgaatgagcaaatgccaattccatgaagcagagagtgtcatatgaagatccccccaacgctcacaagcacatgtgtgaatgcacccacatgtgtgctcagacatgtacgtggatagctgggcgctcacacacatgcatcctgccctgcatctttgcctctgaccatgtccacttcatggcaagggccatgtacacagcctgcaggctcagcggatggcatgactgtgcctgtttcaagctggctgtgcctctgagctgccctcagaaacccacgcctggcgctcctgtcaggagtgtgcttggatgctaggcctcccagaggggtcagaagatggggaagaagaatctgtttgcaaatggaaatcagaataagctctaccaggcacagagaacagggaaggcagtgggcagaatatgagttttcccagccccccactgggggtcagaacaatcagcgagttccttctgtgccagccacatgacaagtacattatgccctgtgaagtggtgggttattcactcccattttaccgatgagaacacaggctggtgtatcccagcattttgggaggccgaggtgggatgatttcttgagcccaggaggtctggtttgcagtgatctgtgattgtaccatagcactccagcctgagtgacagagtaagtccctgtctctctctctctctctctctctctctctctctctctctctctatatatatatatatatatatatatatatatatatatatatatatatatatatttatgtacacacacacgggattggagagaccaattcaatactccctcagtatttttttttgagatggagtctcactctgttgcccaggctggaatgaagtggcttgatcttggctcactacaacctctgcctcccaggttcaagtgattctcctgcctcagcctcctgagcagctgggattacaggtcccccgccaccacgcctggctaatttttgcattttcattagagacggagtttcaccatgttggcaagtctggtctcaaactcctgacctcaagtgatctgcctgccttagcctcccaaagtgtcccccagtattttatggaggccctaggtataacactgattgctcacttattttgttgaagcagatgatatggtgattaagagcctcagcttgggagccagacagcctgggttcaaattcttgccctgataattactagctgtgtgattttgggcaaatcacatcgcctgtctatgccttcctttctttatctgtaaaatagagttataatggtacctacttgcttgagttaatacatgtacagggcttcgaatggggcctggcatgtagtaggcacatttcttgagcaataaatgttagtccttattccttatttctaattgtatcaggatgttcccaccgaatcctgctcctcctccagggctgtgccagctgcctctctttcaggccagaccttgaacaatctttgctgtaagaaggtatcacaaactggaaggcttacagctacaggagtgtattctgttagtgctggaggccaaaagtctgaaatcaaggtgagggccgggcctgctccctctgaaatctttcttgcctcttcctagggggatccttccttgcctctgcctagctcctggtggtttcccagcaatcctcagcgttccttggtgtgcgggtgcgtaactccagtctctgccttcctcatcacagggcattctccctgacttcacatagctgtctccttagaagaacgcagttctatcagattaggggcccattctactcaaggatagcctcatctttaattactaattaaacttgcaaggacaccattctcaaatcagatcacattctgaggtccatatctttttttttttgaggggattggagagaacaattcgacccataatagcaaatctctcttgtccctggggaagctgtgtctttaaaaagagctagatggggaataaagagatttcaaagccaacaagaaaaatggtcttgaagtggatgctctggttctccgtgtctctggtttactggctggactgagctccctgggtagttttattctccgatcgctgccgtcacccatattctgtcttccctgtcccttcatgggttgtacggactgccgatcacactggagcatgagggagtcccggccagtctggcccagttgaaagccccacctctcctctgggttaacatggaggagggagggcacagggaaaaggtctctcccctaatagcttcctgttggggactccctcacctcttgtggccaatgccatctctcaggccatccctgactggccatcagggatttctgtgtcattagggccggatggtggctctggcatggggtgcaggtccttgggggatccttggaggcctcttttccttgcattcccacagctgactctgtgtgccctctttttctcccgtagctccccttccctgcctgttttcctctgggcccccttgcctggtcagcagccctctttgctggcagagcagcaagatgtctccctcccatgatgccctcttggctcctggaaacctcccactcccttgctacccagttgctggggctggggtgtgggctattccacgtgtcctctctgcctgcccatattttttcatagttcattcatagttcttctccccaaaaagagaggcatgagagcaggggagcctaggcagaccctccactggagaatgaggtgttggaccctcctaaatgcagctctgctttctgagatttcacttggaaccccctacatttggcttgaattgaggaagtgagagtcattctcccttcccaggggagggaaaagtcttagtgccacctgccttctcctcaggctgggacacttaactccaaagacctcccccaactccccacctgcttatttaaagggggcccaggggaggtagaagagctggtctggctgccccttaataagtcctgaggtgccccccaccaccatcttggtggttatcttggaaaggagttcaatgtccttttgtcctctgccctgggtcacattgcacttaacaacccttggcatctgcacttcagcgcatcctccataacctgaagactccagaaaggaggaagggctaaaagtatgggataagctacccccaaattattggtgcctcctctgtaccaactttgtaacaggtgtttgtctccatggacccactggatgctctgtgagctccatgaaggtcccattttcccaggaccaggcctggatcctggtacattatatatactcaagaaaacatctgttgagagagtgactgtggtggctttagtggttgtcctaaggtttacagtatacatatttaatttgtcagagtctatcttcaaataatatcataccactttatatgtagtataagaaccttacaacaatatactctccattcctctctctcttccactatgctactcttaccatgcattttgtttttacatttgccacaaacacacagtactttgctactgttttgctttagatggtcaaatatattttagaataactaaaaatatgaaaaaagcaaaatttatatttatcttcttttatgccatttctagcatttcttatttctttgcatagatacaagtttctttctggcatcatattccttctgcctggagaacatcctttaacacatcttatagtgcaggtctactggtaattaatgccctgattttgtttgactgaagaaatctcacacttcttcctcacttttgagagatatttccactgggtatagaattttaggttgacagttgtttgctttcagcactgtaaagcagtcaccccactctcttttgctctgcatagtttctgatgggaagttggctataattcttatcttttcccttctgaatgtaatatgccttttttctttggctgccttcaagattttctctttatctttggttttcggtagtttgaatatgattgtgtctagggttgtagggtttgtttgtttgtctgtttgttttctttttcttttttggtcttgcttagtgttttctgaactttctggatctgtggtttggtgtccatcattaattttgaaaaaattcccagccattatctcttcaaatatttcttctgccctattctctttctgttttacttctcagattctaattatgttatgtatgttagctcatttgatatttgacattctttcatagctctgagatgctctcatctgtttttggtctcccccacctcccactgtttggatagtttttaactgatccatgttcaagtccactgattctgattctttccttggctgtgttaagtctactgatgtgctcatttaagatttttattttttaagagataaggtatttctctgtcacctaaggctggagtgcagtggtgcaatcatagcttactgaagcttctaactcctgggctcaagtgatcctcctacctcagtctccagactgaggcgcataccaccgtgtctagtaaagtttttatttttttatttttacagagacagggtcttgttgtgttgcctatgctggccttgaactcttgggctcaagtgatcctcctgcctcagcctcccaagtagctaggattgcaggtgtctcccaaagtgctgggattacagctgccaagcccagaccatctaagacattctttattgctgatactgtgctttctatttttggcatttacatttgatattttcttctagtttccacctttttgctgaaatttcccatttgttcatgcatgttgtctactttttccattagagcctttaagatagtaatcatagttatttaaaagtccatatatgatagtcccaacatctgggccatatctgagtctggttgttgatttcttttttctttctctcccttccttccttccttccttcttcccttcctttcctcccttcctccctccctccctcccttctttctctctctctctttctttccttccttccttccttctttccttccttccttctttctttctttccttccttccttccttctatctttcttttttctttctttctttccttctttctttctttctttttttctttctttccttccttccttccttccttccttccttccttccttccttccttcctttcttctttctttctttctttctttctttctttctttctttctttctttctttctttctttctttctttctgacagtttcactcttattttccaggctggagtgcaatggcatggtcttggctcactgcaccctctgcttcccaagttgaagcggttctcctggcgtggagaccaggtgccaaacaactggtaaaaattcagctaaagttttaataagttgctaaggctgagtatggctgggatagaaatatggatccactgggagcagcagacacacggggaatttgcacctgttcacaggctcatcttcatggatggcgttgggtgctatgagaaagactggggatagagtgagagatgagagaaagcctgccttgtggtgcaagcctaggggaggggagcagcagccactgctggagaagagccataagacactgggaaaggttggcaaatcctgtcaccctcagtgcccattgcagctgggagaagggaaaagaaaaattcctatcctgatgggcaaggggcgagggtgagaaggccccacccccaagacccagggacacagtgcctgcctaagactgaagcagtaccaggacagcagagaacaaacaacctccacgcagtatacacgcacaccttccagccccaggctagcaagtatcaagtaacaagtagtagtctgctgctggagaaggatcaagagcacatggagaagccaggcatggcggcacgtgcctgcagtcccagctactcagaaggtcgaggcatgaagatcacttgagcccaggagttcaagaccagcctaggcgacatagagatgcaggatctctgacgtgcaggatcgtagacaaagtctggagctgagggtggaataagatcattgaagaaaaaaacgctcctggttccaccttaaacacaaaggaatgctagaagaatttgaagcccacggtgcactgatggtaagccagtaacaacaaaggccaaacccagctccattcttgtcccctacacttaaggcctagcaaaagaaaaggcatgcccatttccagtcataaataccatttacctcatctctaccatcccatgcaagatgtctgtctgtaaacagaaaattagaagacatacaaagaaacaagataaaataacatattgtcaagagacaaagaaatcaacaaccaaggccaggtgtggtggctcatgcctgtaatcctagcaatttgggaggcagaggtgggtgatttgccttagcccaggagttcaagacgagcctgggaaacatggcaaagccccgcctctacaaaaaaaaaaaaatacaaaaattagccaggcatggtggtgtgcacctgtggtcctagctactcaggaggctgagatgggagatcacctgagcccagggaggtcaaagctgtagtgagctgtggttgcgccactgcgctccagcctgggcgacagagcaagaccctgtctcagaaaaataaataaataaataaaaaataaaagatataaaacggtagattatctggccttttctcgttgtgagggtggatgtgatactctttccagctttctccatcctaagtggaggctggaggggaaagtggaacagttgtggaacatgcacacacattctttgaatgcagtggaagtgactctgcacagcttctgaggctgtgtcatagagggtgaggcagcttccactttgctcactggagttctgagctactatgtcagaggttcaattactccgagatagccaggctgtgaggaagctgattctcagctgtcgtattgacatgccttaccttggagttcaaatcagcccctaatcaaattggattctgtatttctagccattaagaaatccagggagatcaataataataacagagacattcagagaagcacagtgcctctctggaaaaatgaagggagtttcgtcccactcagccatggcccagacaaagacagttgtaagcaaatggaggtgatgatggttttgtttaactgtcctggcacatcaaatagccagtccaattcccccacacaagtcttagcaacaggggaatgcagaatatcctaagattgctcagtggggcccaactgtcatcagtggggcagcagccatctagtgcatgatgtgatcattaactagcctgtgacagagaacatctgatgggtacaagctttgtttgagggctgggaggaaaacctcagggacttgaggaaatcctggaatcctggtcacagatcacttggtcatctatctgcaaggtcctttgtaaagtttctgttcttttggtggattcaaaggagattggagtgagctagaagatcccttcctctgatattgcttttgggtccaaggtgtagatgggtggtttcatctcaggtgatgaatggcagtctggagtgctgtgttgagaaggattctgaggttctgtccaggttcagcaggaaagagctctgtggtcaatttgtgatgtatcccacggaggcagggagtggaagaggcatatttgctccatatttgtaagctgtcttaggtcggttccagggaagcggactctgaggtggggatttgcatgcaggaagtttattggggcatgcattcaggaacatttgcgagagtgagaaagccaggttgggcaacagaggcctcctcagtcaatcctatgggtgtctctggagttgtcttccattgaggccaggtgtgaaccagccattgatgcagccaacactcctgaaagttgggggaatgaggtccttttttgtccaggcaatcatgtgcccagctgcaagggatgaatgatgggtgatccaaattattatgactactccattcctccttgctagtgaccagtctaggggtaggcgtgtgacctcatccagtcaatgacattgaagggcaagtgtgctaggggctccaataaagactctctttcttgataaaggagacgttagaaggaacactttctcctctcctttcttcattgggatgtgaagcttggagtttcagcagctattttgagagcaggaaggagatatttcccacacaccgtggatgtcagagtgaagggcctgagtctgggtgacctcactgaaccattgcaccaatccagatacctctcaccaccagcttccttggcatgtgaaattaacaagcgtcataatttaagcactttagtcaggcattctgctattgcagtggaatgcttcctgaaacagttcccctcaaaggaacaccattcaatgagtacatggctgcctgtatccaaactgagttctgtgagccaagaaatatgggaatggcttgaggataggacatcaggtctcctggaaacatttcttatttttgttttcctagcatagtttgcatcagagaaatgcaccttccatactccacataatcctggagggctgtcaatcacagacccacatccccaggccaacagggcaggcactattacccaaaataaatcaatcagacttcatctcctgggaattcaaaccttaaatgaagacacagggtggggactcctgtgctgtctctcccaagagcctcttgttgggtccttttgcatcctctttttcattttttttcttctcttttttttttttttagatggagtctcactctgtcactaggctggagcgcagtggtgcgatctcagctcactgcaacctccgcctcccgggttcaagcaattcttctgcctcagcctcctgagtagctgggactacaggcacgcgccaccatgcctggctaattttttgtatttttagtagagacggggtttcaccatgttggccaggatggtctcaatctcctgaccttgtgatctgcccaccttgtcctcccaaagtgctggttgcaccctcttttctctctacaagtctaactccacactgcaggcagagttatcatttaaatgcaaatctgatcttgtcactctcttaaaactcctcagtggctccccagtgcttttgggatcaaggccaccattcttctggtggactatggacaagctgatggatattctgtgggatacatcacagccagctggaggcatgggtttataggtgagggatggcaaggatatgggggtgttcaaaggaggagaagggaccctggaagaaattgtgatgtcattcaggactacaggataggcatgaatggaagggctatgtgttgggtaattactttgtgcaggcacctgccaagtacaagcacacctgagaagcatgactctccccattgtgtagcagaagaaccaacactcggatgggttagataacttgcccaaggtcatagagcttgtcagaggtaaaacccgaaattgaaccagatcactgtcctcgatttcaaagtccactcctttagctacaagtccatccaccgcttttgtgacagacattgtaatgtgctccccaggacccctttaggaattgctatggtttgaatgttcacgtccgctccaaaattcatgttgaaacttaatctccaatgcaacagtactaagaggagaagcctttgagaggtggttaggccatgagggctctgcctgcgtggatgggattagtgctttataaaaaggcttgagggtgtgtgttcacccattcattccttctgccatgtgaggacaaggtgtttgtcccctctggaggatgcaacattcaaggcaccgtctcggaagtagagagcagccctcaccagacactgaatctgctggcaccttgatcttggacttctcagcctccagaactataagaagtatatttttgtttttttataaattactgaggttgaggttttttgttccagcagcacaaatggactgagacagaaatgaaggatttattcccatggcttctgggaacgctgccagaagacagccctcagctattagccttctttggagattgtctcaagagaagaaaacggtctcataccaaggtcatgcctccttccagaggcagccttcatccaacaactgaccaaagctgtggtacagagacctggtccagttgccctagttcaggtcaactccaaagggccatcccaactggagagcccctcccagagtcagctgaaccttcaatgagactctgcagccgcaccgctccctctgcccaatcctgcctctgtcccctcccatcctcaggtgtgagcctaacagcacgccccataaacatcctgcaaactcatctccatctaagtctgcttccccgggaacccagcttgtgacagaccccagatttcttaccaagaatttgtttctgctgtttcctctaactgaaatgtggttcccccagcctctctctctctctctttttttttttttgagacggagtctcgctccgttgcccaggctggagtgcagtggtgtgatcttggttcactgcgacctccgcctcccaggttcaagcaattctcctgcctcagcctcccaagtagctgggacgacagctactgggactacagtgccaccatgcccagctaagtttttatatttttagtagagacagggtttcaccatattagccaggaaggtctcgatctcctgacctcatgatctgcccgcctcagcctcccaaagtgttgagattacaggcatgagtcactgcgcccggtgtagcctctctttatcaagatgttcctgctcattctctgagtgagagtggcgtgaacacagctctgccacagtcaggctggtttctagccatatacctcatgactgttcctactgtagtgccttagcttgtggtatacccccagtcctcctggaatgtccttcaccatcctaaccctaccaccttagctggactcagaggaacaaatatataggactgacaattacagtcgctcaggatgctcactgcacaactcccagggggcaccattcccagttcagcgatcaacctgtccagcatcactttgcaaattatgctacaggaggttgagagccaggctttgggtcaaaaggacccagatatgaatcctggttctgctgcttattagctatgtagctttagaggaaacattaattcttgtttccttggtgttttcatctgcaaaatgagggtataccataccgtagtgattatttttacttttttttttttttgagatggcgtctcgctctgtcacccagcctggagtgcagtggtgcgatcttggctcactttgcagcctctgccttccaggttccagcaattcttctgcctcagcctcctgggtagctgggattacaggcgcacaccaccacgcctggctaattttggtatttttagtagagatggagtttcaccatgttggccagactggtctcgaactcctgacctcaggtgatccacctgccttggcctcccaaagcgctgggattataggcaagagccaccgcgtccagcccatattgtattgattctaagatgcacagtttttcattttcacatctctgaaattaggctatatcttacaattgctggtatgctatatttctaatcagtagcattttttctttcttggtgttgataaaatcacggtgcatattataagtaatgccatggtagacttgttgaaagatggaaaaatatctatctcagaggaggatggataagaccagcatgggatgcccagggtgtcacccaccctgtatcccctcagtctaccctgagggtcacctgcagcttctttggaagttcttgtacaccatgtaaatggagcaagtcatttccaacccccctttctcagtttccttgtctgtataaagggtacataatagcaccacctcatagaaggttttttttcattttttttctgagacagagtcttgctctgtcaccaggctgcagtgcaatggcgtgatctcagctcactgcaagctccgcctcctgggttcaatcgattctcttgcctcagcctcccgagtagctgggattataggcgcccgccaccacacccagctaatttttgtatttttagtagagacgggtttcaccatgttggccaggatggtctcaatctcttgacctcataatccgcccaccttggcctcccaaagtgctgggattacaggcgtgagccaccgcacccgacctttttttctttttaaagagggtcttgctctgtcactcaggctggagtgcagtggcacaatcatagctcactgtagccttgaactcctgggctcaagcaatcctctcacctcagcctcctgagtagctggtactacagctcatcaaaaaaaaaatttttttttagagacaacatgtgtctaaatgcttaggatggtctcgagctcctgggctcaagcaaacctcccaccttggccgcccaaagtgctgggattacaggcgtaagccactgtgcccaactctcatacagtttcatgaggacaaaatgaactcgggatggcgaagtgggtgtgccctgtgtcagcctgcatgctgccaggtgcagctctcacagcctaggctgaggccattggcaatggcaatgcagtctctgtctgtctgcctggcttttgttcatctctggctgttgggagattcgaggtgaggtaggaggtagctcctcatcccaggtaggcaggaggacctgggtggcagtcctcgctctgccagcttgggtgagtctcactacctctctgaggcccagcttcttatctgtattagtgatctcttgggcttattgtaggactaaaagtttgtgaaggtaaagtgcttggcgcatggtagatgctcagttttaaaacagaacttctgcctggccaaaagaaaagactggctgggggctgacatggaggcatattgcccagtggcccactcctgaagatggtgaaggtagtataagtgtaagagcccacactcagagcctgtccctacctgctgagactccaggattaaaaacctgaagtacagccgggtatgctggcccacgcctataatcatagcactctgggaggctgaggcgggtggatcacctgaggtcaggagttcgagaccagcctggccaacatggtgaaaccccatctctactaaaaatacaaaaattagccgggcgaggtggtgggcacctgtaaccccagctacttggggggctgaggcaggagaatcgcttgaacctgggaggcggaggttgcatcgagccaagatcgtgcctttgcactctagcctgggcgacagagtgaaactccgtctcagaaaggctaacaaacaaacaaacaaacacctgaagtaccacaggcatctcagatcattcctgcctccaggctggaaggactctgtgatgttgtgatattataagaaatacacgcgtgtaatcctggcactttgggaggccgaggcaagcggtttgcttgagctcaagagttcgagaccagcctgggcaacatggcaaaatcctgtttctacgaaaaaaatacaaaaattagccgggcatggtggcacacacctgtagtcccagctgcttgggaggctgaggcaagaggattgcttgagcccaggaggtagaggctgcagtgagctgagatcacgccactgcactccagcctgggcgacagtgaatatatacttatttggtctctgcctatggttcctgagatagagatcctaagaccttgtaatttcctgagcaataggggagtgaggagaatcttttgttctgatattcggtctttgaccccagttcctgacacaaagctccaaaaacctttttaattgcctgagtaatgggagcacgtagcacagctcctaaatccctcaggattccccgggtgacaggagcttcttttgttcttacgaggtgactcttggggggctcctggacagcctcagaatgggggttggttgccaagggaaccaaccatgtgattagagagttggaactttcagccccaccccctaactccaggaaggggagaggggctgaaggttgagtgggttaccagtggccagtgatgtaatcagtcacgcctatgaaatgaagcctccatcaaaacccaaaaggattgggtacagggagcttctaggttactgaacacgtgaaggtgcctggagggtggtgctcccagaaggcggggaagctctgtgctctctcactcccacgtcccttgccctgttgacttcttcacctggctgttcatctgtcctgtgtaatatgctttgtaacaaacctgtaaacataagtgcttccctgagttctgtgagctgtcctagcaagttaacctaactcgagggagtcgtgggattcttagtttgcaggctgtcattcagtggtgacgacctattacttgcaactagcctctgaagtgggggcagagttgtggaactctgtgtgatctgatgctatcttcacgtagagagcatcagaatgcatctgaactaattgaattagaggacaccctcttggtgtctgctagagaactgcttggtgtgtgggaaaacctctcactcacacatctgctgtcagaagtgttgtgttgtgtggtgtgtgaaagtagaaaaacattttttccacttacctctctctctctctttttttttggagacagggtctggctctgtcgcctaggctggagtacagtggcttgatctcggctcactgcagcctctatctcccaggttccagccatcctcccacctcagcctcctgagtagctgggactacaggcacatgccaccatgcctggctaattctttttttttggtaaagacagggtttttttatgaactcctgaggtcaagcaattacccacctcagcctcccaaagtgttgggattacaagcatgagccactgcactgggcctccacttatcaattttttttgtttgtttgttttttgagacagagtcttgctctgttgccgaggctggagtgcaatggtgtgatctcagctcactgcaacctccacctcccagattcaagcgattatcctgtctcagtctcctgagtagctgggattacaggcaagcgccaccacacccggctaatttttgtatttttagtagagatgaggtttcaccatgttggccaggctggtctcgaactcctgaccttgtgatctgcccaccacggcctcctaaagtgctgggattacagacatgagccaccgtgcccagcccacttatctcttatagaccccaaacctccaaccaagtttcatctctgaccaaaaacctctctgccaccttgtgtacggaccaagattccaccattgtcacgctttcctggcatctcaggctggcacattccacatctattctaatcttccttcagacactgtttttctcctatgataccattaactaggagttgtccactctctacttgaatgctcctagccatgaggatctccctccctcctgagacagcctccttcagcagagtccagctgtctcctgtgcagttcttccttacatgcagctcctgcctgaccctcccaggcccccatgctcagtcctaggtctgtccctggggccacccagaagtggtctgctccgcctacatccccatccccacaaggatgaaatgttccttataggacaaggtgtatctaccatttctttttttttttttctttccttccttccttccttccctctcactttctttctttcttttttttttttttttttctgagacagagtctctctgtcacccaggctggagtgcactggtgcaatctcagctcactgcaagctccacctcccaggttcaagcaattctcctgcctcagcctctggagtagctggggctacaggcacatgccactacacctggctaatttttgtatttttagtagagacagggtttcaccatgttggccaggctggtcttaaactcctgacctcgggtattccacccgccttggcctcccaaagtgctgggattgcaggtgtgagccaccatgcctgacccatcatttctttaagaaaataaaacacctctctctttaaatatatgcctttctttttttaagtggaaaagtaatccatgtgcattgttgaaaacatgggaaatgtatgtcaaagtagaaagattaaaattacccataattccaactcccagaaacaaccactattaacttttacttctgccttcctattcattttccccataattgagcgcatagtgcatagaaaatttggtgctctgctttttccacataacattattacaggaatatttcgctgtaccattcaaatttctttcaaacatgatttttatttttaatgattatgtagtacaccattgtctagacaatttactgatcgttcccaattgttagacatttgggtcatatttaatttttaactatgatgtcacaatgctgtggttaaaaaaaagttgtatataaagtattttaccgctttcaaattatttccttagactcatatcctagaagtattaccattaggtccaagggttgtaggtattttaaagacgacattctcccaacttttttgtctttaacagctttaatgggatgataaatacagcttgagaaacatattgtgtgacaagatgtcacaccaatagccagactgtaaaactgtacacaacatccttttataaagttttatcatttgttttcaattttataaagatgtcttactgtactggtcatttatatcttatcattcacacaccagcagtacagatcccagggacagcgcctaggactgaggtgctccaaggaggacagaggcaaaggcatggcattctgctgagaaaagacttgtaagagcaattcattattttattttattattaaatttgtttttaaattattattaaaatatttttcatgatggggtctcacactgttgcccaggctagagtgcagtggctccagtacagcttactacagcctccacttcgagggctcaagcaatcctcctacttcagccttctgaacagctaggacaataggcgtgtgcccctatgcctggctaatttgttttagtttttgtagagatagagtttcactgtgtcaaccaggctgttctcaaactcctggcctcccaaagtgctggggttacagacgtgagctactacgcccagcccaattcattaccttaaaaccaatttttactcatgctaaaatcatatgagtgggccgggtgcggtggctcacacctgtaatcccagcactttgggaggccaaggctggtggatcacgaggtcaagagatcgagactatcctggctaacatggtgaaaccccgtctctactaaataatacgagaaattagctgcgtgcggtggcgggtgcctgtagtcccagctactcgggaggctgaggcgggagaatggtgtgaacctgagaggcggagcttgcagtgagccaggatcgtgccactgtactttagcctgggcaacagagcgagactccgtctcaaaaaaaaaaaaaaaaaaactcgtatgagtgtccattatatgtactttttccaacattaaatactgtttttcaatatttgcaaatttgataggtaaaaatgaacacatttttcattttcttcaaattttttaaaattttattaatatggaatactttaatatttattggtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaatttattggtcattcgtatttcttctcgtgcaaactgtcaatgtcgcttgtctctttatctgctaggggtcttactaggtgttttacttgttgatttataagaactctctatatattaaggatgttttggaagccaactattatctcaacttgttgtttgcctatatgtttcatttgtgagtgtctgtagagatcatttaaatttcatgagccgagtgtatcagtcttttattttgtgattcttttttctcctttgcttttttttttttttttttttttagacaggctctcactcccatcgtggaggctggagtacagtggtgcattcacggatcactgcagcctcaacttcctgagctcaggtgattctcccacctcagcctcctgagtagctaggactacaggtacatagcaccacgcctggctgattttttgtatttttggtagagacgggttttgccatgttgcccaggctggtcttgaactcctagactcaagtgatctgcctgccttggcctcccaaaatgctgggattacaggtgtgagccactgcaccctgccttctccattgctttgtaatttaggaagtcttccccaacttgatgaatatctgtttctattttcttctaggttttaaatgtttgcttacatttaactggattccatctggagtttatttttgtatacattttgagggaaggatctctgtggatcttcttttttctttacccaaatagtaaatcaattatgcacgaaatagttttgggtgcccccaccagcctcatcacccatggaaaaagctttcattctttcatgtccttcctaaagtgtggggaccagaacaggaacaaataattcttaaacaattaaatgaaagcctaagctagattcttttcagccttcttataacaaccctgagaaggagattgattatcagtcccatttatggatgagaaagctgaggctcagagacgtaaagcaactttcccgaggttaacacagctagtctgatctggaattagaacatacattgtttgactgctatatccccaggcctcagcatttataattggtttcaagttgaattagctctgggttctctttacagaggaaccacctgactttgctactgggagatgagcatccagagcccagaccttcagagaatgggcttgggaacctgagcccagaggaaacacatgccaaaccagttggtgaatttgtttttattaatttttttttttgagacagagtctggctctgtcacctaggctggagtgcagtggtgtgatctcagcttgctgcaacctcacctcccgggttcaagcaattctcctgcctcagcctcccaagtagctgggattacaggtgcccaccaccatgcccggctaacttttgtatttttagtagtgatggggtttcaccatgttgaccaggctggtgttgaactcccgacctctggtgttctgcccgccttggcctcccaaagtgctgggattacaggtgtgagccaccatgcccagccaaatttgtttttcttaagttagcaaaatcctacattttcactgaaaatattttgggtgtctcaacaatcttcacacctctggtttcctttaggatgaatttggttaggctggtttgttttgttttcttgttgcaagggacaggttcccactcagtggttaaaatgaaggggcttactaaggtcacagaaaccaggatggatccagatgtggtgactcatgcctataatctcagcaccttggaaggctgaggcaggaggattacttgcggccactagttcaagaccagcctgggcaacatagcaagaccctgtctctataaaaaaattgttttaaaaaaaattagctgggtgtggtggtgtgtgattgtactctcagctacttgagaggctgaggcaagaagatcacctgagcccaagagttcgaggctgcagtgaactatgatcacaccactgcactccagcctgggtgacagagcaagatcctgtctcagaaaaaaaagaaaaagaagaaaaagaaaaagaaaagaaaagaaaggaagaaaccaagagagaaaaacacagttcataggggctttaggacaaatgccagccctgcccttcagtgcccctggaagtcactgtcctgcctctctctgcagactacaagctaggctgcttcacagggtcccacagggtgtcagcccctgagtttgcatacaaacctacaaaacacagatttgggagtagtgtgcttaccggatttgggggaactgccaatctctatgattttgcaactcgaataatcctcaccttaaaaaaatttttttgagagtatccaattttttgttgttgttgtttttgtttgtttgttttttgagatggagtcttactctgtcaccaaggctggagtacagtggcacaatctcagctcactgcaacctctgcctcccaggttcaagtgattctcttgcctcagcctcctgagtagctgggattacaggtgcgtgccaccatacctggctaatttttgtatttttagtggagacagggtttcaactagttggccaggctggtcttgaactcctgacctcaagtgatccgcccaccttggcctcccaaagttctgggattacaggtatgagccaccatgcctggctctaattggttgttgatcaaccaatgaattcactgtgtctagtcaggtgaccatctctagctccatcaactgtaatggtagctgtgggaggtcgcgtggttcccaggacgcccctctccagagcttgaggtgaggcagagaaactgacatccccgtctcaccagaggtacccaattctgtattccacgggtggttgaatttccttcatcccatatttaatgttccaaggcagagctgctattgttttattttgccaaaaaaaggtaatatatagcaaacaaacaacatgatccccatttagtatcaccaccatttcagaaaccataggtaacttgcacctcaaaactaaaggttagagataatcccaaagtaaaggacagccttccttgcgacggataattggccacctcaggacattcttgctggggaccatgggcacaggcaccagtccatgaaccagtacgtgggattcaagctttcttctcttgcctgctcccgtgggtacactctttccatgagtgcaacttttagaacataaacagggggctatggtctcaagttaactgccttcatgtctggggtaaagagccacatgctgccacctttaactctgtttcattccctggaacctcatgtggccgagaggtcagcattaagttaggataagctcccgggatccccaagcctgtctccaggaaatactttagaccctctcacctcattcccacttcatccctttggatccaactactgataagacttcgtgcccctgatctcctgtttcctgcaggagctgggggcagggcccacctttcccagccctttgggtttgacccatggaggagctttgggagtaaacgtccggcggatgagccacagttggtggagcgggcactgttggagctctacccagctgccctcggatcctcttagcatttctgtttgcccaggttccaggtgttttcatctgacagcttccatgtgagatttttcttcagaggattgcccttgggctcctggagccactggctgcacagcacaaggacctggaagtgcctgcagtttacttccccgccgggtggcccttggccatagatgggcagatacacaagagcatgagtccagctcctttgcctccaggcacaaaccgagctgtaatttacattcctcggctcccagtgggatcagattgaggctgggacgctatctgctagtgcactcttgcttggctttttctctttcctatcttcttcccccactcctgccagtttctcctaggagcacttcataaatcacttgcccaggaatcgttgtctttggtttgctgctaagccagtccccctgtcctggggatcagcaggctatggcaaaagtaatgcccagaggaaaagcaggctgtgagtgtgcagcacttttgctagctcatgcttgggagggcctggaccagcatccttgcatgccctaaatcaacaatgctccagacttgcaggtggtctgattttcaataggaaagtataacctattttttattttttacatttaaaaattatttttaaacttacttggagatagtaagagtcactttttttttttttttgagacaggatcttgctctgttgtccaggctggagtgcaatggcgtgatcacagctcactgcagccttaagcaatgcttccaccttagcctcctgagtagctggagtaccgatgcacaccaccatgcccgactaatttatttttttgtagcgaagcagtctcattattttgcccagggtggtctcgaactcctgggctctagagatcccaatcctcccacctcagcctcccaaaatgttgggattaaaggcaagagccacttcatgcagcggagagtcactctttttggtgtgtagttctaggagtcttgaaaaatgcatagaatcagaaaccacaatcacaatcaagatatagaagcagattctgtcatgtggccagggccctctgtaaccaaaccttcccttcaccctgatcccctggcaaccactgatctgttcttcatcaccatagttgtgccttttccagaatgccatataaatgaaatcacacagtagctttggcttcttttaggtaacacgatacctttgagattcatccacatttttgcacgtatccattgctggtccttgtggacgttttcagtaatcaaaatggagtcacttatgttgaccccgaacaaaatggagcccatgggccttgaaggaagggctctcgtgcacatatgcctatgactggaatgattgtaaggactctctgaaaaccacaacaatttcaaaaatttcagataagcctcttgcacaagaacacttgactaacaatggctgccttcaccaatgagtggatgccaactattgcaggaggcccctgtaaccaatggtccttgtttcaaagcagcttttgtgaacttttccttttgtctataaaaggaaactcctttggatatgcctgtggttcaccagagcatgcatatcgctcctgctattcccaaataaactctttgttttaagtaacacaatatatttgaagtttatccaagtttttgtatgtatcaattgcttgtcctggagggcaactgttctggagagcaggtctctctcctgtttacttaaggtagacatccttttttttattgctgaatagggttacattgtatagctcgactacagtttaaccattcctcaatggggaaacatttggggtttccagtttttcatgattataattaaagctgatatgaacattttcatatgttttttggttcaacataggcttttgtttcacttgagtaaatgccaaagagatttctgggtagtttgttaagtgtatatttatctttgtaaggaactgccaagtgttttccggagaagttgaactatttggccttcccaccagcaatgtgtgagagttcttattgcttgacatcctcaccagtgctgtacagtcagggtttgtttgcttgtttgtttgggtctttttttggagggactggttcttaatttctttctttcttttttttttttttttttttttttgagacagggtcttgctctatcgcccaggctggagggcaatggtgcaatctcggctcactgtaacctccgcctcccaggtttaagcaattctcctgcctcagcctcctgagtagctgggattacaggtatgtgccaccatgcctggccaatttctttgcattttgtttagtagagatggggtttcaccatgttggccaggctggtctcaaactcctggccccaagtgatccacttgctttggcctcccaaagtgcagagattataggcatgagcgatcatgcgtggcctggttctttatttcaaaaagacactcatcagtcttcagtatcaaaacagttgcactattgatttctttttctcccagttgtcgtcaaagaggcatcaaaggagagtacattgtaagccaataagctgcagtttgtacgcctaacagacctcctagaaactttaccaaaaagtggggattaggtagggaaagaaactttaaaagatcagcaacctgccagcctacagactgtggagagctctcacagccagagggggtagccagggtgccagaaacccaaagaagcaaagtttcaaaataatatgacatttaaaaagttttgtacacaagctattcaagatttctcactgactgatacaaagcacaatgacatggcacttttagagacagcagcttcaaacccagaaaagggtgatgagatgagtttcatgtggctaaatcagtggcaaaaacataatcttctttctttcaaggaggcaggagagcaatcaagtggtcacctcaatgtaaggggcacatgatccactctgtaagcggctgggaatggggtggagatgggacagaaatttggtctcagaggtctcaccgtcttaatttggtcacttcttttttttttttttttttgtcccagatggagtcttgctgtgtcgcccaggctgaagtgcagtggcgcgatcttggctcactgcaacctccgcctcccaggttcaagtgattctcctgcctcagcctcctgaatagctgggactgcagacgcccaccaccatgcctggctaatttttgtatttttagtagagacagggtttcaccatgttggccaggctggtcttgaactcctgacctcaagtgatccgcctgcctcagcctcccaaagtgctgggattacaggcgtgagccactgcgcctggcttaatttggtcacttctaatgaaaaaacaaaaaagtaaaaataactttgtccaaagatatcttaaagctgaaaacctgaacagcacattttttgttgctgttgtttttgggctaactcctggaatcacctttctggtttggctggtactttgtgcaaagctatgatttcccagagtggagtctttccccgggctctgtttggttctcagtaaggcaggctcatacctttttcccttttttctagagaaagcaatatacagtaagctaaacagtcaccttccaaaagggagaaagggattagattgctgcttcagagctgtggaactatttggaatgttttacaaatggttgctataaaacaacaaaaaaggtaattactaaatgtatacaacacaacatgcttttaaagacattatgtgttgcactcacattcgcttaaatgttgttcccaaaggtgctcagcctctagcgcagctggaatctctgggaagaggcagagacagtttggcaaaaaagacacgtgggggaggtaggggtggtgaaaggagaaagcagccttccagttaaagatcaaccctcagttaaagggcagctttgggcaggctggcctagttggagttggggtcagagggaggagcagtggcaaggtgggactggggtgctctgcatctcattcagttaagcaggtctggtctggcatcctttgtgtacagaggtgctcctccttggtgcatttcagtttatcttccaagtcatcaattgtctcttccagcttggctaccgatctctcggcaaactcagcccgggtctctgcctccttgcgtttatcagtaagaatctcagttgcttcctcatatctgtcttctttttgagagtccttttcttcggcagcactcagccacttcaggttctggtccatcgatctgatctgctcctccatctctcagccacaggactctgccagctcaggttgttcctctctgcgtcccaagtttccttcaacaaccaccaacttatgagccgagccccatcttcatgcttcctacctatcttctgcaatgtgcttagcttctttgagttggatttcctggagtttcatctttttttttttttttttgagacagagtctccctctgtcacccactggagtgcagtggtgcaatctcagctcactgcaacctttgccctctgggttcaagtgattctcctgcctcagcctcccgggtagctgggattacaggtgcgcaccaccatacccgactaatttttgtatttttagtagttttaccgtgttggccaggctggtcttgaactcctgacctcaggtgatccacccacttcggcctcccaaagtgctaggattacaggcatgagccatcgcgcccagccttttcttcatcttttaaggctcgattttcaataaccttcctacctctcccactctcaatcagcagcttttaccacttcttccagcttttgcagagcagtggccaggcacgcctgagcactgtccagctccttttcaaccagctggatcctatggttcaaggaggccaccttggcctcagcctgttccgggcccaccttgctccctctactccccgctggaggcgcttagctctctcctctgcatcatctgcctgctgctgctgaacctggctcttgcgctttactgccttgatggtggcgatcccagccacggtgcccacccagcccctgcttgtgctccaggtcctgcctctccactcagcactgcagccgtttctcctactgtcagtttcccccccccccacattccaataggtagcctcagttttaaaaaatcaggtcagttgggtcatgccatttctttgcttccactttccaatggctcatatcatgcttagaataaaacccgaatccttatgtggcccatagggttggccagctcctgacagtccccctggcctcttctactctcccactccagctatcctggtatccgtgctgttgctcagacatgcccagatgccccaccttgaagccagtgaccttgcggcttccttatcttgaatgcttattcctcaggttttcccatgggccacctccagaaaaggtggcatctcaaagctatctctgcggaagggtctttgctccccatcctgtggcctggttttattttcttcacatctttcatcaacatgtgaaattatcttagctatttattatttttaaaatgtattggatctcattaaaatgcgtgctttaattgaagtataatattaagtgtatagctcaatgactttttttttttttgagaaagagagttttgattctgttgcccaggctgagatgcaatagtgcaatctcggctcactgcaacctctgcctcccaggatcaagtgatcatcctgcctcagcctccgaagtagctggaattacaagcatgtgccaccacgcccggctaattttttgtatttagtagagatggggtttcaccatgttgtcagtctggtttcgaactcctgacatcaggtgatccacctgccttggcctcccaaagtgctaggattacaggcgtgagccaccgcacctggcctctatgactttttacacatgtgtgcttgtaaccgttccccatatctggacatagaaggttcccagacaccccagaaagctccctcatgtctcttcttctcaaaggtagccactattctaatttctatttggtttctgtcatagatgagttttgcctgcctttgagcttcatgtaagtggaatcgtgtaatttggacactttttgcctaaattctttcattcatcattgtctgtgagatacagccacatttttgcatgtggataaatgcaacagcagtttgttctttttatattgctgttgcatggagtactgcatagcaataccccattgcacagcagtgttccattgtgtcagtataacacaattcatttattcattcttctgctggccgaccatgggttgcttctgactggttgctgttgaataacaccgctgtgaacatttttacacgtctttccatggagagatgcactcatttattttggatatatgcctgagagtagaattgctagatcatcgagtaggcatatgtttatcagctatttattcttttacttgtttatatttttttctcttcctggactgtaagttccatgaaggtaggaaacaaacttgtcttgttcactattgtattcccagtgtgtagcacagtgcccagcacatagtagctgcttaataaatatttgttaagtaaatgaacaaacttaagctactatcagctccaagtaagttatgacaaagaacccaggactagctacaaatcctcctgacattcgcccttcgcaagctgatatttgagagcccagctgactcagaaggaggcagagctgcaggtgctgggttattcagcatcctgttattctttgaagtggctccccctccctctcttggcctgcattgtcacagcttgaaatattcttttgattatgagaacatttcccattaagtgtgcatctccagcttccccccaccccccagtatttatgagctcataactccagaatctgtcacaatcagtgctgcaaaagtgtatctgaatgtaatgaaataatttgatgagaaacgtggcggggagacagttggaattttctcctgccttacaaaccatccccaggggacaggtgtatataaatcaacacctcccttaattaagtaaaacattttagggaaaaaaacaaattaattaccacttcatggcaccaccccagccgattacccaaatggttcacattccataaacctcacttgaattcagaactaattatcactcttttggttggtttatgcttcccaatctacaaagatctgtattaaaagtgggtagtgtggtatggctttttcactttactttcaggatgatgtaagctgtcaaaagaatcaagaattaagtcttaaaaaaaaaaaagagctgaaaatgcagggaacgtagaatgtggaacattcagggtaggaaataaacatcaccttggggtgttgctgggatggtggggagaagcctatagagtgcaggatgtgtggggtcttgtcctggctgagtccctgacttgctgtgaaatgttgggcatgaactggacgtctctggtctcttatctggggaccattgtccattacctgcctggcccccagggggagcccttgcctcctgccatgtggtcccaacagggagtgagaatcctgacatctctgagcctccattgtccagcctggcctgatgtctttcctaattatccttcctgctggctctggcctcccccttgccctgtgggcccgatcagttctcatctttgatcctgcagggccccgtggccagggtagctgctaatagcttctcctattcccagtccgttcagctgccttctgagtggttcactcccccagtggagcaggctgcgcaggcctggccttggctcttttggactatgtgtgggagtgggagtctcaatggcatcaagcacagttggccttggtagccccctccagctgtaagccttgtaagtccagagtccagtgctggctaagccaaggcctaaccttcccttgtttctgccacttgccccacttgagtgggtgtgtacattgtaagcgctcagtcagttctcagtcactatctgaatgttaacgaaagacatggataaccagaaagaaacaatccaactctttaaaacatttttaaggcatgaattgcacatagtacagtgcataagttatacatgtacaactcagtgaatctttactttgtgtacacctgtgtaattccaacccaggtcaagacacaggtcattccacctccctaaaagtttcccttccagtcaacgctcctcaaaaataaccattatcctgacttctatcaccatagattggttttgtctgttcttgcatttcatataaatggaatcatctggtatctagctttctgtgtctggcttgttttgcccattcactgagtctatgagattcattcttattgcggatagcagtaattattgaactcttttttagactgaagttttaaaaagtgattacttgagcgattactgattgttggtatctagcttgacagtatgttgtccttttaaaaaataaccacataccaagatatttgtgggcctaatactgtcattaccatatgtacaaaaagaataatttagctcctgtgagcactcgagtacattcaaattccaaatggagcagggatgaatttgattaggaaggtgtctgactacagcccttccctcttgagaaccttccagggcgttttcttattgcattaactcccatttgctgagtgctgtggtttgaatatttgtcccctgcaaaactcatgttgaaatttaatcaccaatgtggcaatattgagaggtagggcctttaagaggtgattgggtcatgagggctctgcccttatgaatggattaatctattcatggattcataggttagtggattactggattatcatgggagtaaaactggtggctttataagaagaggaagagagggatgagcgtggtggcttgcatctgtaatcccagcactttgagaggccgaggatagaggattgcttgagcccaggagtttgagaccagcctgggcagcatagtgagacttcatctctaatttttttaaaaaagaagaagaagaagaggaagaaagacttaagctagcacgctcagccccctcaccatgtgtgatgccctacactgccttgggacactgaagagagtctccaccagccagaagcttctcagtagatgcaagcccttaaccttgggctactcagcttccacacttgtaagaagtcaatcccttttctttgcaaattactctgtttcaagtactctgtgataagcaagagaaaacgaactaagacattgggttgctagagaggtttagtatcttttcttagggtcatttattacctgtgtaacaggtaggtcctgctgggaccctttctgaggactccagggagggcatgaggaagttggagcctgctccctccaggtcatgtgtgagagggtgggaataatctgggtacaccctgcaggttgtctccaaaagggtcagtcacccccaaacccagggaacatcagtgctggggcaggtgggggaagaatcagggtccactgtctcttgggctagacccaggcaatgtctgtccccatggaaccctcagccctaatccctgccttcagccctgagagcttgttagcaagaggctctgatccagcaggtctggggtggatccaggaatctgatattttaaagctccccaagtgattccagggagtggtctggagccagactgcttgcatttgaattccagctctgcctgttatcactgtgacctcagccaagtaactttgcttctcttgccttcatttcctcattcgtacaatggggattataatcgtgctggaagaataaaatgaatcaatgcatttatgcttgaaaagcacttagaagagttcctggcacagagtaagcactcaaaaagagttggccaccaccgccatcatcatcatcatcaccatccacggcagcaccaatgctttaccaacgctttcactttacacactgaaactgagaaccacagaggggtgtggacatatccagagtcacacagcaagacacaggtggtacagggaccagaagcccagctccctttccccttgggattgtgttctctcacccacgtggctggctagccatcctgcccaatgtcccagtcacatgctgggggacagggtggggaagatagtctacagagtggggactttctgaaggattatattaggttggtgcaaaagtaatcacagtttttgtttttgccattacttttaatggcaaaaactgtgattacttttgcaccaacctaatagaactggaagtgttggcatttgcctttcgcccaccatagcaattctctatcctcctcctcacccttgaagggaccagccaggccctctttcccacttttggagtaagaggacgggaatgacttgagtcacctctagatttctaaagttaggacaaatatcatatcgccaatgatcaaataccaccaattctacctccacaatgtcttttgtatccaagacctctgccatacctgaggcctggccgccatcatcgcatgcacctgggcggctgcaccagcccctccctggcctccctgctgccaatctggctgcttcaattcactctacataccaccctcctcaccaccccttggagggattgtttaaacccccaccccccctgctatgtatgagtggataaaaatgtgatatctacatacaatggaacattattcagccttttattttattttattttattttattttattttattttatttgaggcagggtcttactctgacacccaggctggagtgcagtggcatgatcccagctcattatagcctcaacctcctgggctgaggtggtcctcccacctcagcctcccgagtagctgggactacaggcatgcaccaccaagcccaactaattttttttttgtatttttttgtagagacagggttttaccatattgcttaggctggtctcgaactcctgggctcaagaaatcctcctaaagtgctggaattataggcatgagccctcacacctggcctccttttttttttttttttttagtcagggtctcactctggcacccagactggtgtatagtggtgcaatcatagctcactgcagcctcgacctcctgggttcaaatgatccccccacctcagcctcccaagtagctggcaccacaggtatgcaccaccacacccagctaattttttacttttttgtagagatgggggtctcactatgttgcctaggcttgtctcaagctcgagacctcaaatgatccttctgcctcagcttcccaaagtgctaggattataggtgtgagctcatgcctgactattcagcctgtaaaaagaaagaaatcctgtcttatgccacaagatggatgaaccttgaggatatcacgctaagtgaataagccagccacctacatgagggacctaaagtagtcgaactcctagaaacagaaaacagaatggtggctgcccaggacaggggaaacgggaagttgttcaagggggagagagttttagtttcgcaagatgaaaaagttgtagagatctgttgcgcaaaaaggtaaatacacttaatgctactgaaccatacactaaaaaatggttaagatggtaaattttatatgtttttttcttttctattttttttttttttttgcatttttagcagaggtgaggtttcaccatgttggtcaggctgtcttgaactcctgacctcaggtgatccacctgccttggcctcccaaagttctgcgattacagatgtaagccaccatgcccagcctgtttttttttttttgttgttgttgttgtttgtttgtttgttttttgagacagagtctggctctgtcaccctggctggagtgcagtcacaggatcttggctcactgcaacctccacctcccaggtgcaagcgattctcatgcctcagcctacccagtagctggtattacaggcgtgcaccaccacgcccggctaattttttatatttttggtatagatggggttttgccatgttggccagactggtctcaaactcctgacctcaggtgatccgcccgcctcagcctcccaaagttctgggattacaggtgtgagccactgtgcccggcctgttatatgttttttaccacaattaaaaaaaaaaaaaaacacctccaagtctccccatcacctttagggcgaacccagatcccttgcctagctttggagaccttctgcactgttgccaccctcccaccaggcacttcaagctaccatgtcctcagcccacagagctcttcagcttttccccgacacggctcacatttgctcaccagtgagtttctccctgacagctttccatctggaatgttcttccctcagcttgtcaaccttttgaaatcctcattatccttcaagaaccagctcaaatatatcctcctctgtgaaaccttcttttaaccctctccttcaggaagaattaatgcccagagtgtgtgcccctgctttttttttctttttgagacagggtctcactctgttgcccaggctggagggcagtggtgtgatcacggctcactgcagcctcaatctccagggctcaagtgattctcccacctcagcttccccagaagctgggactacaggagtgcaccatcatgctcggcacatttttgtaaattttttggtatagatggggctttgccatggtgtccaggctggtctcaaactcctgggctcaagagatctgtccacctctgtctcccaaagtgctgggattatatgtatgagccattgtgtctggccccccgtaccttttttttttttgagacggagtctcgctctgtctccaggctgcagtgcagtggcgatcttggctcactgcaccctctgactcccgagttcaagcgattctcctgcctcagccccgcaagtagctgggactataggcgcgcagcaccacacccagctaatttttgtatttttagtagagacagggtttcaccatgttggccatgatggtctcgatctcttgacctcatgatctagccaccacggccttccaaagtgctggtattataggcgtgagccactgcgcccagcccctataactgttcacatcaccaccaccaccaccaccactgcctcagctaccattgaatgggggctttctacacactgagtaccaggccaaacaagctgtatgcatcagtggctcagttaatcttcatgaaaacccacaccgtcctcattttacagacgagaaaactgagactcagatagggaatgtatcatgcccaagatcacacagctagtaagttgtggcactgagacttaaatcttcctaattccagagaaaagcatctgacaactcagttctgctcccccacacacctgagtaattgccttgtccgtataattatttgtttttctgcctgcccaattaggggagggctgtgccttaacccttctggctctgatgccccatgcctggcccagggcctggcacaaagcagatgctcattttgtgggagttgttttggacaccttggagtaaatcagtgccagtgctagctcctctaatttcaccacttctattaaccctccaggaattggcaggttggtgatcacaaaagaaacattccccagccgatcaataaataataatgttggagaatttaaaataagaatctggattattaaagttacaaatctttggtctttatacctttaataaaacatgcgtctattaataatgaatactggttctggcctgcttaggctgaaagggagaaaaaatgaccagtgaaaagatgctaatattttttctccttacttgttttggctgccaagatgctgcatccctgacaaatggctcatcatttaaaaaggtttaaaaagtttaactgcacgaaagggaaattgaagatgggttgttcagccttgtgggccctcagtgaggagagattgtttcttcttgagacattctctctctggttttggtgggcccaccttctgctggtccttctccttgacctctggttgtctttctcaggctcctcattttttggtcaaactctatcctgggttccctccccttccctccctttctctcccttcccctccccttccctttccacttaactcccttaccctgagtgacctcatccacttctgtgaccaccagtcatcatcttttgcacgaaggaagtcactcagtaggagagatgatcagagcggtaaacagggggtcagaccatttggggccttataggccagggtgaactttggctttaactccaagaatcctggtgccactggaggcacagaggatggcatgaaacaaatctctttggaggctgtcattaaaatagactaaagggtgacaagggcagaattaggaaaaccagttaggagaatattgccgtaatccaggcaagaggtgatggtagtttggaatagagtggaagcagtgaggagctgaggttggatacaggatatattttatttttttaaattttaatagagacagaatctcactctgtcactcaggctggagtgcagtggcacgatcctggctcactgcagccttgaactcctgggctcaagtgatcctcccacctcagcctccccagtagttgggactacaagtatgtgccaccgtccccagctccaggatatattttaaaggtagaggtgataggatttgctgagggattggagtggggtgtgaaaaaaaaaagggagagggttgtctccagggtttttggtctgagcaactaaaagatgagtgttttcattttctgagatgaggaggcctgtgggtagagaagctttgatgataaggagttgagtcttggatgtgtgttgtctgagatacctgttggatatctaagaagagacatcagattgacaattggacatatgggtctagagttcaggagaaaggtccaggttagaggtataaatttaggcatcatgatcatagatgtggtatttaaagtcatgaagctagatgagattgccagtggaggtgtatggcagagtgtgaaaaaggactggactcatgactttcctatgttttaaggttggagagatgaggaagaatcaacaaagaagaatgtgaagaggccagtgagctaggagtaaaactaagaaagtaaaggatcctagaagtcaaacgaagaaagagtttcaagagggggaatgtcattatgtatgtcaagtacggaaaatgggttaaataaggtaaggactgaggactgaccattggatctagcaacatggaggtcattggtgatcttgatgagggcatttaacctcactttgggccacttgatggtgaaggtaaaaaggaaagccagtagattccataactctcattattgtccagaaggaaatctaccagttgttcaagacaccccaacttgtcctgggagcttgtcatttgagttcttcaaaggaggcattgaataatacagctgactcttgcacaacacaggtttgaactgcatgggccctcttatatgtggattttttttctaccaaatgcagattgaaaatacaatattcacaggatgccaagtatgcatatatgcagggctgacttttcctatgcgggttcctcagggttgacttcaggacatgagtttgtgtggattttggtgtgcgcaagggagggaaagtatcctggaaccaatttcccacatctactgagggatgactgcataatgaatattgtcagcaagagttttatagcagagccataggtcaacgttttactcccaggatataagcggtgctgtgggaagcatggagtgggagagattgtcatgttgagtatttatcactccactgatgcatggagtgttccatccagtttgagactgggctctgcctcctggagaagcgacagcagccaggtgccactctcatggagaccaagagttagtggcctatgtggagggccacaaggccgccctgttacacaactccaggcaacacatctacatcatggtctatgtgaaatgagcttcctggtgttgtgcagtgcacaaactgcgctgctgtacgaaacaggcctgatgtgacaagaggcagctaagggtatccccagaactcccagagggatactgggacactgttgtctgaagaagggaaagtaagtgatggaaggcaaaacaaaagatgctcacatcctaacacgaaggacaaattccagatggaaataaggcacatgctctctttattctttaatcccccaaacttcaaaaggaattttattgttttcttcctgccatcaaatctgtgacttgttttaggggaaggacaaggtacgtgtgtgtgtgcgcgtgcatgtgtgatggggtgcggggttatatagcctctacccttctctcctttctctccaaaattcctaactgggaggatttttctagtcattggaggaaaggtgtttgggaatatattaattagagcaagcctaagccgctgtaataaagaggtcacaaaatacagtggcttgaagaaaagagaagtttatccctctcatgtaacagcctcaaggttaagtagtgcagggtggggagatggctctgttccacatgatcactcaggtatcaaagatcctttcatcttgtttctctgtatccttcatggtgttatcttcatccccattgtcagaacttggtcaccgcacatctatgttcagggaaggagaaagaatgttaggaaaaaggtgccccatcccttctgttcatatgccattggtgacaacttaaccatgtggccacactggccacaaagaagcctgggatgtgttgttgctagctggggaatcagcatttgttcagtttaagctctattactgtggaaaaaacttagaatgggttaaagtaagtaactggcaaaaactggttctttttgctctcatctcttttctaagcatttttatctctcaaatttagaaatggaaaatttgggccaggtgcagtgattcacgcctgtaatcctagcactttggaaggccgaggcaggaggattgcttgaggccaggagtttgagaccagcctgggcaacaaagtgagaccccatctctccaaaataaccttaaaaaattagccaggcttggtggcacatacctgtggtcccaactattcagaaggctgaggcgagagaatcacttgagcacaggagtttgaggtcgtagtgagctatcattgcaccactgtactccagcctggatgacagagtgggaacctgtctctaagaagaaaagaaaggaaagaaagagacagcgagaaagcaaggaaggaaggaaggaagggagggagggagggaaagggaaagggaaaggaaaggaaaaaggaaagaaagatactgaaaatttgaagattctttccgtgggtccctttctgaccatttgacctaggtacatgtgccagccctgtgtatccattccagtcataatgtggagggtcctggggttaaaaggtatatgaaaaagagtcttatcagtcaagctcgcatgtcaacccacaataatgaccgtaacaatgaataacaacaattataattattaacatgtttagtttacacatagatgtatcacttataatgctctgtaatttatttttagtaatatgtacatgacttttccataagtcaaaagtcttgaaggactgactttctagggagaagaagtgactcactttgcctggagagctgggaaagaggagccactgagatgggctttgagaggatgactaggaatccccagagagaaaaaagagagcaaatggaattttacgaatgagaaatgttaatagcatgtatgaactctagcatgtactttcagtaaaacaaaatttttctttttttctgtttttatgactttgtttctcttcctctctctctctctcttacacccattaatggacacaccatgtaactgttagatttcttgtttgcaagtgacagaaaactcacctcaaaaatatcttaaatcaacaaagggaatttattggctcatgcaattgcaaagttcaagggtaaatttaagatgtggctaaactcagaggcccagacaatagtaccatgacctggtctttctccaccatctggctcggccttgctgcatgccagatgagcattcacacccacatggtgccaggatggctgccagctacgtggggtctaagtcgtcttcatctcaatggaaatgaatggagagcctctctctccattgtgccccattggctctgattaggtcaggtgatcatccttgcgatgctctcacgggctacaactgagacacgtgccacaactgagacacgtgccaacccctaccagcaggggtagagtcaactctgtctaaagctagggattgagaactgggagagagtgatctgctgaaggaagaatttgttactgaagaagggtgaggccaagtgcatggctcatgcctgtaatctcagtactttgggaggctgagcagaaggatcacttgaggccaggaattcaagaccaggctgggcaacaaagggagaccctgtctctacaaaaaaattaaaaattagctgggcatagtggtgtgtgcctgtagtcccagctactagggaggctgaggtgggaggattgcttgagcccaggaggttgaggctgcagtgagctgattgtgccactacactccagcctggcaacagagcaagatcctatctcaaaaaaagtaaaaaaaaaaggccgggcacggtggctcacacctgtaatcccagcactttgagaggccgaggcgggtggatcacctgaggtcaggagttcaagacctgcctgaccaacatggtgaaaccccatctctactaaaaatacaaaaattagctgggcatggtggcaggcgcctgtaatcccagttactcgggaggctgaggcagaagaatcacttgaacctgggacgcggaggttgcagtaagctgagatcgtgccactgcactccagcctgggcgacagagcaagacttcgtctcaaaaaaaaaaaaaaaaaaaagtaaaaagaagaaaggtgaatggccctttggccacaaaagccgtttccatcttccatggagtgggatgctgaggatctcactgagatactggattcctacctattgtggggaaacttcagtcttaaagactgaatggccctcagagcagaggaacctgcaggtgaattgagctctgaagcacaacaaagtggaaggctgggaaatgcggctggtccagggcttagcagtcatccagcctttccactggacagatgaggaaacagatcatagagggtgagggacttgtctgagcaagttgaggcagagcggggacccaaaccccagtgatgtgaaagccagagccaggctctgtctgtgggtctggcagctgccacatttattagctccctgatatctccttgtttccttgtatatttttacaaggttgttaattaccagccataaagctcggcaaacattctgataggctttaaaggctcatgaaaacagcattacattttaaggcatggtttccttattaatctaattaactgtcagcctcacatcctgctggtttccagatgaagcgagctgtgcctttcagcttccgattcagccccagtggacaaggcttggggatgtcatcgccacaatctctgagccaggaaagcagctcacacaggcccaaggtgtgggttgctgaagcagtgtctagatgctcagcatcgtgcagatttatatctcaggatgatccatctctagaacaaagacatgatggcttggaaatagcccagattacagcaagtacatggatgcctcagctcaggaccctcccaggccatggtgtagacacttttgggtgaccttccccagtgaggctccctttccagagctctgtcctcatttataaccctgaccctggcaccctgctctcccacagcagctgtttggactgagatggacacctgacccaaagaaggctcagtcacctctgacctgtagcctggcttgaaagaggggctgggccaaccagaggcaggtctggagatagagaactagaactgggaaagagtgtcttcatttatgagggccgccgtcacaacataccacagactgggtggcttaaacaatagaaatggatttctcacggttctggacactagaagtgtgagatcacagtgccagcaaggttggcttctctctccctttctctctctctctcttttttttttttttaggtagggtcttgctctgtcacccctcaaccttgtcgggctcaagcgatcctcccacttcagcttcctaagtagctggggctgcaggcattgccaccatgcccagctaatgtttttcttttttttatttttctttttttgagactgagtctcgctctgtcgtccaggctagagtgcagtagaactatctcggctcagtacaacctccacctcctgggttcaagcgattctccttcttcagcctcctgagtagctgggattacaagcacccaccaccatgcccggctagtttttttttttttttttttttttgtatttttagtagagacgggggtttcaccatattcaccaggctggtctggaactcctgacctcaagtgatccgcccgccttggcctcccaaaatgctggaattacaggcatgagccactgcgcccagcgccagctaatttttttatttttgtagagacagaggtctccctgttttgcccgggctggtctcaaactgctgggctcaagtgatcctctcgcctcggcctcccaaaatgctgggataacaggcgtgagccactgtgcccagggctggcctctcttggggcctccctccttggcttgcaaatggccacgttctcactgcgtcctcatggggtctttcctctgggtgcacatccctggtgtctctcttgtgtgtccaaattttctcttctcccaaggagagtaagctctgattatggctgaccctaatggcctcattttactcaatcccctctttttaaaaaaatttttttttaaatttgagacggagtttcactctcgttgcccaggctggagtgcagtggtgcgatctcagctcactgactgcaacctccgcctcccaggttcaagcgattctcctgcctctgcttcctgagtggctgggattacaggtgcacgccaccatgcctggctaatacaatcccctctttaaaggttctatctttagatagaagacaatatttaaaatattgtcttcagatacggaggtactggggattaaggcttcaatatatgaattttaggggacacaattcagcccataacaaagggcttgagatgaaaattcacacagcatctgggctggggcaagggagccaccatggctggtgccctgcctatgtctgcaagaccctcagctctaccccctgaaggtataatcgcaaacacctgccacctcccacctgagggcttttatctggctgctttctgctgagggcacgtccacctgcatgcagggaaagcctactagagggttaatggccagaagcagccctccaccaatgactgatgggatacagacccagctcccttgcctggggtggggcaactctgcttccatgatctacactgtctccagcatccccgggcaggaatgggctcccattgcccacggggtaactggcttgatcatgtgcctttcttttctctgtctcactttgccactcccctactggtacttcctgggatcacctcccaagtaaatgacttgcccttgaacctctgtctcaaggtcagcttctgggggaacccaaacagttaggtggcatgtggacatgatgtggagatacgggcagaggaagctggcgtgggaggggagagagggaaacgtggattccaagagagggaaagggtttctgggttcctgagtctctagttctggtacctatgagcactgccctgtgcctctcccccgtggctctccaagtagttacataagtggggtgttaggtgttctggaacctaagctagtttagcctcttccctatctagatgcagcaaattctcttggactcttccagattcttccctcaaatatggaattatcaggcaagttgatgcctcttgctctgggggaaaggtagccccaagacattctgtggctatgtaaatatgccccccaaaataaatccatggtttgtagagtgaaagttgagcaaatctgcatacaggccaggagctacccagaaggtcaggaatcgaggccacatgcccttttcttttgaggtaaaacatgatcacaacctttctggttaattgtgatgagcctgactgaggcccctggaggaaaaaaagatgtaaagacccacagggaaaagaaccgtacctgtgggagtctgcactaatgactagtgttaaataccaacttcttccgtagctgcttctggttatgacttcaagtatgttttctcattctcagcataattgaaaggcgtcaaatgattaacaccagaggttaagatctagaacaattttgtccaacctgtgggctgcaagcaccccagggcagctttgaatgtggcccaactttcttaagatgttatgagactttttttgtgatgtataaattatataagctcttcagctaccgttagtgtattttacatgtggcccaagactattcttcttccaatgtggcccagggaagccaaaagattgggcacccctgatctagaagttaggagtctttcaggaagctaagaataacttacagacacctgattctataactctatgaaacgtcttagattctttggtcttaaaatagtattggcccaggcgcggtggctcatgcctgtaatcccagcactttgggagggtgaggcaggtagatcacctgaggtgaggagtttgagagcagcctgaccaacatggcgaaaccccgtctctagtaaaaatacaaaaactagccaggcttgggggcaggtgcctgtaatcccagttactcgggaggctgaggcacgagaatcacttgaacccgggaggcagaggttacaatgagctgagatcgtgccactgcactccagcctgggtgacagagcaagactgcctcaaaaaaaaaaaaaaaaaaaaaaaaaaaaaagtggagtacgatcataatctgtgtaggcaggagagaggaagcaatggagccagcagggtctcgagtcagagaggagtgggagtggttgggttggctggcttcaagactagaggggttcttaataatatagggtgctatagtcacaagtgggggtgcatcccaggtgttagcagggtccaacccttgggtctaggggtagcatgatatttatgacaataatgatggtgaacatgataatgggcatgaccactcctgtttacaggtgagaaaactttacccctctcagcaggactgtcaggtccaaggagtaaaattggaccctaaaaaataggattcaacagtcctatttgggtcagggtgaactctttggcaccaaggctctggacactttgagggtgaagccaggtggggtggggctggttctggggaagggctggttctggggaagggctggttctggggaagggctggttctggggaagggctggttctggtggcctgagatgcagcaggactgaacaggactgtccttccagtaacctccatccttcctcatcgagcatgtcccaaccccaaacctgtttggcacttgcctgatggatttaaattgatgccctcaaaactgcaaaactagggccagttctcccccctttctgtccacgcaccttcaagaatttaatgagcttgtctaggttaaaatgtgttattcaagcccaatgtttgtggtatcactgaggaagcaaatcccaaactaatagaagttgcatgtaatgtaaaatagcaattaatctccatcatgaagggtaagaaaaattaacaaaccgctgttcaaatatttattaggaggagagactggacagatattcttagtctattactgggggcaattgaaatacaaggaaactgggctgggcgcggtggctcacgcctatagtcctagcactttgggaggccgaggcgggtggattacctgaggttgggagtttaacaccagcctgaccaacatggagaaaccccatctctactaaaaattcaaaatcagctgggtgtggtggtgcatgcctataatcccagctactttgggaggctgaggcaggagaatcgcttgaactcgggaggcagaggttatggtgagccgagatcctgccattgcacccaagcctggacaacaagagcaaaactctgtctcaaaaaaaaaaaaaaaaaccaaggaaactgtctggtccgtaactgggcatggggatggggtgggcttagaaatgattccagtaggtgaggggttcagtgccagcccaggtgggtggggaggggtgagacctgtggtctctttgacatattagagtggtgggcaacttctggatgcttcttctcacctcttcttgctgaaatcaggttatggttgttcagcctgacatgatggccatcttcgacacaggcaggaggattctggcccctgctccagccagaggtttagccctgaaccccagccttgacccctcctaccgttgtcctgcctctatgttcccttcatctacctcctctttttgatggccttggcaattcttttttgtttttttttgagattggagtctcattctgtagcccaggctggagtgcagtggtgcaaccttggctcactgcaacctcggctcactgcaacctccacctcccgggttcaagtgattctcctgcatcagctagagaatcgagtagctgggattacaggcacccaccaccacgcccagctaattttttttttttttttttttttgtatttatagtagagatggggtttcaccgtgttggccaggcttgtctcaaactcctgacttcaagtgatccgcccacctcggcctcccaaagtgctaggattacagttgttagccactgcaattggcctaggcaattcttaacaactctggatttttccctacaaatgctgagccactcccacaggattaccaaccacctgtcctcctcctaccaataccccacctaagacctagataaaggtgatgataaaggctggcacctggaaaacaagggttcaggcttcctttcccagctgagggagatgcctccaaagatggccgccaacaacgcctcctgtccctggacacgcaggctcctgtcaagaggtggcactatttctcctccctagaatttgggctggccttgtgacctgctttcacttgtgccggttccatgcctggcttgtaagaggcctagcagcttctgttctcttggagccctgagccactgagaaagaaatccaactaaccttctggagacaggcccagccagggcccagccggtccaactactccttgacaaccaaggctgccacaaagacaggatagaggaaggaacacagaggcagggcaatgggaggagccatttaaggctgaggttcagggatgagcccctggatagggaaggggccagaacctttctatgtgtgtcttgaatgttccagctccagctgaatgtgggagtgatccccaaaaataccttgtggagcagaacttcccgtctgcgtctggacatcccttagaaccataagaaataactgtaatgaaggccaggcccggtggctcacacctgtaatcccagcactttgggaggctcaggtggataacctgaggtcgagaggttgagaccagccagaccaacaccgagaaacccagtctctactaaaaatacaaaattagccaggtgtggtggcgcatgcctcccagctacttgggagcctgaagcaggagaattgcttgaacctgggaggcggaggttgcggtgagctgagattgagccattgccctccagcctgggcaacaagagtgaaactctgtcccaaaaagaaaggaaggaaggaaggaagggagggagggagggtggactgtaatggttaatactgagtgtcaacttgattggattgaaggatacaaagtattgatcctgggtgtgcctgtgagggtgttaccaaaggagattaacatttgagtcagtgggctggaaaaggcagacccaccctcaatctgggtggatagcatctaatcagctgccagcatggctagaatataaagcaggcagaaaaaagtgaaaaggtgagatgggcctagcgtcccagcctacatctttctcctctgctggatgcttcctgcccttgagcatccaagttcttcagttttgggactcagactggctctctgctcctcagcttacagacggcctatcgtgggaccttgtgattatgtgagttaatacttaataaactctcctttatatatatatatatatacatatatatatcctatttgttctgaccctctagagaaccgtgactaatacaataaacatcatcattttaagccactgagatttggagtggagtagcgtattaaatagcaataggtaactgagactccagcccagctaggaccagtctggcacccccctgccattttggatgctgcaaactatacttggccaacttcaggatccccagttgacacctacatggggtctcctgctgctgaccacctgtcagggctgctctgcccaccaagcttcaagcggaagctcatgccattgttcaacaaacatggagtcgcacctgctatttaagccaatccctgtattggccgctgaggattcagagacacactcctggcctctgaggagttcacaggcccaaggggagtccggcaggaagataacatgctaaaagtcagggtgcagagtgtgaaatagtagcaggacacagtcccaggcaagttcaggaggtgggagtggcagctatgccccagtaggcttcatggggttgggtatttgagtggtcagcagggagttctccaggcaggttgattttgtgctgtcccctgtggcccttctcaatgccgttgcctgccctctgaccccctgctccccagccctgggcctctgtgcttcacccaggcaggttttgccctcactggagccaggctctacagccaatggaggattttaagcagaatgacatggtggttgatgttaggtgaggattgggaggaaccagagacctggccagagatggggagctcagtgacaaggcagttgcagtggttaaggtaagagaatcgtggtggaaaaggagcaaagatctgtgccaaggggagagcctaggattcagaggagccaggcaaccaggtcaaagtgcatggacccccaatccagtgctgattccactgtagagcgaataaaaagtaattttaaaggttaaaaatacagatgagtacgtggaggtaaatacaaggatgtcctcgggagctgtgattgtgatggtaagaagttggaaagaatctgtctatcaagaggaaaataattacataaattatggtaattcttacgatagaacattatcaaggagctaaaaggaatgaactcaggcatatgtaacaacatgagtaagtcttgcaaatacactgttgcataaagaaaagctgcataatgatatatatggtaaaaaatccacttatttactaaaatatacaaaataatattatatattttctatgggttcctataaaatgcgtgaatatatttttgaaagatctggaaggcacttgccaagttcaatatttggaaaggggccatggaccaggattgcagaaggtgggcaaagaaaacttgtgctccgttcataatttttttttaaagaatggttccattttactgacataattaaatattaattaaaaatagaaaacaatgaattaaggatttgattcataggtattgttaatcccccaaaataatcagctcagaccttcaccctctgatccctcaagggagctgaagtcctactaccagacactcattctgtgccagcgtctgggtggcgggagtgtcactgaggaaaggaggggatgagagtgtaccgaacccctgttgtttggcatgttgtttgttggcacatgacaaatcttgtgtcattgaattgtcacagctaccctaagccgtgggggtggggggggcgcgggtatgacgattcttattgtacagatgagctgcgtgcatttgggaaattcagtcaaataaatagttcaagatcacacagcatgcaagtggaaagatttgaacccaggtctgtattgtcccaaaagccataccctctcctctgtaccaaggaggaacaagaggacagacaggcatggaatcacctgggagctttcaaagcacacaggtgccagatcctgccctcagagatgccgatgtgattgacctggggtggggcctgggcttttttttttctttttttaaagctgtgactatgccctgccaggcttgaggacaactgccttaactggagtccagctcattcctctcagatcagccaccacggggtgactctttcaaccgtgcctcccattactcaagggctgtccttttggacaatgactttgtgagaagtgtttattacacttgggtgcattttaaaaaggtggctcacaaaccctgtctcagatttgagttcccattttctcactgtttttttattagagaattcgagacgggttcttcaagaaaaaaaattaccctaagaaataaccaccttatagaacgagcaggatcatgaataaaaaaaaagaaattaaaaaaataaccagtaataattttatgtattttattttactttatttatttatttgagacatagtcttgctctgttgcccaggctggagtgcagtggcacactgcaacccccgctgtagaactcggctcactgcaaaccccgcctcccaggttcaatcaattctcctgactcagcttcccaagtagctgggattacaggtgcacaccaccatgcctggctaattttcgtattttagtagagacggggtttcaccatgttggccaggctggtcttgaactcctgacctcaagtgatctgcttgcctcagcctcccaaacttctgggattacaggcgtgagctaccatgcccagcctaattttatttattttaaagtcagcgtttcctagacctcaggcatttgggagacagcttcacatttgccatgtttgtatcaccactgttaatttacttaacatttcactttaaatcaatacatagttcataaacttaaaaacttttattttaaaagataactgtgtatcatcactaaaaatgaaaagcaaaaatacttgtaataaacacataaccataaaaataaaacatggttactttgtgtcctacctaaaatttaggagctcatataccaccagtgatgtgtgtcctgtattttgggaaatagttataaatactaaattgaaaagactgaaacttttagataaaatcttaatgactcctagggcatttctcacatggattattgccagatcctcctaactgaccttcctgtttctaagctcatcacccccattccccacctattttcctcccagcagacagtggtatcttttttttttttttttttttttgagatggagttttgttcttgttgcccaggctggagtgcaatggtgcaatcttggctcactgcaacctccccacctcctgggttcaagcaattctcctgcctcagcctcccaagtcattgggattacaggcatgtgccaccacgcctagctaattttttgtgtttagtagagatgggggtttcaccatgttagtcaggctggccttgaactcctgacctcaggtgatccacccacctcggcctcccaaagtgctgggattacaggcgtgtgccaccacattgggcctggtattctttaaaaatttacatcagatgatgtcatttatccatccaaaccctccgtttgctctcatctcattcagggtaaaagatatagaacctactatagctgacaccttttctacgcaaagtgaggtccatcggccagcagtatcaatatcatctgagaactggttaggaatgcagtatccaggcatggtggcatgcacctgtagtcccagctacttgggaggctaaggcaggaggatcgccaggagttcaaggctgcagtgagctatgactgcaccactgcaccccagcctggatgacagagtgagatctatctctaaaattaaaaaaaaagaaaaaaaagcagaatctcagatcccaccccagacctgaatcagagcctgcattttaacaagatccccaggtgattcataatgcacattaaagtttcagaggcaccttagtggtctcctcacctaccacagtccttctcccactgcctcagccaccaggcttccttgctattcctctgccacaccaatcttgctcctacctcagggcttttgcacttcctgtttccctgcctagaacacttgccagagcctgggttccccagaaagcagagccagaagaaagctcatagtttgttttttgttttttcttttttttgagatggagtctcacggtgttgcccaggctggagtgcagtggcgtgatcttggctcactgcaacctctgcctcccgggttcaagcgattctcccacctcagcctcctgagtagctgggattacaggtgtgtgccaccatgcccagctaatttttgtatttttagtagagctggggtttcaccatattggccaggctggtcttgaactcctgacctcaagtgatccacctgcctcggcctcctgaagtgctgggattacaggcatgaaccactgcgccgggccagcttatgtttattacgtctgtgtttactcagggtgtaatcccaaggaaggaggaagagccaatacaagggtgcacaaccaaccaggtcaccacttggcatagagcatgactgattgctcaatctcctggaaatgtcttctgtgagagcacatgaataaagccagctcagaacaatccacccaagggaaaaaagggaaaggaattcatccacctgcttccgctcccactaggtaaatgttcactagtggggcattgatatggtttggatttgtgtccccactcaaacctcatgttgaattggaggagggacctggtgggaggtgattggattgtgggggcagatttctcccttgctgttctcatcatggttatgatgagagtgagttattgtgagatctgatggtttaaaagtgtgtgtgacgctgtgagttctgatggtttaaaagtgtgtgatgctttccccttcactgtctgtctcctgccaccatgtgaggaaggtacttgcttctccttcacccttctgccatgattgtaagtttcctgaggccttacagtcatgctttctgttaagcctgtggaattgtgagtcaattaaacctcttttcttagtaaattacgaagaaattcttgggtagttctttatagcaatgtgaaaatggactaacaccggcattaaccccctcactttcccagtggctcaggcatgggctcccagcaggtcccaggtcatctcccacctgagtgtcaatagggaatctccggagcaggaggcaaggacaggcggcccaggcatgagatcagtgagagcccacacacagctggccacagagcagcggcaactaagctggaaccagtggccaaatctgtggagccaggggaggcccggaggactgggagtgcccatgagcagtacttgctaccaagctcctccctgagatggctcttggctcgatcctcactttcctcatgagggctcaagtgctgccctcacagaacccttccctgatcatttttacattttcttgtttaattaaattttttgttttgagttggggtcttgctctatcatctaggctggagtgcagtggtgtaattacagctcacgtgcagtctccatctcaaaccatcctcccatctcaaacctctcaagtagctgggactacaggcacgcagcaccatgcctaactaaatttttgatttttagtagacaggaggtctttcaatgttgcccaggctgatctcaaactcttgagctcaagcattcctcccacctcggcctcccaaagttctgggattacaggtgtgagccaccgcgcctggccccatgatcacccttttaaacattgcagctgccttgtctgcttgagtcttctccagaccactcatcaccttctgatgaatgtgcactttactttaaaaggaatgtggtcccattgggggaagagtttttttggcctgtttgttcactgatgggtctccagtgtcttgaacagtatgtggcacctagcaggtgcttggtaaatatttactgaatagcttgaacaaagggcggaactggatggagcctttggaagtcattgagtttgccagtctttaggtttatttccaatgaaatctgacatggaagccccattttgaaacagatcaaagagagcaacagctgagccctctctgcaggtgtcctgggcatacccgctcctatgctggtgacagaaaaactgcccagagaggggatgtccctttcccacataactctacactcaaaaatcacagatataaataagcgagagtttctttttctgcttgaaaggcttacttgaaggcctaaaaagaaaacaagaatgagcacagcctaaatgaatgttccctgggctgagaattctcccagtatctgcaaaatcctttccacaacagaaaatcccaagttctctacactgaattagattcatgggaaaccagagggatcagtttactgatgctagaagaaagctttttattttattttaatttttaaattaattttttttttgagatggagtcttgctctgttgcccaggctgaagtgagcggtgtgatcttggctcactgcgatctctgcctcccagattcaagcgattctcatgcctcagcctcccgagtagctgggactacaggtgtgtgccactgtgcctggctaatttttgtattttgtacatttatttatttatttatttattgagacggagttctgctctgttgcccagcctggagtacagaggcacaatctcggctcactgcagcctccacctcccgggtttaagctattctcatgcctcagatcccgagtagctgggattacaggagcatgccaccatgcccggctaatttttgtatttttagtagagacggggtttcactatgttggccagactggtcttgaactcctcacctcaagtgatccgcccacctcggcctcccaaagtgctgggattacagatgtaagccactgcacctggcctattaatttttttttttttgagacagggtctctcactgttacccaggctggagtgcagtggcacaatcacagctcactgcagctccgacttcctgtgctcaagcgatgctcccacctcagcctcccgagtcgctggaacagcaggctcgccaccacacctggctaagttttgtatttttagcagagatggagttttgtcgtgttgcccaggctgttctcaaactcctgggttcaagcaatcctcccacatcagcctcccgaagtgctgggattacagacatgagccactgcacccggccaaaacatattattttataagcagtgtgcgcataatactgtctataggcagatattagaattcttccttgagaaagaactcctcttttgtttgggaaaatatttcaagagacctattgattatgcaaagaaatgcctggggagcgggtgagacacctgctaggggggccagtgttgctgcgctttattaaataactgggattttcagctctccctaagtacttaagtactgtctatggcatttgcctcatgtatctttgctctttttttattgttaacctttatttagcactttgttttaactgatttttgtaaatggcatgcagagggcagattggcaacaggccagggtgaaaggagtgacattcccaggtgggggacattggctacagcaatgtctaacactcagttcaagagattacttattctgtgatggcacctccttgtctttgttctcaaatcttcagtatcggttgaaactctagtagtgggttgaattgtggccccccaaaaagatatgttcacatcgaaatccacggaagctgtgactatgacttttttccggacaaaaaaaatgctttcacaggtttaattaaggatcttgagatgagatcattctggattatctgggtgagccctaaatctaatgacaagcatccttacaagcaacagaagaggccgggtgtggtggctcatggctgtaatcccagcactttgggaagctgaggcaggtggataacttgagcccaggagttctagaccagcctgggcaacatggtgagaccctgtttcttttcttttctttttttctttttttgttgagatggagtctcactctgttgcccaggctggagtgcaatggcgtgatctcagctcactacaacctctccctccctggttcaagcgattctcctgcttcagcctcccaagtagctgagattacagacaccggccaccatgcccagctaatttttgcatttttagtagagatggggtttcaccatgttgcccaggctggtctcaaactcctgacctcaggtgattcacctgcctcggcttcccaaagtgctgggattacaggagtgaaccaccgtgcctggcctaccctcattttttgaatgtttgtttttcttctaaccagcagactctttactaaggcatgagaggtgaaaggggtccaagtggaaggaagatagaatgagaattgtttcctttttcttattttaattttttgagacaaggtctgtctctatcacccaggctggagtgcagtggcatgatcacagcttgctgcaacctcacattcctacagtcaagcgattttcctcctcagccccttaagtagctaggaccacagttgtgcaccaccacaccagctaattttttatttttgtagagatgagggcttgctgtgttgcccaggctggtctcaaactcctaggcccaagtgatcctcctgcttcagccttgcaaagtgctgggattataggcaggagccaccacacctgaccgggactgacaaccccagctctgggttgggctccttaggacgtagctctttgggcttctcactttctccacactccccagcctccacctactagccctgtccagaaactgaggtcttaacaaatgcctgcagtacatagaatacacctcggtgtttcttgttatttaatatttattggaatggaatgaaatagtggatgcagggtttgtaaacagatccctggatgtacggagtagccctccatttcataaaatggattttgaatttgttggagaggactggaggagtggagtgatgatgggatgtgaccagcgggtaactgccctggccacacctcaatatgcaatgtactgtggcctcgcagatttcacatttgtctcgacccagcacctggcacttagcaggtgctcagtaaacatgtcaggctgaattgtgaatctggcatgccatgcacgctcagtactgtccttagacccaggcaagtggggacccctgccccaggcctcaggggccccatgctttggagtgccttcctcaaaggaagtctctttctggtgtctgggactgggtggagtgggcaatgctattccatcctggtaccctatgaggtattcagtcaaggtcaccagaaacacctacctcaaaaatttctaaaaacccctctgggggctgggactggcagtgccatgtgggtggagttccccgagcctgaactaggctccagaggggctccttttcctatttctcctctttgaaatggtctccaaggctgggcatggtggctcatacccgtagtctcagcactttggaggctgaggtaggaggatctcttgagtccaggagtttgagaccagtctggacaacatgacaaaaccccgtctctaccaaaaatacaaaaattagctgggtgtggtggtgcatatctgtaatcctagctactcgggaggctgaggtgggagaatcgcttgaacctgggaggcggaggttgcaatgagcagagatcgcgccactgcactccagcctgggcgacagagtgagactctgtctcaaaaaaacaaaaaagaaagaaaagaaacctcggcattgcatgcaaatatttttctatcctattagattcattatttgttttttttttttttttttttttgagagacggagtctcacttgctctgtcatccatgtatatgtgatcatgccagaatgaatgagtctctagaatgctcccaacacacacattttgggtgactcttggttcagacccagaagtagttcagagctctgggctatcaatggcctggcctaccactgacccttgagtttcactcccgtgtagggcccatgcactgggtctcagccatttgcattcagactatgatgccacctctggtctgcagcacccatggctgcagggtggcaacaggcatccttactccgtgcactctctgctgctgggcccccacccctctgtaggcttcaagccatgtgtcagacagtcctctggtgcagctgggaccattcattgttctgcagctcccatgggctctttctaccaatgccctttcttgcctctgattgatatgacaagtcctgctgttctgggttggccttaagctgtgctggattggaacaaacattcctcacgtgagtggtacagttcttgctctattcatgagcccctcacctatgctccctactggtagtggtatgtgggaggcagcgggtgaggtcagcattgaaatagatcacgtttcaggaatgcagtgattgtggcacaaagagttgaagagaagagatggttgggaaaagcgctgttctacattacatagtgtgttcgtccttttatgttatggtatacctgaggctgggtaatgtataaagaagagaggtttaattggcttctggttctgcaggctgtacaggaagtgtggtactggggtctgctcctggggtgggcctcaggaagcttacagtcatggtggaaagcaaaaggggcaggtgcatcatgtggtgacagcagagtgagagacagctggggagacgtgccaggctctctaaacaaccagctcttgcatgaaccatcagagccagaactcactcattaccatggggatggcaccaagccattcctgagggacccatccccgtgatacaatcacctcccaccaggccccacctccaacactgggaattacgcttcaacgtgaactttggaggggacaaacatccaaaccatatcacactgtaaaattccaaatggtaaatttaatatgaccagaagacaaatgatcattcatatattctctagactctggggaagacttcccttatggtcatcatcaatgaagcactgtctttgagtcattggaagcccagtactccccagtagcacaacggatgatgcaacctaatgagtaaccagcattcagtaaatgttgtcagggaaatgcagaggcaagaagatctttattgtttcaatataaacagagcctgaggagcctggcattgtgagcaataacaatgttgctgcttttttcttgtgttttttccttgtggtgggacatatgagcccagagccacacatttgacagtaaagaacaggaggagatggtgcctggatactgcagagaatcttcacatgcactaattgaaaaatactaaaatacctaagtacttcttctgtattcacaactctcaatcttcgtcaatacctcatcattcctcacatgggcccaataattttgtaatacattttaaaatcaaattgtttatataggcagggcttccaaaaacatattttccagggtcccatgcaccttaggcacagccctgttctcactttcagatgcaacgtcttccggaagctcacacatgggccccacatccatttatcctccttccagtatccatgcccccactttcctctgaaaaaaacactccctgcccataatcagcctgcatggaatctgatgaagcagagttgaccaactctggggatgaaagtcctgacttagccctaagccagtcagcatatctcattctgtggtcccagcacttggttcaggaatgggcatatgtcccaatcaaagtcaatgagatgcaatgaaacttttatttgggattctaggaaagggacactctcttccctgctgtacctgaaacctaacagcacataagagctggatctgttcccaccatcttgttgtcgcatgaggcctagaactcaagcagcagctgaagaagcaagtggagacatggtaagggagctaggacctggtgagctcatctgtgttcctgatcaagctgcacctgaagccaggacacacacttggaccataagccaataatatccccttttgcggaagcagttttggttggatttcttcttatttgcaaccagattaaatcaaatggataatcatgtctgagtgtaaatgcttttgttgtccatatactaatgccttctcaattctgatttttttggctgtctaacagaatgatgtcctgaagtatgcattaacctctgcctgattcctctttcttttattttattttctttctttcttcttcttcgtcttctttttttttttttttttttaatggagtctcactctgtcacccaggctgaagtgcagtggcatgactacaacctccgcctcccaggttcaagcaattctcctacctcagcctcccaagtagctgggattacagatgcccgtcaccacgcccagctaatttttttgtatttttaatagagatggggtttcaccaccgtattggctggactggtttcgaactcctgacctcaggtgattcatccacgttggcttctcaaagggttaggattacagacctgagccactgcacccggccctggttcctatttctacctcctccctgccccacaactgaggcctcttgacatttgctgcaggctcagcccctctccaattaccatggaaaaatcctgccctaagttggaggagtcaataactccagccccactgcagactcaattgagaacttctctctcatttcatagcctgtccagcctttccagtttataactgtattccctactcactctaaggtctgagtccaagtcatggtgtctgagatcttaaaaatagaatcatcagaatgacccgccttgccagtttcagggtacaaatatagccacctttatttcaattttccactcattcaagttctcacatactttttttagtgcaaggtcccaagacaccctctttaggcatccactgatccctggattttcaaagtctaggggataacttgggcttagggcatcagtgtggttccaatgccacctacagagagaactagtctatcagtccaccaccaatagtcattgctcctcactgccacatggtgtcgctgttgaagactgattctgcatagtctcatggctgcttgtccattgctgccagatgtccttgctgggttcctgcacaagtcacagtagtgccccctcttggtcttagcatttatcacaaatttaatcacatatttgttttcctgcttattgtctgactctcctataggacgtaagttccatgggtgcagttcctatatgtgctttattcagcactactgaatttgtaccagaataggtacttaataaatattgctgaaatcaatgagtgaatgaagaaatgcatgcatgcctgcatgaataaatgaaataaagtgtctgaagcaagggggagacaagacagagaaagtggtttccagagacagaatctcagcccacctcttgagagggagatggcatacttgttacataaatgcttctactccccactcctttgtccatggggccactaatcaatcacatcattctttctcgctgaggttggagacaatttctaaatcctcagtacagaagtccagccatctcttgtaatgaattggaggaggcagacaacaatggaacgttttgtggtaacaggatgcaagggaatgttctcactgtggcagttttaacatatagcccccaaattctttgacattcctcttatttaatggtgggatccctgacccttgcccttgaatctgggttctgcgaatgcttgaccaatagacaatggcagaaatgatgttctataagtttccaggaacaggtattaagaacctggcaacttcctctttctgtctctttaaacattcatcttgaaacccagctgccatgctgtgaggaagcccaagctgctttgggaagaggcccacctgagagaaaacagcagccagtgccagcttgctggccttgtgagtgagtcaccttggcaacggaccctccagccttagtagagacatccctggtgacattacatgaacaaagatgacctgtccccactgaaccctgcccagactgcaggctcatgacaaaataaatggtctctgtcttacgccgctaagtttagagtgttttgttaggcagcagtagtaactgggacactcatcaaacttcagcatcaactctgctaccatggctcagtccttacaatcaagttctgtctcagtttccccggctccacatgccaggtccccttctgggcctgcggctttgagaggaagcttacatcttatcccatccatggaatgggataggagcttattctgctccctatattgccagtcatgtagggggattgcatagcctgcagtcaccacccacttggtctctccagcagcccatgctgagagcctgaatatttcatgataggctgcagcttttgagcttaggaaggaactgcgggtgtcatttcgagctagttcccatccctttcattcccatgcctgtatttgtcaacgcttagcagaggacttgcccttgtgcgctgtttgggaagctgtgtgccatgtccgattcactgccccgtcactgcctgttactccttgtggatgcagatgccctagactcagggggaccatcttcagagcctctgctaagtggttctcaaacatgtttagatgccatttagccacttggatgacccagtgactgcctcattaatctgacaaatgttggaaacaacttgcttccttctctctttctgacattaggcaccagcagcttcctcacctctggcacactttgaattttagtaggccagtggagcctgcctttggaggtagacagaggtgaattcaacttccagatttatgatgtgaatctctcaagttctcgtgatcttgggagggggatatcatttccttggtcctggggttccacgtttgttcaatggggataatgccagcctcagaaagctgctatgaggagtcagtgagacaaggtgcacaactcatagtttggtggggcctgttagccccttgagatcagcacaacatgagttcaaatctcccacttgccattctaagcaagttagtgcttgttagggctcagaatagtgcctgttaggaagcactagagaagccaggcatggtgacttatgcctgtcataccagcactttgggaggtttaggcaggaggatcacttgagcctaggaggtcgaagctgcagtgaactatgattgtgccactgcactccagcctgggagacagagcaagaccctgtcttaaaaaaaaaaaagaaaaagaaaaaaaagacaagaaagaaagcactagagaaaggactgagccatggtaggagagttgaggctgaagtttggtgagtattaattttatggatcacttttgtgtgtcttcaactccaggcttctggaatgtctacctttgataataattatttttcttttttagagatggagtctcactatgttgcccagtctggtcttgaactcctggactcaagtgattctcctgcctcagcctcccaaagtgctggtatgacaggtgtgagccaccacatttggcctgaatgtctatcttgagaggtggtgagggttagtggtaaaaagtgtggattctagacccagacttcccaggtttaaacctcagctccaatacttactatttatgtgatcttgggcaagtgaacctgtctgggctgaagtttcctcatctgtaaagtggaaatgatagtaatacctacttttttttttttttgagacagggtccagttctgtcacccaggctgtaatgcagcgacacaacgaccatggcttactgcagctttgacttctcatgctcaagtgatcctcccacctcagcctcccaagtagcttggactacaggtgtgcaccaccactcctggataattttctttcttcttcttcttctttttttttttttgttttttggacatacaggatcttgctatgttgctgtggctggtcttgaactcctgggctcaagcaatcctccctcttcagcctcccaaaatgctgagattacagacatgagctaccatgcctgggtagtaacacttacttcttaaggctgagatatagattaaataagtcactgtatgtgaagcacccagcacagacatagcactatataaaagttagctattgttatcctgcataatgttgatccagatgtgaaattccatcccttccttaattcccacaaactctaattcaaaaacattttttttgtgagtatattagagcttacagaaacctttgggttcgtgcaaagggtaaaggagggatttactgcttgtttcacacactgcttcaagtagaaatgtagacatgatcattcataaactccagccatgcctctgtctgtggcagcccctcaccatgtcaccccatgtggtccccatcctctcaccttctcaatggttccttgcttctccttccttacacctccatctcttctcctcaaccctccaccctggatcatccttatcatcccatccaaattcttctctcttgagtatgccaagcaattctgctctccccaacccttactttctgcacaaccacatgcaacacccacccccatctcccatgtgctcagcagaacacaaagactgatatggtttggctttgttttcccacccaaatctcatgttgatttatgatcttcagtgttggaggtggggccttgtgggaggtgattggatcatgggggatgactgctgttcttgggatagtgagtgagttctcatgagatctggttgtttgaatgtgtgtggcactgctgggcgtggtggctcatgtctgtaatcccagcactttgggaggccgaggcaggtggatcacaaggtcaagagatcgagaccagcctggccaacatggtgaaaccctgtctctactaaaaatacaaaaattagttgggtgtggtggcgcacgcctgtagtcccagctacttaggaggctgaggcaggagaaatgcttgaacctgggaggtggagcttgcagtgagccgagattacaccactgcactccagcctggtgacagagcgagattccgtctcaaaaaaaaaaaaagaaaagaaaagaaaaagaaagaagaaaggtgtggcatttccccctttgctctctctctctcctgccaccatgtgaagaaggtgcttgattcccctttgcccttctgccatgattgtaagttcctgaggcctccccagccatgcttccggtacagcctgcagaactgtgtcaattaaaccacttttcctcataaatgacccagtctcaggtatgtctttatagcagtgtgagaatggactaatacaaagaaagaccttccatttaaactgtccctaccctccttggaaggcagtttgagttataaaaagaaatgaggctgggcactgtggctcatgcctacaatcccagcactttgggaggctgaggtgggattgcttgagtctagaagttcaagactagcctgggcaacacagtgagaccctgcttctacaaaaaattaaaaaattagcagggtacagtgtagcatacctgtagccccagctacgtgggaggctgaggcaggaagattgcttgagccaaggaggtcaaggctgcagtgagctaagatcacaccactgcactccagcctgggtgacagagcaagaccctgtctcaaaaaatacatgtatatatacctcttgttataggtgtgtaaagactataataaatagagtataaattacacaggttcaactattagctaaaatatacatgtattatattacatttacccctttaccttctaacccccttcctcactagacctcagctctcactgctctagggaaagggagccacagcaggatggggagggaaaccaaggaagttaatttccaaatatccaggtcctggtgattgaaaggcagttcacacagaatcttaggataattttgacaatcagtaattttcgctttacggtgttgaagttaggacataactcccacatgagatgggcatctacagctcaaaaagtgttgatggtcttcttagaaaaaagaaaattgcgcttctaatagagcaagagagtaaaagtgaacatgaaatctttgcacagttatttgaaagagaaaattctgattttggcaatgagatctaccacacttatgtgggtacttgtttcagctacaaacgtagggaaatgttcaataaaagtcttgaaatagagcttggggtctcactctgttacccaggctagagtgcagtggcacaatcatagctcactgcagcctccaactcctgggctaaagggatcctcctgcctcagcttcctaagtacctgggactacaggcacatgccaccaaacccgcctaatgttttttaatttttttgtagagatggagtcttgccatgttgcccaggctagtctcaaactcctgggctcaagtgatcctcccgccttggcctcccgaagtgctgggatgataggtgtgagatgccatgctgggcctaaaacatatatttctaatgcagagctgagttgagaaggaggaaagggaaatctccaagggcctgaaaataggagtgatcttcaatcaagaacagtaaactctcagttgctgttgtggcagcccccagggcacatccttggacttcagggacaaaggaaaagggttttaaaacccacgcaggtcaggagatgtggccccgtgaaacagtgattgggaacgaagacccattcaaatcaaagctggagcctggaaggactctttcccatgaaatggggaccagaagttctccagcccaagccccggcctaacaggctgaggacagagcaggtgacaaggacaggaatccagatacacgggcagagcacaagaccatttatcacaatgtgggcacaagattggggcaaatgtgatgctgagtctcaaagcacaagattgaataataagaacgagaataatgatggccatttattgtgcacttacactgtgtgtcacacgctaagtatgtcacactgaattcttctgatgaagtagatgctactactgacattgtcactgtgaagctgatcttgtagatttggacaatgtcaggatgggaaagtggttgtctactcctcccaccttgtggggagctttagtgaaacaattaagaggatactttttcaccctggtggcttttaaattatgcctcgtggaaggtcaggggctgccttaggtagcaaagggaaggtcctctatttgtggcatcgttccaccccctcttcaactgaagcagtttcatttatatctgttttattatttatttatttatttattctttttttttttttttttttttgagatggagtctcactctatcacccagactagagtgcagtggtgtgatctcggctcactgcaacttccacctcctgggttcaagcgattctcctgcctcagcctcccaagtagctgggattacaggcacacaccaccatgcccggctaatttttacatttttagtagagacggggggctcatcatgttggccaggctggtctcgaactcctgacctcaagtgatctgcctacctcggcttcccaaaatgctggaattacaggtgtgagtcaccgtgcccggcctctatctgttgtatatactgtgcttctctctcatgagatctgcttcactaagagggttttgtagataataatcatcatcatcataaataaaatacaataaagtaaaataaaataagtctccaaaaagagtgacaatcagacgtggtgtctattgctgtgccacagcctgtccctgtctcttccagcacctcacgatgctacattgtcagctcttgtttggcggccactggacacagactgagcagggactttgttctccaggatttctccagcatctggcccagaagagatcccccacaactgtggaagaggaaattacattggatttccacatgcctcaggccgacctgggagtctagagggtgtagacttggaacaggggtctgtccatgggacatgggctgccctccaacccctgggcaccccacacatagctaagaagaatatgggtctgtttcctgcttattatattcacctaaaaggtaaaataggctctgcttctggaagctccttaattgcagctttataaagaggtcccacatgtgaaaaagaggggaaattaattggtcttccagggagcagctgaatgaggtctggtaattgaatttcacaatggatgcctccctctcggtggcccgcatgtgatctgggatggatatttgaagttttcgtcatgtaaatggcttgggctcctcaaggtttatattttttggtgggcattactcattcacacttctatcttggacaagatggagaagaatttatgccatcttacaaactctaaaatgatagcagggaaagaagaagggggcaagggcctgtcctcatcttgagatgcaatttggtagatcctttgcaaaggctggggaagggccaattcagagaataaatcattactcaaatgccggctaccccagaatgaaggtgcagacccagctggtaggtactagtgcttgggagcttggctccaaaatgagttatgataggtgagatccggaggggcaagaaacacaccaagtcatgatgataattaataccttgaacaggtagctatatactgagatgcccccctgaagatttaactagcaccatgacccaaatggttacttaagtctctaatggttaaagacttaacttgtgtgttttctgtctcaataaaatagttactagtaaatcactgtccttgggctggatgtgcaaggtaacctccaaccactgccactaccaggataggcatcagaccttttaggtttttaaaatccaaatcagcactggaaatataaaatatatttctagaaatacatcaaatggatagaaatataatatgagccacaaatgcaagtcacatatgtaattttaaattttccagtagccatattttaaaagtaccaaaaagatgatattaacttcacaataggctgggcacagtggctcacgcctgtaatcctagcactttgggaggccaaggtgggtggatctcttgagcccaggagttcaagaccagcttgggcaacacagtgaggccccatctctacaacacacacacacacacacacacacacacacacacacacacacacacaaattagctgtgtatggtggtgaatgcctgtagtcccagctactctggaggctgaggtgggaagacacctgagcccaaggggttgaggctgcagtgagacctgacagagccactgcattccagcctgagtgacagagtgaggccccatctcacaacaaaaacaaaaacttaataatatattttatttaacccaatatatcaaaaatatctcaacatgttgtcagtataaacattattaatgagacataaacaaatgtaaaatgtgatgcatgtaatgtaaaagaatttacattatttgaaaattttttgttgatattatttacatgatttcttattatttgagggctgtaagagaaggatctgtttcaggcctctggaatacactaattcttgtactaaatacattatttcttatactaagtctttgaaatccagtgtgcatttttttaagagatcagatctcactctgttgcccaggctggaatgcagtggagcaatcatagctcactgcaacctcgaactccttggctcgagtgatcctcgcgcctcagccttctgagcagcccagtgtgtattttaacttacaacacatctccattcacatgagccacatttcaaatgctcaatagccacgtgtggctagtgttacaaattggagtacgcaggtggagtccttcctacagacagtgaagccaaagaaatagaataaaccctttgtgattcaagggccacaaaggaaactgaagagagttctaggttaagaaagccaactgaagcaggttgcggtggctcatgtctgtaatcccagcactttgggaggctgaggcgggtggatcacctgaggtcaggagttcgagactagcctggccaacatggcgaaacctgtctctactaaagatacaaaaattagccaggtgtggtggtgcacacctgtagtcccagctactcaggaggctgaggcactagaatcacttgaacccaggaggcggaggttgcagtgagtggagatagagccactgcactccagcctggatgacagagtgagaccctatctcaaaaaaaagacataatctaccacagtagtgccaagataactcaataaaggaaggaattttagtttaaacaaatggcactgagacaattgaatatccacatgtaacatgaagttggattcctatttgcaccctaaaaattaactcaaaaagaatcaaattcttaaatgtaagagctaaaactataaaactcttcaaaggaaaagacgtgaaaatcagccaggcatggtggctcacgcctgtaatcccagtactttgggaggccgaggagggtggatcatgaggtcaggagttcgaaaccagcctggccaacacggtgaaaccccgtctctactaaaaatacaaaaattagcctggtgtggtgatgcgcacctgtaatcccagctactagggaggctgaggcaggagaatcacttgaactttggaggcagaggttgcagtgagccaagatcacaccattgcactccagcctaggcaacagagtgagactcagtctcacaaaaaaaaaaaaaaaaaaaaaaaaaaaaaaaaggcgtgaaaatctttgtgactttggattaagcaatggtttcttagatatgacatcaaaagcacaaacaaaccaaaaaacagataaactggactttaccaaaatttaaaacctttgtgctacaatagggaaaagacgacccacaggatgggagaaaatatttccaaatcatacacctttttttttttttttttttaagagacagtgtctcactctgtaacccaggttgcagtgcagtggaatgatcatagctcattgcagccttgaacttctaagctcaagagatcctcccacctcagcctcccaagtagctgggactacaggcttccaccaccatgcctggctaattttttaatatatttttttggtagaggttgggggggcgggtctcactatgttgcccaggctggtctcgaactcctggcctcaagtgatcctcctgcctcagtctcccagagtgctgggattatgggcatgagccaccaccgtgcctggcctccaaatcatgtatctggtaagagtctagtacctagaatatataaagatctcttacaactcaacagtaaaaagacaaataacccaatttttaaataggcaaaggatttgaatagacatttctctaaagaagatataaaaattgccaagaaggcctggtgtggtggttcacacctactaatcccagctctttgggaggccaaggcaggcaaatcacctgagatcaggagttcaagaccagcctgaccaacatggcgaaacccccttctctactaaaaatacaaaaattatctggacttggtggcacacgcctttagtcccagctactcggcaggctgaggcaagagaatcgcttgaacttgggaggtagaggttgcagtgagtgagatggcaccactgcactccagtctgggtgacagagcaagactccgtctcaaaaaaaaaaaaaagaaaagaaaagaaaagaaaaaaatagccaagaagtacatgaaaagattctcaatatcattagtcattagggaaatgcaaattaaaacaaaacagaaaaaaatcaactaacaacaatagtgaggaggatgtggagaaactggaacccacatacattgctgatgggaaggtaaaatggtatagccactttagaaaacagtgtggtaattcctcgaaaggttaaacatgttcatagtaaaactcatacaccaatgtttatggcaacatgattcataatagccaaaagtgaaaacaatccaaatgtccaccaactgatgaatgcataaacaaaaccttgtatatgccaggcacggtggctcacacctgtaatcccagcactttgggaggctgagacagatggattacttgagtccaggagttggagaccagcctgggcaacacagggggacatcctccccttaccctgtctctacaaaaaatacaaaaattacctgggtatgttggcctgtgcctatactcccagctacctgggaagctgaggtggaaggaacacttgagcccagtaggcagaggttgcagtgagccaagattgccccaccgcactccagcctgggtggcagagtgaaaccttgtcttaaaaaaaaaatagttctgccgggtgcggtggctcacgcctgtaatcccagcactttgagaggtggaggtgggcggatcacaaggtcaggagattgagaccatcctggctaacacggtgaaaccccatctctactaaaaatacaaaaaaattagccaggcgtggtggcatgcgcctgtagtcccagctactcgggaggctgaggcaggagaatggtgtgaacccggaaggcggagcttgcagtgagccgagatcgcgccactgcactccagcctgggcgacagagcaagactccgtctcaaaaaaaaaaaaaaaaaaaaaaatagttctgagaggccaggcgtggtggcctgtaatcccagcactttgggaggccgaggcagggggggtcacttgaggtcagaagttccagaccatcctggccaacatggtgaaaccccgtctctactaaaaatacaaaaattagctgggcgtgatggtgcacgcctgtaatcccagctaccagggaggctgatacacgagaatcacttgaatctgggaagcagagattgcagtgagctgagatcgtgccactgcactccagcctgggtgacagagcaataatccatatcaaaaataaataaacgaataaaagtgatggttatacaatcttatgaatatactaaagccacttacttgtacaatctaaagtggtgaattttatggtgtgtagattatatcaataaaaatgcatgcctgcaaaaaatccatgagacttcattagaaaacagaaaaattgataaaatttaacaatgtaaaaataataatataaataacaaaaattgggacgtaaaaagagaggaggtgagagtactagtgccatcattttcaaaatggggagatagacaaaactgaaacatgtagtttaaaataaaaacatagtgaccacaactttaatctatttgtaatctctcctttataaatttagagagatatttcaaaaagttatctcttgaagtacagaaacattgtttgactttcaacaattcctttagtttctctccagttcttttttgtctagtaaattataataaaatgtaatgcttcttaattaaaatttgaaactataatataatctccttttaataaaatatttctatctcatcctcctcattttatattggcacaaagagatatttcaaataatgtacatctcttataatttctagaccacaaatgtgattttttttctactatcaccttcaccctttcctttattatttgaattcttcataataatgttgtatcagctccctgaaacaatagagttcaggttctaaatgactggaagaaaacatgccaagacaggccttggtgaaatatagattatttttttcttcacattattctgtatttttaaaattgctacgcccagtctccccagaggaaactgacccaacctttaggctggaaacagggaaaaaataattgtggttttcataagggaaagatgtctaaatagctttggcacaaaacttcctgggcatctgtgctccagaagagaatggttgatagggtacaagagctgtgccttgcacctagtgttaaacatggccccagagcagtgacggaactctgtcaaaggaccacaatggcccatgctgggacctggaaatagtgaaacattgctgcagcctggaccagcagtactcaaggaggtaggagggtcaccatgtgacagcagcttctactggatgggaagtgacacagcaacaatagcactcctggactctccaacgttgctcccatggcttttggatttaatttaaagaaacaaaagagggccgggtgcggtggctcatgcctgcgatcctagcactttgggaggttgaggtgggcagatggcctgagctcgggattttgagaccatcctgggcaacatggtgaaatcctgtctttactaaaaatacaaaaaatagctgggcgtggtggtgcacacctgtagtcccagctaccctgggagactgaggcacgagaatcgcttgaaccccaggaggcagaggttgcactgagctgagattgcgccactgcactccggcctgggctggagacagagtgagcctctgtctccaaataataataataataataataataataataataataataataataaataaaataaaatatcgctgggctcggtggctcacgcctgtaatcctagcactttgggaggccaaggtgggtggatcacctgaggtcaagagtttgagaccagcttggccaacagggtaaaacctcatctctactaaaaaaaaaaaaaaaaagcctggccttggtggcatgggcctgtaatcccagctacttggaaggctgaggcaggagaattgcttgaacccgaaaggcagaggttgcagtgagctgagatcacgccactgtgctccagtctgggtaacagagtgagactccacctcaaaaaataaataaataaataaataaataaaataatctatagcagttgttatctacagttgaggaatagtttacaactgttccatatacaaacttataggttgcaagtcccctgtaatgtccattattttattgaatcctttttaaacagtcctataggggaaggcaaggattagaatcagtattttatgggtgagaaaactgaggttcaacagagttcagtgacttgttcaagatgacacagctaggccaggtgtggtggctcacgcctgtaacctcagcactttgggaggccaaggctggtggaacacttgaggtcaggagttcaagaccattcaagaccagcctggacaacatggtgaaaccccatctctactaaaaatacaaaaaactagccgggtatggtggctcaggcctgtagtcccagctacttgagaggctgaggcatgagaatcacttgaacccgggaggcagatgttgcagtgagccgagatcgtgccgctgcactccagcctgtgccacagagtgagactgcatttcaagaaaagagatcacacagctagtttgagactcaaagccagctttgtctatggctagatggtgcctagcacaggaatctaaaggaagcatggttacatttagagtttttggagagaacatgtagccagagggacagtaggtgagtgtgaattaggcacccaaagcgagctcgggtcccgagttgagacccgggagcatcagtgagccctcttagtgtgggtcttttcttcattcttatcggcagctcctctgctcagatctgcttctttcatcaactaatactcacaactctctcatttccagacactttcctttaattgtgtgtgggatcatacacagtatcagggaaaactatcgatagcaagcctgattatagacactgtgaaattagcaaagagagaagaggttttgttttgttttgtttaccatttgtttaacatatgagatctgcttacccgtggtgtcaatgcctgtaacaattatacatgtaacccagatgttccccagggtctctcaccacaggcaagctcagtaagatggacttagattccatttccatggcctatatgtccacagagcccttcccaagagtctggagaccttaggggactcatatgctcagtaacattgcctctggggtcctggttctggcatgaatctctatgacccagatgtgaaactcagccacactctcagacaaataaccaaaaacattcatgggtataattagattttttctcagttggtaaaaatcttaaatacagaaaaaacagagagctgtctaacaaatacccatgccctccaactctttgaatttaatgttattattttacaggatcggcttttgattgttttaatctaatagggttaaaagtgacatctcttacgtatgccttccttcccagaggaatccaccatagggaatttggtgtctgtccttccaaatcttgtttttatacttttactcatataatgtatccataaatgtttgtcttatgtgtttttataatgctatcatatttcattttctgcaagttgcttttttatgcaatagtgtgtgttttttctttgtttatttgtttttgagacagagtctcgctctattgcctcagccccccaagtagctgagattacaggtgtgtgccaccatgccctgctaattttttgtatttttagtagaaacaaggtttcaccatgttgcccaggctggtcttgagctcctgagctcaggcaatctgcccgcttcagcctcccaaagtgctgggattacaggtgtgagccaccgcgcccggcctggttcctgttttcgtaaggagattggaatgagatgcaaataaacagagaagtgattatatctaagaaatacaaacaagtctgtctgctgccctcactacatggacatagacccaccaggcaattccacctgctgcttcaactcatattattcccagtcatttaccttctggctggcaaccttctcctccttacctacttttaatgctcctacccccattctgttctctctgccttcttcgcaggggcaaaagataaattcctcccattttctcatggaaagctcttaatcatctcttctgttactaggggcctggtgctcctgcctccagtttgtggttcctcaaacacagttccttcttgtatcagttaaggattgcaacatagcaagcccaccccaaaacttaactgtcttaaaacagtactacttattagctcttgaatctctgggtcagcagtttcgcctggactcagctaggtattatttctggtcttggctaggttcattcaggcactgtcgttagccaggtggctctgcttcagggattggttgactgtcagctggggcaacagcagtgacttgaccactcgtctctcctgctcctgcaggatagccagggcctgttctcacagtagcagcaggactccaagagtgacagaagaagcatgcaaggcttctggaggttcaggctcagaactggcacaatgtcacctctgcctcattctattgaccaaagcaagtcacaggccagcttagattcaagatgtcaaaaaataaactccatctcttgattggagaagctgcaaagtcacattctaaggggcccggaaacaaggaggaggggaggactgtgggttggattctctgggaagccaactctgagatagagattaacatgcaggaagttactcagggagtgctcttgggatcaacaccggtggaagagcagagaaggaagcaggatggagcagagggagaaattgaagtgcaatgtcagaacaaaggcttccactgacctcatggagacctctaaaactggaataggtcttccaagttgtcctgagtagaggcaaggggaccaggcctctaagctcccaagctgatcaatcatttatgcagactgccctgaaaaggcagctgccaaggaaattcccaaagagggcttagagccaaggatcatctgccaacacttttcccagtagcaggtggaataaatccttcattcctcagtgggggaggagggttgcctgtgccgaacatcacagtccactccactgccacctctccctaagaatgctaatgctcatgataaaacgcttgtcacttgctgtatatgtatacgttaaatatttataatcacttattaaatgcatcgcctaacttgtacagattttagatgatcacaatgctaaatgtcactcctttgaacttagtcttcatagtttcattgctcatttatctaggtcatccactcaaaactttaaggatgaggagaaacagcttctcccatcagaaatctaggcaagaggcgctcactggctcccaaccagcgggagggtcgtcgtgtgcctgcgcctgggttgggggagccttcgcgcctaggcctttccctcaatttttcctctttccccctcgccccgcactggggcttcctggtcggcgcttgcacagggaactcagtgctgagattgtctcaagccccaggaaaaatggtggaaaattcactgtcaccattgccagaaagaccgatttatggccttctgcttctcttaagctcccaatttggcttcatactttacctcgtgtaggcttctattcctgaatcttggctaaactccttaggtttaacctattggcctcaaaaatattggacagttgcattacctctctacttccttattactatagtaattggctatgtgctcttgtttgtaccccattcactcgactccattcgtacaatcacagataactatgctaaaaatcaacagcagaagaaatactaagaggaggccattccagcattaagagctatttctatttagtgaagtaaaccaaattttctttcttgtagccaaagacctttacaccaaaaactgaaatgtacctggccatactaatgagaggtgaagctggctgggcttctgggtcgggtggggacttggagaacttttctgcactgacggggagtgtctgcagcttcattcctgaagtcagcgagaccaccagccgaccggaaagaagaaacaactcccgatgtgccacctttatgaactataacactcactgtgaaggtctgcggcttcactcctaaagtcagcgagatcacaaacccacgggaaggaagaaactctggacacatctgaacatctgaaggaacaaactccagacataccgtctttaagaactgtaaccctcaccgcgaaggtccgcggcttcattcttaaagtcagcgagaccaagaacccgctggagggaataaattccggacacactaacaccaagcatttatttatttataagtttttgccatcgtaattttgaccataaattaattcaaccatctctcttattaatagaggagatgtaaaaattgtaaattgatcttctcttagattatgttcaatgaatattgtaagtgttctcatgtattgttaatgaacagaataaaatacagcattaccattaaaaaaaaaataagtctaggcaagaaccatttcaagccatgctggcaacagagtcaccagactgcagttaaggtagagacacgatgttctttgtagttctttgtagagagaaggactaagatctgggtcatggagagatgatcactcaacagggaatgcgggaagctagagtaaaatttggctggcagaccaagtcgtgagaggaaaaagagaccaaatgaggctttgaaagataaataaacaggccgggcgtggtggctcacacctgtaatcccagcgttttgggaggccgaggtgggcagatcgcctgaggtcaggagttcgagaccagcttggccaacagggtgaaaccccgcctctactaaaaatacaaaaaaattagccaggtgtggtggcaggcgcctgtaatcccagctactcaggaggctgaggcaggagaatcacttgaacctgggagtcggaggttgcaatgagccgagatcgcaccattgcactccagcctgagcaatgagtgagactctgtctcgaaagagagagagagagaaagaaagaaacaacccaccccacgagggcagctcttgatatctgggaagacagttcatgccttacagaggcaagttgcttgtttggcaaaattccaggagagccgtcaaatcagaatttggggacctggatggagaattgatttcacctgcaacaaaggcgactccctgtgaccacatagaaaagactctgctttttggaaaccaaaggctgtgaccttcacatgcaggcttatagataggaacaaattaacaggtcaggccaaaaaggaggagatgtcagcagtggccagttggaaagttctgggagaaccacaaaatgccagagtctctcaattaaagtggaaaaaccggcttagagtgattcaatggtaagatcaggatcatgccatgggttgttagctattctgtttagctctccagatctacccttcgccctctccaccagtggtgctgtgtcccagagattcactttaatggaatatgtcgaaaggattctttactccctggctttctattgggtttgctcaatgggagacacgtgcaggatactagaggatggaagaagagagaaatgagggtatttatttacccagctcccccgccactggggccaaggactggaactatcatggaaaaccgttttctcaacttcaactctttccacattcacggaagcactccttctccctgcctctttaggcctggacccataatgtacccccctcaactgttgcagtctctggggtgcttcccccattcccgttggcttcccttaacgattgttacaactttataaatactttcctggccaggtggggtggctcacacctgtaatcccagaactttgggagggtgaagcaggaggatcgcttgagtctgggaggtcaaggctgcagtgagctgtgatcacaccactgcactccagcctggaaaacagactgagaccttgtctcaaaaaaataaataaatattttccttgatcactgcacttgagtgctatctcttttttgatgcaattctaaatgctaatcacttgagctagcttattgaaaaggggacactgtgaatttttatggatagttgttccttttggctgtccagcctcagaaacacatactcatgtctgaagaatttcccatcatatgagtcttggtgggaagtagagctcacttccccacatagaatgtggcagtgctagctatttgcttttcagcctcccttgcagctaaggtttgggcaagtgacctaggctcagccagtcagaagcataaaccaaactttgaatgaggagtcggtaatataaagacataaggacagtgctgggcatagtggctcatgcctgtaatcctagcactttgggaggctgaggcaggtggatttcttgaggccaggagtttgagaccagcctggccaacatagtgaaaccccatctctactaaaaaatttaaaaaaactagctaggtgtggtggtgcgcacctatagtcccagctacttgggaggctgaggcaggagaatcacctgaacctgggagatggaggttgcagtgagccaagatcatgctactgcactccagcctgggcaacagagtgagactctatttttttattttttattttttaaattttatttatttatttatttatttttgagatggagtgttgctctgtcacccaggctggagtgtagtggcacaatcttggctcactgcaacctctgcctcctgggttcaagcgattctcctgcctcagcctcctgagtagctgggattataggtgcacaccaccatggctgggtactttttgtatttttagtagaggcgaggtttctccatgttggccaggctggtcttgaactcctgacttcaagtgatccggccacctcagcctcccgaagtgctgggattacaggcgtgagccactgtgcccggccgagactctgtctctaaacaaaagaaaacacaacacaatacaacaacaacaacaacaacccaacccaaaccaaaccaataaaacaaaaacttccacttaaatcttaaaaaaaaaaaaaaagaaagacacagggacagtggagaggtagtctggtggtggtggccatagaagcagcaatatcctgtctctggggcagcctgggcagtagggccagtgactgttcctagcatgcagatgtggagctttagcagagtcagagaggcaagtggaagggtctggtactctgcactggaggcagcagggtcctcacaggccctgtgtttctgccattgcggtgtccaggtctggttcttcagccttcccagcaatgccaaaagctctctggtatcttttctactgattcctctcctgcttaaatctaccacagtcagtttctgttgcttgcattatgaatcccaacttgtggtttgcgtgcaacccaaatgtgggctacagctaggcttcacagggaaatagaaaacaggggcccaggcagctactccctctgcctcccactttggtgcctcaatttctctctctctatctgtctctttctctgtctctctcaatacaactgccacatacttctttccagctgtggttttgtcttaattcatggaaagacattatagcttactgtttaggaagcacccactttgaggtcagaatgcctggattcaaatctcagatgtacagtttaccatccacaaggttttggtcaagttactgatcctctttgggctctgtttcctcatctgtacaatgaggacaacagttttcctgttttgaggatgaaatcacacaacgtgtgtaaagccctcaccaagctattaggccacaggagccatcagtaattgttgctattgttatcttcattatcagcattattatcagcacggtttggggacttatagagactacttaaagcaggcatcttaaacttcaaatgcctacaggagccaacagggatgatgaaaaggagccatgtatagaacacaggcacacacattttccatagtcccaagggaagctctcccaagggactgtaaaaattgtgcgagtgtgtgcctgtctagagggggcagccatttcccagccacagccatttattgccatgtggaatgtgagcccggtgatgccagattttccactatttcaagagaggtcagatatccagctatttggggtaagcttgatgtttttcaaaaatctaaaaaagcactatcctggccaaaggaaaccttcctggggccacagcaggctgcaaacgctaatttctatgttctaatgcaaatttctggattgagttgaaattgtcagggagggaaagtggttaggccaggttaatttcattggctcaatcaggtatggccatggcccaccactcacccagtggggaatgtggtggacactctgactgtggggtgtgggcaggaatgtagtcataggcatactttagagaaggaggcaaggaccaaaggggtgccccaagagttgctttcctatggatgccagcacattaaaaacaaacgcatcaggaatgcaataagtcccgataagtgcaaggttaagagtgaggcttgtttatcttgttatttatttaaataacagtgtgtctggcggtagggcataacaggactagcacaaaggctcagatatatccatgtgattccagattatttccaccctttcacacctccatcctagcatgtaggcctttgtcctcatacttttcacctcatggttgcaagatggctgcaattgtgaccatcacaactatgttccaggcagagggagaggaaatgagaaggagtaactaatggcccttatgtcaggactttgcagaaatccccagcatatatatattttttcatcttattggccacagctagttcccatacccatacctagtgacaaaagaaattatggaggtgagtatttttagcttggtacattgcagccccaaagaacatcaaggtttttaaaaaccctattttggaaacaaggagagaataacctggagtaggaaatcagcagcctctgccaccttctctgaatatgcaccatgtgccagaccccagctaagtactgggatatcaggctaacagtcccagtctgcacagcagaaagatacagaagtgggcctggtgcagtggctcacgcctgtaatcccagcactttgggaggccaaagcaggcagatcacctgaggccaagagtttgagaccagcctgtccaacatggcgaaaccctgtctttactaaaaatacaaaaaattagccaggcatggtggtatgcatctgtagtcccagctacttgggaggctgaggcaggcgaatcacttgaacccaggaggcagaggctatggtgagccgagatcgcaccattgcactccagcctgggcaacatgagcagaactctgtctcaaaaaaaaaaaaaaaaaaaaaaaagagagatacagaagttgttgtggaacccaacacagctgggccgggttccaaagtgagaaaatcagcgctttggctccttacagatcttctaggcctcccatccttcctgccccttccctgcccctcctgctgtcagcgcagtcccacaaagggcagagtagggtggaaacaatgtgtgattaacaccagtagcagtttcaggaggcatccaagagatgttccagagagaaatatgtaactggcacatctggtttataatgtgtattaattcctgacatgtagtttgagtaatatatgtaaagcaaaaagtccaagtgttgatttaggggccttattattactctgtcagcagaattcatgttctatttgtgcagtgctctgggcccagcacctcacctagggcagcaggaaggggaaggctttctcatgggtgccagtggatggtggaggcccctgctgatggtgatagggatgtggatgagtacttggagcccctggtagggttggcagaagctcatctggcaaagaagatcgtggagctagaccaagtgccagctgaggctagaagcagaggcatcctacccctcagaggcagaagtagcttaaagtctagaaaactgtgggctgtggagttcaaagccagctctgccacttcattgccatgtgactttgagtaagttattccagctctctgagcctcaatttctgctcccataaatgagaaccataataacgcctacctaacagggctgctgtgaggtttaaataaaaacaacaggtgctgagaatttactatgggtcagcgtagtgttgcaagtgtttgacatgtattatctcattgaatcctcacagtaatctcatgtagatactattatgatgcccaatttacagttgaagaaatgcggcacagagaggtgaagtaacttgctcagggtcacacagctagtgactggcagagctggggttcatacctagacaatctagccccagagaacactcactgagatgtttcaacagacagctatattttatagtaagcacacagtaaagggtaattctctaggtcagtgatgtccaatggacctttctgtgatgaaaatgttttgtaattctgtgctgtccaatacacgagccactagccacagatgactatttaacatttgaaatatggctagcttgactaaggatgtgaatttttaatttaatttaatgttaattaacttaaatttaaatagccaggctgggcacagaggcttacgcctgtaatcccagcactttgggatgccaaggcaggtggatcacttgagtccaggagttcgagagcagcctgggcaatatggtaaaaccctgtctctactgaaaatacaaaaattagctgggcatgttggcacacgcctgtaatcccagctacttgagaggctgaggcacgagaatcacttgagcctgcgaggcggaggttgcagtgagctgagatggtgccactgcattccagcctgggtgatggagtgagaccctgtctcaaaaaaaaaaaaaaaagaagaagaagaagaaataattttgaatattgaaccagccttgcatacctgaacaaaatctcacttagtcatggtgtataattctttttatctatcgctggatttgattagctaatattttgttgaggacttttacatccaagttcatgagagctgttggtttgtagtgtgccttcttctttccacccttgagaatcttcctaggtttgctgtgttgtgtccagggatttttagtttttagggagaggacctgggagaaatggagctattccatgttggtggaactggaaatcccacacattctttttttacatatatgtactattatacagatgtgctgcaatggattaaaccaatttcctggttaacacttagattctttctaattatttgtcgttgtgaacaatgccacaatgaataagtttatgcatttgtcatttcatacttaaaggtaaaggtgctattgtaaattctcagaaatggaattgttgggacaaagagcacatgtatttttaattttgatgtttccaaattatcttctataggtattgcaccaacttatattccttattctcctgagactgccatgccccctccactgactctctgccgacagataacatgttagggtcttgctaatctgatagtttaaaaaaagtgaaatttatctgagttttgagtcataattaggtaggccttttccatgccctcaaaataaaggaattttcctatgttttcttttagtgtctttacttttttttttttttttttttagacagagtcttgctctgttgccaaggctggaatgcagtggcgtgatctcggctcactgcaacctccagctcccgagttcaagcgattctcctgcctcagcctcccgagtagctggggctacaggcgcgtgccaccacgcctggctaatttttatatttttggtagagacggggtttcaccatgttgaccaggctggtctcgaactcctgacctcaggtgatccgtccgcctcggcctcccgaggtgcggggattacagatgtgagccactgtgcccggccaacatctttacttttttatttgaatctttgatccttgtagaaattatcctgagctgtatgtggtggcatgtacctgtagtttcagctactaaggaggctgagtcgagagaattgcttaaacccaggagttggaatctagccaggcagcatcaccagagtcctgtctatcttttaaaaattcccctatcttatcaccaggaattagagaccaaaaaagaaaaaaaattacctggtgaagagagagaggaatagatctaacttgttgctgttgttgctttctatcatatgggtacccagttttcccgtcaactctcttgaaacagtctatcttatctcctctggtgtaagatgcgactattatcatatacttaattcctgtgtgtattttggatgtattctaggctttctagtctatccggctagttgtctatctattcatacaacaacactatactgctttaattattatttataaagattgtatctttgatagcggtagtcctctctcattctttttcttttcttatttatttatttgttttattgtttcttttctttttttttttttttttttgagacagagtttcactcttgttgcccaggctggagtgcaatggcatgatcttggctcaccgcaacctccgaatcccgggttcaagcgattctcctgcctcagcctcccgagtagctgggattacaggcatgagccaccacgcccagctaattttgtatttttagtagagacggggttcctctatgttggtcaagctggtctcgaactcccgacctcaggtgacccgcccacctcggcctcccaaagtactgggattacaggcgtgagccactgcgcctggccttcttttttcacttttttgtagagatgagagtcttgctttcttgcccaggctgctcttgaactggcctcaagggatcctcctacttcagcctcccaatgtgctaagattacagctgtgagccaccacacccagccttcttatttacatttttaaagttaactgtaaaacatcctcaagcaggtccttcaggaggtattcctgaagaaggcattgttatcataggagttgacagctccatgtatgtattgccgccgaagaccttccagtggcatgagatgtgggtggacctggaatatgatgatattgatgatcctgatcctgtgtgggcctaggccaatgtgtgtgtttgtgtcctagtttttaatttaaaagtttaaaaaataaaaacaaaaaccttcagaatcaaaaaagcttatagaataagcatataaagaaggaaaatagttttgtggagctgtacaatttgtttgtgttttaagctatgtattacaaaacagtcaataggtttttaaaattttttaagtttataaagtaaaaaagttacagtgaactaaatttattttttaagaaaaaagatacttttcatacatttagtgcagccttagtgtccagtgtttatgaagtcgacagtagtgtacagtaatgtcctaggccttcacattcagtcaccactcacccactgatgcacttagagcaacttcagtcttgcaagctccattcatggtaaatgccctatagaggtgtacaattgtatcttttataccatatttttactgtaccttttctatgcttagatatgtttatttattatttatttatctgggagacagggtcttgctctgtcgcccaggctggagtgcagtggcgcaatctcggctcactgcaacctccgcttcctgggttcaagtgattctcttgcctcagccttccgagtagctgggattacaggtgcgtgccaccacacctgactaatttttgtatttttagtagagatggtgtttcgccatgttggccaggctggtcttgaactcctgactcaggcgatccacctgcctcaggctcctaaagtgctgggattacaggcgtgagacactgtgcccagccaacttagatatgtttaattacacacacacttcccattgtgttataattgcccatagtattcagtatggtaacatgctgtataggcttgtagcctagaagcaataggctataccatatatatgtctatggtatagcaatagggtgtgtagtgggttataccatctaggtttgcataagtgcactctatgatgttctttgcacaaggatgaaataacctaatgaagcatttctcaatatttatcctcacggttaagtgatgtatgactatttatatatatatatatatatatatatatgtgtgtgtgtgtgtgtgtgtatatatgtgtatatatatacacgtatatatatatatatatatatatatgtagagagagagagagggagggagggagagagagagagcacataaggactgtgtataattatatatattttttccttatgccatatatattaaaaaagaaatatatatatatatatattttattactgagtcatcttatccaagaacatgacacgttttcctattgttcaaatctttcatgtcctttggtaatattttaaacttttcttcatataaatctcgcacctttatttccaggtattttgtaaagaagtgtttaaatttcttcacaaattgaatctctgcctcttttttgttgctattgcaaatgggatatcttcttcctttgtgtcttctgattgactattgtttgcatacatgaaagcagttgatgtttattaattctttaccatgttattccgtggaattcatttattgttgtcagcagtctcgcaattgattctcttggtgttttcagttacataatcttttcccccaaatactgatagatttatttcctcttttccacatcaatgcctataagatgacctaataagaagagacctcagttccctaccctaatagtctatctggaaaaaagatgtctcaacaaattaaccataataaagatacaaagggcagagtcaagacaagaagcaaaggtatctggaatcccagtctaagttcatttgcagtgttctatgcagcctacgaggtgagggcctgcctgcctcacccttcattactgttgcttctcaaatagccagcttagagctgcttctcaaaacccaaccataatttttccagactgggctgaaccaatgaaacaaaatatctaactaacaggggaggggagaagaggaagggtggaaatcatgctggctttcttgggtttgcactatggcttctggctaaaatcttcacaccagagcttgcctaacctttccatggtctcaggaatgggagaatctaccagaaagacccagaacctttgtgcaacagatctatgtccaagatatatcactaaatagcacattcttgttacaaaacaatgtaccaaataggtttataataatacttttcaaaaaaagtatttttattttgaataaaaatactttattttaaataacattttattttaaaatatttaaatactttatttttatttcaaaataaaatacatttttttgaaaagtattgctatatgctggtacacacatagaaaaagagatctagaggaaaattagttaagatgatgtcaaaagcagttatgagccaggtgcagtggctcacacctgtaatcccagcattttgggaggccaaagtgggaggactgcttgagttcagtagtttgagactagcctgggcaatgtagaaagactttatctctacaaaaaaattaaaaaaaataactgggcatggtggtgtgtgcctgtaatctcagctacttgggaggctgatgagggagaattgcttgaatccaggcaggtgaggctgcagtaagccctgatcataccactgcactctagcctaggtgacagagcaagatcctgtctcaaaagagaaaaaaagaaagaaagcagttatgtctagagattgtggctgtgaaagatgtcttagtctgttttctgctactataacagaacaccacaggctaggtaatctataaagaacagaagtttatttggctcatcgttctggaggctgggaagtccaagaacattgcattagcatctggtgagggtcttcccatggtggaagggcagaaggtggaagctagtgcacaagacagagagaggatatcgggctaaactctttcttttatcaggagcccactcccatgaaaattaacccactccctcaagccctcatgacctagtcacctcttaaaggccccactacccaataccatcacattggtaaataaatttcaacatgagttttggaagggacattcaaaccatagcaaggaatatttattttccatgttatctgtgtctgtaacattagtgtttttaagtaacaaccaggtattgcttttgtcattaaaaaaagaaagatagctctgacacatactaaaatgtttatgaatgaaaaaatgtgatttctgagatttgcttcaaaataatgtgggaataaagaaatgagtgtaggtagagactagccataaattgataaacactgaagttggatgatgggcaaatgggaatttgatatattatttcctctgcttttgtatatacttgaaattttccataataaaaatattttaaaaggaagtaattttatagacacagatatgaagagagagccacactgtagtttttaaaagaaacagcattgtatgtatgatattgcatctgtgtgcaatgatacttgtgtctctctctatattggtatacatgtaaaaaaaaaagacttagttcaagtaataataacaagcaagtttactgaacacttgtgagggtatcaggcagcatcttaagtatagaaatctctattttcttttttttcaaaatgatatatttaaggctgagcgcagtgatgcgcacctgtaatcccagcactttgggaggccgaggagggcagatcacctgaggccaggagttcgagaccagcctggccaacatggtgaaaccccgtctctactaaaaatacaaaaattgtaatctcagctactcaggaggcggaggcaacaaaaagatatatttaaagccactacctgcaggtcttttggaaatttaagtttttgctagcccagtaaattttttgacattcttcccataaaagggtggtgtcatgtgccttccttttgaacctggatgggcttctgttttgaccaacagagtacaacagaaatcccacctacctaatgttcacaccctggctctaccacttgctaattgtgacctgtggcacaatatgacctttacggctctatacctccttttccacctctgtataatgaggataatcataaatacctcataggatcattgtgaagattagatgagttgtatgtgaaattcacagaacaatttctgggcaggtagtaattactaaataaatcttttcttcattaacaacaacaacaacaacaacaagaaagagtatagcagaaatgatgcagtgtgatttcagaggctgagtcgtaaaataccatgcagctgctgccttgttcactgaaatacttactcacaggttcctgagccactatgtaaggagtttaactaccctgtggctgtcatgctaggaggaagcccaagccacacggagaagctatgtgtaggtattgtgatctacagtccccactgtgcccaacctttgagtcatcccagcccaggcaccagacaggtgagcacagaagtcttcagatgattctagtcctcaaccctgggagtcttcctcaataaggccctaaacatcatggagcagaaataaattatccctatggtgccctgtgtgaattcctgatcctcataatctgtgaccagaatacagttgtttttgttttatatcactaagtcagatggtttgttatacacaatagataactggaacatacggactttcaattgtatgagataattacatttggttcttatggttgaaatcactgtaaagagcatttttgtccttactcgcagttaatcacagtcttacactgtagtcttgtttacttatatttttaagttaatctattcttttggtttaaatatgtctttaaggagaaaaaagagtatttttgtaacgcatagtagaaacaattgctatgaaaattttaaatcatgctttcccatatatcattttaaatcatcttgtggctcaccagggacatatcccaccttctaggaattactgcattaagctttcttctgatcacaaaggtttctcctaacttttacatttgagaatgtatgaggttcccttccccaggttgtcattgcatgttgccccaggacaccctctctctgaaggagttcgcagacagagttcccgtgcagtgcatgagacagttaacattcatgggaggtgacccacatcaggaactgtgaagggtctgagattttaccctacttacaaactcatcagctagattatttcctgaatgctggcagaagacatagactcctgggtcagagataagaaactgtattacttacagagaaagtagatgctgacttcaggcttaccctgattccccaaacctctgaagtcctgaggatgtgatgcaggtgggcctgctcacacagagttgtgtcacaggagaggaatactgagctaagagaaactattgcttttacagtgagcagtcacaaaccttccctttgaagacatgacttcatccctcaaggttgttttctgcaaacacaaccctgagaaatggcctgagtaaagggcaatcagggtcttgccttcctggtgcaccagcaagaacatgcagggatgctcagagctcatggatatcccgatcacaagctgcatggcctaggccagataggctagggagtgctgtgaggtcccagagctaaaactccaccactcccttcccaactcctgaaagcatagcataatgtcagcaaagcagaaggagggatgttaaggggttcaccttgactccactttaatcagtaataataaaaggcgaatgatttgctcacttcagctttacttttattagtacaataatccaaacgatgctgagcttcttcagtttgcacattcaagggaaatcacactaacagcttctgtcaattagttactgctctagcaatgccacataacaatcaacctcaaactctcagtggcatatgacagtaagcactgggattacaagtttcctgatcagctggtggctctgcttcactccataagtaggctgggtggctctgctgcacgtgactcccatcctcttcctggaaccagtgggctaaccagaacatatttaactcttggagatgatggaattgtaggagagtttgcctagctgtgcaggcatattccaagctcatttgttttatgtctggtgctattccattggccaaagcaagtctcagggccaagcccgaagtcaaggggtgaggaagtatactccatccatggaggtggaggggaaggaggaaacgttcctgacaacgatggaatctactttctatcaaaagcccatggtttctcttcctactatttttcactcgcatggggcctcacaccctttttgcaaagtcttcttcgtgttctcccttcaactccaaagtaccaaagtacaattaattctcaaataatgaatattcacatgatagttcctccctcacctctcagaatggggctatagaaaaatttacactcattttatttcaattaagcaatatttcttcccaaataataaagaagaaacaaaacattgactcggagtttatgcctcttagctcctacatctgcccgctacactaggatctgctcctggaggacttgacaaagaccccagcactttatgttcaagcttttacatgcgcacgagaacttctgtttgagagatatgtattgtgcaattcctcataaagaatgactatagtttttatggttatataaggttataaaaggtaattaatttaggaacgattccgaaagaagagcgtgaataagagaacaatagctaaaacatctattttctttgctgccttgtagagttgaaaagaacatacttaaggaatgagctttacaaagaggttaaacaatacagtacctgactaagaatgttgttatggtaatatcttttccttaaaggtattttttctttatccctggtgttgtgtgtgtgtgtgtgtgtgtgtgtaagagagagacagaaagagagagagaatatcaggggacatgtgtatccctaggagtccctggaaggtatttgttacatgcttaaagaccagctattggcagccatttttgtagccccccagtcttgtcccagctgtgaacatccactgcctgggaggccacctgaaatctcctcatcttttccattgctggggatatctgtattcatcaaagattttttgttggaagtgacagaaaccgaactgtaactactttgagcaagaaagggtaattcattgtttcacatacacaaaccatggacagcacccggtggagccaataccccagatgactggattcagacacccaaaggccaccaggctgttctctcttttctctgctgctctttgcctgttggagccattcttaccagtcacaggcagacttctccacggggaggggaagatggactctggccactccagaatcacagccttccagctttagcaactcttggagttcagagaacatctctccattagttttggtgtaaaaagttccaggagatatctctaattggcctagcttgaatgacacgctcatggcacggaccaatcactatggttccatttccacaacaaaggtgggacgcaccgacatggccaccagggacatcattgggaactatgaaaccactttaatttgtatgagctatggagattcttatgagaactatcaagttggtagcaagccctctctcttcatctgtgccttaggaggcccatcaatgggaggaaggggatctggaagttcctcccatacagcagggtttggtccctgtgggtcagtaagtggggcttataaaattaaaagccaggtgtggtggctcacgcctgtaatttcagcactttgggaggccgaggcgggtggatcacctgaggtcaggagttctagaccagcctggccaacacggcggaaacctgtctctactaaaaatacaaaaattagctgggcgtggtggtgggcacctgtaatcccagctactcaggaggctgaggcacaagaatcgcttgaacccaggaggcggaggctgcagtgagccgagatcgcaccactgcactctagcctgggcaacagtgagagtctgtctcagaaaaaaaaaaaaaaaagttaaatgggtgatgttttagggttctctcagttgcacaccttgggacaagaatgcaaggccaggtagtttatttgggggatgatcccagggaacaccgttaacagattagggagtgacacagggaggaaaaggctgccaagaaatcaggtgtgatgaagaaattcccctctgtggacaactggagctcaatcccactggggacctcccggacacaagaacactcaggtttatccagtacaaggggagaggatactaacatcatcatcaattccctgtcattggctgaacaacatttctgtgagtacaacatctccagtacttctgtcttgtccagtgagtgggccaagtgtgccctggcatcaggagaaagctctcagcagggtcatagctgcagtcatcaccttagggactctgagtgttgaggaggcacaggcaggaccccagcagatgaccccggatggattttcagtccacgaaaccatgatatgctggggtttctccatcccgctgctgagtcaatgggaagggcctctcaggtcatattcccataggatggctcaaggatccatgtgtggtctggctgacacccaggccttcttgagggaggaagaggtgggaggaaacgaagatgaaccttttactcaaatagtatgaaatactccttcatgagccttttaaactggaagagactcggctacagttagtaatcagatttatgtttttctctctaagaaaatgaaggaagcacaagaaaaaattgaccacttatagaaaataaaggctactcaggagactgaggtgggaggatcacttaggcccagagggttgaggctgcagtgagctatgattgtgccactgcactccagcctggaagacagagaaagactctgtccaaaaaaaaaaaaaaaaaaaagaaagaaagaaagaaagaaaaaaggagaaagaaaataagaactatgcattttttgcaccttccataatctccatgattatatttggggggccctttatctgctttgatcattgccatattcattgcatgtagcacagtactaggcacataaaagatgcagactaatgatttattgaatgaatgtatgcttccatatttccctacgagtggccatttccctcccgagatccaagccgttgaatttcaattagtgtattgcagcttctcccagagctgggggagtgttggtattttttctcagacaattaagtgctttagtggagagtcgggggtgaagggttgtgctctgtgccccacacgagctgcgctggcctcacagaaaatggtgagactgtcagagcactggctggtgacggaagggctgtatgtgccccttcaatttaatggccttttaattagtatcaataatagctgggccgtccctcgctgcactgcatgtctgtctccaaggctcattatgaccagggatgaacagcactcctccaatcccttatgtcctcatagtcatgagaccctttgctattacataatgttgcaatccaccatcacacctggcccacagtagttgcttaatgggtgttacttcttttccacttttggccctcctttgaagccccagcaactttaggcattcgaaactgggcctctgcaccccattccttgtagccagaggggtggtagggctggagatgagagtcctcagagagaaagatggtagccacacccaaggcctctctggtgttcaggctctgtgagttgggatggggagatagatggaaccgctctgtgtgcgtagggcagggctgggaccggtaggcatccttctttgatgtcggcataaactctagcaggaaattttgaaataatctgatccagggtttcaaaccagcagcctgtaggtttgaatggctgtttattttttaaaaattcaaataaattcataacatttctttttcttttccctgcttttcctgagctgtatataacattttaatgttgggaaatttaacatcataacctacatttcctgtctctccaaggaaaagaaacaaatcaggtgatctagctacaatgggccccgattccatatggtaacagttggttgaagctgggtagtgaccgcccccgcttagaagggcatgggctcagccaccgtagtcctcacctgacctgcttcccttgtctgtgttatctacctggcctctgcgagcatttcagtttgcttcccccctcactgaacagctggaaagatgggctcagggagggaagtggtttgagttgtctaagcacatacagacaaataatggccaacttaaagccaggctattgtcaatcccagtccagtgctcctatacctcaccactctctgctgctctttataagtttcttcaactagacaggagctactgcagtgggaggtgcggtgaaaggagctcactcagaagtgtatgaatgtgacagctctgtctctgcttgactgggctgttgcttcccatctttgggcctcagcttccccatctgtaaaatggggctaataacaatcctaatctcttagatgtgggagagctctcagaactctgtggagctaggaaatgttattgaacatgattgttgtttcgattgctatgtaaccccaaaactttgtgatttaaaacaataaccattttatttgtttatgattgttcaatccagggtgggctcagttaggtggtttttctagtgatcttgctggtgatcactcttacggttgcattcagctggcaggttggctgatggcggggctcagcagagaagctgggatggctggcctgactctcttcacataattttagtctcttcccaccatgtgttctctccagcagggtagccagacttcttacatagttgttcagggctcccacaaatgagcattccaagaggacaaaccccagtatgcaggcatttaccaagcctctgcttgcatcacaactgcgatataccattggccaacatttgtcacattgagggagaaggcaggactcaactccagagatggggctgaaactctggaccagattgaagactaggtgaacagggaagcagtgaaagcacctctccatgagacatacccagcaacaccacgtcagtttaccacagtgatggcaacacctaaaagttaccacccctttccatggcaatggcctggaagtatcatcctttgtccagaaaattctgaataacctgccccttaatttgcatgtaattaaaagtgggtataaatatgacgacagaattacccctgagctgctactctgggcatgctgcctagggggtagtcctgttccacaaggagcagtacctctgctgctgttggacactgctgctccaataaaagttgccatctaggctgggcacagtggctcacacctgtaatcccagcactttgggagtctgaggtgggtgaatcatgaagtcaggagatcgagaccatcctgaccaacgtggggaaaccccatctctactaaaattcaaaaattagctgggcatggtggtgtctgcctgtaatcccagctactcgggaggctgaggcagaatcatttgaaccagggagtcggaggttgcagtgagcagagatcgtgccactgcactccagcctgatgacagagtaagactccgtctcaaaaaaaaaaaaaaaatgttggcatctaccaccacctgtttgcccttgaattctttcctggatgaagtgaagaaccttctcgggctaagccccaattctggggcttacctgccctgcatcaatatggcaaagtccagaatcaatgtgggaggggactacataagagtatgaatgccagaagcatggttcactggaagccatcaaattaacagtctactgcaattattttcatggggtctaactaacggctagagtagggagagtgggccttcacctgcaaggtgaaactggatagtccccaggtctccctactcagaatgttctctcctgatgaaccagcccagatttgatgtttacctttactttgcagctttggcccagcatgaccaggctttcagagttcacattagatcacagcccacagtgccaatccaaatgactggtatgactgaccatggagaaggactccatggtggacagggggacagaatgtcctgattggccaggcctgggtcaggtgccatcaccagggccagggggaatgaagtcagccccttctgaactaatagtaataatattaatactagatgacatttggggggtgtttactatgtgccagtcactcttttaaacattttatctgaattaactcatataacccaaaaactccatgaggtagatactattctccacatttcttatatgaggcacagagaggttaggaatttttccaggttcacatagctggtcaatggcagagccaatattcaaacctaggcagtcagactttagtttccatactctttatggcctggaccaagaataggagtagaggctcacagaaaaatcagatgctggccaggcacaatggctcatgcctgtaatccaagcacttacagggagtctgggacgggcagattgctcgagcttaggagttagggaccagcctgaggaacatggcaaaaccctgtctctacaaaaaaatacaaaaattagctgggcatggtggcacgacctgtggtcccagctactctggaggctgaggtgggaggatcacctgagcctgggaagttgaggctgcagtgagccatgattgcagcactgcactccatactgggtgacagaggaagaccttgtctcaaaaaaaaaatttttttaagtcagatgctgttaagaatattgggagatgatacagcatagacaaaaatggtatctataccttgcaactgcccactaataaccataaagacatgatgtgccatgtaaagcatgatctaaggaaaaccttcatgttctttatgcagaaacttgggctagatgtggtggctcatgcctgtaatcccagcactttgggaggctgaggtgggaagacctcttgagcccaggagttcaagaccagcctttgcaacataaggagaccctgtctttacaaaaactttttttaaaaattagctgggcatggtggtacatgcctatagtcccagccactcggaaggctgaggcagaaggactgcttagctcaggagttcaatgctgcagtgagctatgaccgcaccacagcactccagcttgggtgacagagagagactctgtctcagaaaacaaacaaaaacaaacaaaaaaattgggtaattgggtatcttcctctctactccagatgggattcttttagccttaggttccccttattggatccaaagttgagaagctcttgggtcacttagtcaagaattcctgaggtatagcaaataagaacatctgggaccacatgttaccaacatctggtcacaaactcttaaaataatatggagaagtagatttggagaaacagatgaagaacacgagggggaatgtgctgggtgacacccacagaaatgcacctggggaatcatgattgaagcaaggatgattgaaaagtctctgcaagtatgtgtgacacttctgagtattgggggtggggtgggggtggaaggcctcatgtatctgttgtttcctgggcactcaatcctttttgaacaagatgctctagagatggttattctcattagaacaaatgttactgacccaatgtcttcctcgtttatatttcttctaatgtgcttctgcttgagcaagtgagcccttaatgtccatttcaattaacatcactgcatctgatctcagtggtgtcactcatggatgcaatgaggggcggagaaaggtcactgggaagtggggagaggtgtcccctcttgtttgaaggcttgaagtcactggtgagggaggtattgggagggaaggtgtggaatgatttgctccctacttaataaagaccatactttaaagatgtcagcctgtcttttgtttgataaaacactaatgtgaagacctagttgcaaggcagaaagcagggacaagggctctgagggctaagccagtgaggaacgggagacacacaaacttgcattgacttatgagagcttcctccataaccttgagctccctagccgtcagtcacagtgggtgggaactgtatgctccaaatctgctatccagtatcctggggattcccagggatggctcaaagctggtggtctgacaccaacacttctgtgtgtggcctgatctcagcatggaaatgggatggaccagagtttggggtgggtgtagcagagcaagcctcagggagaggtagacagtcacaacctgccaacccttccttgctcttgttttccatccttccttcccttccttccttcctaacaagggaatttgttccctttgtgcccttccagagggaatttgttcaggaaagagaaaatatggatttatgttctccaagacacaatcctcagggatgattctctctcctttgagaagtcagagcatttgttttttcatcatctttgccatcaataacaatcattagaagagcttactatttcttgagcaccttctgtgtatcaggggacattacatatattatttctagccttcacagcaaccctcaaggtaaatgtaatttatgcccactttacagaggaggaaattggggcttagagtgcttgaggagcttgtccagtaagtggattgaactgggcccggttcattcgatttctggctccaatgtcatcaattacttgcaatatatacttgcaagggcctggctcctggctaagacctgctaatggatgcatctgaaataagaaatgtcttctattcaagttccagacgtccacatcaacaagcatcaaacacagagtttaacctgcatcgtactggcagtcaagatgcaagggctgtagtcctggttctgcaactcttttgatgggcagctttcagtgtatatgtgtgaactcccctctccagtagaactcccctctccagttgtcatttctccatctgtaaaatgggcaagtttgactaaatatctccaagagtcagctcagttcaatccaatctgacagcacccatggggctttcctgtgtgactgtgccagaaggaaataaagatggacaaggcagacctccattctctaggtgagctaaatgtgtgctctaatagttatacataaagagcaacaaagcttggagagcacggcatctcatttagacttggccagtggcaatgtgtgtggcacaggagatgaggcaggcttcagggtggaggcgccattggcagttgggcttgaaaaggaaatagaacatgtggaggtggagacaggaggaagcttttcccagccaacaccacatggagcagaagaaccacctggtcattctataaaattgtgagaagtaacaaatcattgttgttttaagtcactacattttcgggatgatttcttacgtagtaatagatgacagaccccaaaggtgggtgtgtgattataggctttatcctataaaggtcagagattgctcatttttagaccacagcctacagtaattggcctgcagacataattcatttggcttgcacagggtttttaaaaatagttgagccaacatttagaaattgggagattttatatgaaaatccagatttgggggctctcttgaagaatcctacatctcagcacctgcattctaggaacagtatgcaacacacatcctccagttcatgacagtgctctccactccctattgtctcatgcctaaccttctttctagcccctgtagacacctgagggtttgctgttgttgttatttgttttgagaagggtctcactctgttgcctaggctggatgcagtggtgtgagcatgtctcactgtagccttggcctcctgggctcaagtgatcctctggcctcagcctcccaagtagctggaagtacaggcacatgctaccatgccagctaattaaaatttttttttttgtagagacagggtctcactatgttgcccaagctggtctcaaactcctgggttcaagcaatcctcctgcctcagcctcccagaattctgggattaaaggaatgagccactgtgcccggcatgacatttgagtttttgatccatgctgatgacatggcaatgggaggctattgaaggttgttttttgtttttctgtttttgaggcggagtctctctctgtgtctcaggctggagtgcagtggcatgatctcggctcactgcaacctccacctcccaggttcaagcgattaccccacctcagcctcctgagtagctgggattacaggtgcctgccaccacgcccggttaatttttatatttttagtagagatggggtttcaccatgttgcccaggccggtcttgaactcctgacctcaagtaatcccccccacctcggtctcccaaagtactgggattacaggcgtgagttaccgcgcccagcccattgaagggttttgagcagagaaggaatgatgagagttgggcagtaagtaatgtattggttgggggtaactctggggcaggtgtagtgaaaatctattattcaatctgccccagagcatgaactccatcttttgggaaatgcatctttctctgaccatatggttccgatggggctgccatctccctgtacgtcccacttccttattcacagtattggttagagaatggcacctggcttaagttgggccagtcacagcacctggttttccacccatagatgattggtctagggacggggacttacctatgttggaccaatcaaagtttttccctaaaattttgtccttcagaccagaagcagaaatcctcagtctctctccggtggaacgggtgagagttgtgagtggtgagcgctgctgcagccaggtgcctagccttgaggagaaaagctcgcatacagagagaagagataaaggactgggaggagagtcctggcaacattcaagcctctgcgctcaccacttcagtgcattttctgagcctggttctccagccttcccatcagttctgggagctccccattccttcctgataaattcctttgctgcatctgttagtctgagtttatttatgtttcgtaatttgcaaccgagaacactggtgataaccgggggctttgaggcaattccaggagggctacttctcacccccgtcagggaggagccaagacagggtttatcctcaaatgcagatcccctgaggtcaggagttagagcccagcttggccaacatgatgaaaccccgtatccactgaaaatacaaaaattagccgggcatggtggtacacgcctgtaatcccagctacttgggaggctgaggtacaagaatcgctttgaacccaggaggcagaggttgcagagagccgagatcgtgccactgcactccagcctaggcgacagagctagactccgcctcaaaaaacacacaaacaatgaacagacaaataaatgacagaacaagaagacaaactagagaacatcttgagacaaggtgttcagggaagagttcttttgagaaggtgatattaaagcgagtttggggaagaacgtcccaggccttgcgctcagggtcgtcaactctttgatttctcttccttttgaagcagggcagggaggtcatcaaacaacagaaggacaattataactgctggtatggcaaagccaggactctgaattcaaactctgctccattctcaggaatcccgtctgttaagcaggttctggggaagcgatgtgagtcatgaaatcacaggtcggaggaggcatcgagaatatggtcagttctcaactttcagggaaatccatagctgaggaatgaaggacaacgggcttctcgtgctctcactaggaagactggttcaccggaggctggaacactgaaagtgagaaatcccgacaggagaaatgtgtaggagagaggactagcacctggatcaagttataaaacatctcctgcatctttttcggagatcacccttagcgcggcctctccgcccagtcccagattaggcagcgaagagcgaccctcaccttgtctaggtggcacgttccttaaaagcgaaaggaccaggagtttcttcctgcctcgtctcttccggatccctcctgcaccgcccacagcctgcagatttgagcgccatctccaggccccgcccacctcaagcaccacccctcagtccttccttggggcacgcctccttccggcacccgcccagagtagccacccccggggcccctcctcccctccctgcttccgggcccgcctccttcaggcccgcttccatcttcctcccactctaagcttctcttcagccccgcctccctccacccgtggctccgccctctgggcgattctccatttagccccgcccacagcatctcctttcaagcgctgtcctggttcccggctctccatctcctgcacggccttccccactggtccggcgaccctcttcccagggcctcatcaccatcttagctccgcccctacttcggctccaaacctgtgcaagctgccctcttcccgccccagccccgcctccccaagccgcgtctcagtccctcctccctttcaggccccaccctggccccgccttcctcccgtccccgccgaagctctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagtggggactgcgggcgtctccttaggggtgcggggagggtgtgtgctttgtgcctttccgttcactcacttcttccggcaggccgctgcctatttttagaaacttatttctgcccttcggggagtcccgggagcccgagtaactctaggccccctccgccgctcctttctcccactcggacccgccgccccgggtccccggccccagccctccgcgcccggtcctgctcccggcgttccctgtctgctctctccgcgggccaagtctgggccagtagttggctgggtgggcccgcgcccgctcggaagttggagtcttttgtgctcgtgccccgccccgcccggcgaggggcggagggaggggaacggaggctgctccggggaggccgcaggcgggcccggccgcggctgcttccggctctcctaacccggactgggtctacgggctcccggaggcgcgcagagcttgtcctgcctcggctcccgcctcttctgggctctttgcacgccttgggctcggagagaaacaacaacgggccctcgaactggggccgtatccgcgtttcactcagcctccttggcggccgagtcttagtttgcctctcggtgacatggggggaaagaaggaaactcgctttgcggggtgttcgtggattcagggagggaactaatatgtgaaagaagtgtttaacaccgacagggaacatttaatgagacttcacccaggaacttcccaagccttatttcatttaatgttcacaacggccttctggtttatcctcatttacaaaagcagaaattaaggcgcagaggggtcaagtaattttctccaagtcacagtagccacagaagtgcaaaggagtggtgccagtacctattatttattaatatttcctggtgtgagcatgtatcatctcttagtgcagagggtatttttacctagccttgggtcacaccatttaattaggggcataactctgggttttccctgacttctgggccgttgtccactatactgtggatgaaatcccattctggggttaccatagttctaaagggaaaggtttggatgaattccttgctagtgttgcggcagttagaagttgatggatgcagactccaggtctcagacacaactcaaattccctggggttttggctcaaggaagctttgagactgtaaacggtgggatccaccctttagtttgtgtgtggtgtgttcctcctcccagaccttgcaggttctctgtgtttagatttatcgatcctagtttgatgggggttagggggagtagctcaagtcatctgccttcaaacaaatattactcctattttcagataaggcccagagtggttaaagtgaactaaaattaactttggcaaatgttccagtttttcaatgtgatccggttggagggagtgtctaaaaatcaggcaagggagtttctgggccaggtcttgaggagtctcttgatgttcacattagttctttggagtctggtacgtctgtggtgcctggccaggattctggatttacgagtcctatgtgggagctgaaaggggtcttaccatctggtccaactttttcatatctgcctttccccgcttccctgttaactgaaccttggaaaggggaagtaagttgtctgaattcagactgccttagtgtcagagtgagaactaaaatttccagtcttcttcctcctaatccagtaatatttttatttctcccataccttgccacttcttaaaagggcacgaaaccacttattcaggtcttaaggtcaggaatcctgagtaattggaaatcccaaggaagttttatagtccccacccctttctgtgccttatggttagtattaagaggaggccaggtttaagcacaggtgtactagttctcgtaagtcaccacttcggttttatgtgtttatggcttatatactcttccataaccattatctgatttaatttctaatccatttctgtgaggtagtttgcagagcttggtttatgtctctttttttactgtgagggaatggagacacagcatagcacttgccttagatgacagaatgagtaagtagtgaggacaagacacctctctggagcagaggatttgatttgacatcataaactgagccactcattgtggctctctgagcctcagtttccttatctgtaaactcatagggttgttgtggggattgttaagaaaatggctatgaaagtgctttatagtggtagtaataatagctaaatttattaagtacttaacgtgtaccaccagtcaatggactgaggactttatggactatattactaattcttagagcaacctatgaattaagtactattattatccctgttttatagaagaaacaggcttagagaggttacattacctgcctcagggtcatgtaactggtaagtggccatggcagtattcagactgcagacagtataaccttaaagctggcatgctttttttaaaaaaaaaattgtggtaaaatatatataacataaaatttaccatttaaccgtttcaaagtgtacatttatgtgacattaaatacattcgcatggttatgcaaccatcatcactgtccattatcttccccaactgaaattctgtacccattaaactaactcccccttccctcctccctccagcccctgaaaactatcgttctactttctgtgaatttgactactctaggaacctcatgtaagtggaatcatgcaatatttgtccttttgtgcctgcaaagctggcacacttagtgtcttctttagtctcagagtgcattgtaaatgcaaaattattagtcctcacctgcagcagagatgtggcatgcagctccagggcaggaacccaggcctctctgagtaagacctacttttctcccccttaggttgatgttctgtatcactgaagcctgttttgaatctctgctggccccccagtatctgcagaagagaccttataccctgttttttttggagacggagtctcactccgtcgcccaggctggattgcggtggcacgatcttggctccctgcaacctcaacctcctgggttcaagggatctcttgcctcagcctcccgagtagctgggactacaggcatgcaccatcacgcctgggtaatttttgtatttttagtacagatagggtttcaccacgttggccaggctggcttcgaactcctgaacctcaggtgatcctcctgtcttggccttccaaagtgctgggattacaggcatgagccaccacgccaggctattacacccttaaaatagaaccgagataactccccaccctcaccttgtttgcacctgcccttctgacagtccagggtttggggatattgggctgcagttatcaggaataacagtgcagtgacagcagcttggatcaaaactactcagaatgattaagtagatcacctttatgaaatgttccctctttcttccccctttttccatagaggcacacaggagggattagcttttgggttcttggaggatgtttatggatactcactgcttgcagttggttaagatggagttagatgctgcatatagcctttcaaaatgccctttgaccgttttctgtgttggtccatttaggggagtgggctcttcatgtttatgaagatggttggaatattgtcctgataacaactgggggttgggagaggcagtgtctcagagatggttaatagggtaacaaacacatgatcatgtgtctggtcatgtcacactctccttaaaaatctgatggccccaacattgcctgcatattaaagttcaaacaaatatgacccatgaggtcagtgtgttgaatttattgaatagaatcttgtagttgagggaccttacagtcatttagaccagccacctggctgacatttgagttggttacttgttgagattgtctttctttggatacctcatttttggaaagtttttcattcactgaagaattaatgagcctctgttagacctggtgctacgcttagggatttgggtttgtatagcgtagtgggaaagataggcaaggaaacaggcagtgtgagaagtgttgtcacagggacagacaccaggagagcacagaaaaatgatgcctaacccagcattggaaggtcagggaaggctttttaggaggagaagttggttaagcctagccctcaagagaacagacataagccaggaaaagaagagatctggggagtcagggaagaggcagagataagactgttctaggtagaaggaacagtaagttcagaaatggtgataataggttaagaccatcccgaaagtacgtactgttactattcccattctgtagttgaaggaaacgggccaagagagctaaacaaatttctcaggattcttgggtggagcataatgcttgaggtgggtggatatggccagacaggagactttcaaggtaggcagagcagaggccaagtcaggaaagggccttcttgcctgtgttgaggagtttggacttcatccggaggtgagggggccatgattcaatgtgcattttggaaggatatctctggctgcctgttcaggagcggactggagagctagaacactgtgggcagagagaccagttaggaggttggcaagaggtgatggtgtttcaaatgaaggttgtgggagagcgtgtgcaagagtgtgtgcagaaaaaagatggaattgctgggcgtggtggctcacgtttgtagtcctagcactttgggaggctgaggtgggtggatcacctgaggtcaggagtttgagactagcctggccaacgtggtgaaaccccgtctctactaaaaataaaaaaaaaattagtcgggtgtggtggcaggcacctgtaatcccagctatgtgggaggctaaggcaggagaatcacttgaacctgggaggtggaggttgcagtgagctgagatcgaaccactgcactccagcctgggtgtgagactccatctcaaaaaaaaaaaaaaaaaaggaaagaaaaaaggtggaattgagtgatgagacaaagattattggtgtggagggtaaggaaggaatcgggatgacatctggtttctacctggtgcagttttgtaaatgggtgctgtttattgaggtgaggacacaggagaagaaggagcacgtaagggagggggtagggtttcttatgcagggtctccttacatatgctttcacttacctctggttatggattctagttctttgtgtcaggtctgaaagggagagagtgagagtatggcacaactggtcatgttcctggctaaactggatgatgcaaacattagtttaggaagagaggagatattcaatcctagacatccgggtgtggcacagcctggaaactgcttacgttaagccaagaaaagtttacattttatccaggctacatcctttggcactggtcttttcgtgtactagtgtattcctaagtccctctctaagccgaagccacttctctgcttactctctgctaggcactgggaaaacaaagataagtaaaacgtatcctaaggagctcatgatccagaagggcagaagtctcagtagcttggatacagcggtggcctggggagagggtggatggggcagggcagggtaggacaggatggagagggacccggaagggtttctattagggataggagtcaggagaccccactgtgtgctccagtctttttctcgggtggcacgtgtctaggtttattcatctgaataatgactagatgacccataaggtcccttctagcaattacattttatgattctaggtggtggtttagataatatatctctaggagaggtatttctttcttcttctcccccttcttagtttggcattggtgaggggatatagtaggggtggagatagcaaggttttcacttgagtgtcttggtcttattcaattttggcttcatgtctatatagctggaagggagaaaatgacagccgtaatgttaacctgcttgtcctacaacttccccctgggtactgtaaggaaattgtgctcagggtgcagctcacagacccttaggaatagagacagagtgcagtggaataaataggaagtcttgtcactagcctgagcatcgtttggtcagtgtgtgggctggactaaggtcctttctttttatagccctgtttcctcataaaatcatctgggggggtccctgaaattctataaaggcccaaagagtgggggtggggaggtagggacagaaaaagggttggaggtccctgtctctctcacttctcccctctcttcgaacgaataagtagaagcaggtatctggccaagtattaatgttggtcatcttttgtttccacagccttgccttatttcctcagtgttagtgtcttctgtcatttcataatggctttcatggtaatcaatgtcctgtacctcctgggaggaaggaaggaaagatgggatattgtccctgggctctagtctccatctccagaagagccatttaagacatccactgccccctgttctctattctggggttggggtagggggttgtggctgaatacttgggtttcttagagggtacatacttgagtttcctagggagtgctctactaactaaagtgcaaatctggctatcttcccaacacaccaatgagtttgactggggaaaatagcagtcagtgggcttttgttgcttgccaaacccatgttaattgtaattatctaatattctgtgggatctctgtcttcctgtctgtgaaacaagggaattggactagataatcttgagtgatatttctacctttttacagttttgtggaagtggcttgagaatttatctctggaaggagaaagggctttgctaaagtattgagagtatctcagagggttaaattctgggttcacaaaagatacctttcagtatataaacagatggatattgctttttagagtggacagattgctgaaaaattgcttgtgagatgaatttatcaaattgtatgctgagttccattataaacttggagctgtagcctcatgggacaaacttggagtccaagactataaaaaaattacattaaaatatgtagcaaactgtttaaaatcacataataaaggaaaaataaaaaacattttaagattttcacacaatggtaataatggaaaaacactagaccagaaacttgcatttcctaagagctttagcttatggagtagatgcctctactgaggttacctggcccttgaagtgccatctgtagagactgaatagctctgttatttgtcaaggtaagactcattgctttattccaagtaaatattctcttttagaatgccaggtttggaagcttaatgttattggccagattttcttcattccagaggcatttatctggtatttagctgtctcctgtttattttattaaggattttaataagcttagttaacggtactgcttacatggtgtctcttgatctatttgtctagtttcctttgaaattctttgtgttagtgaaagcaagcccagcagtagatttaaaagggtcatttccataacttcatttatctagatttgggtttttttggtaagagatatgaccacactatactgagaaatcgaatgttgtttcctttttttttgagacggagtctcgctctgttgctcaggctggagtgcagtggcatgatctccgctcactgcaagctctgcctcccgggttcatgccattctcctgcctcagcctcctgagtagctgggactgcaggtgcccaccaccacgcccggctaatttttttgtatttttagtagagacggggtttcacagtgttcgccaggatggtctcgatctcctgacctggtgatctgcccacctcggcctctcaaagtgctgggattacaggcgtgagcagccgcgcctgaccacgtcgtttcctttttacctgaagcattaatttaaggctttggaattttgtttttgcggatacctgtaaggtggtactgaggaatggtgctgctgccaaagtaataatgagggctgtgcgtgaatcagttgagcacaagaataacttctcttcagactttaaagattcaccctaattgattcttacaccaattaaaatcaacccttactaaaattagggttcagaggaagttacttagttgccgtggcatgattatttatgcttgggagtcccaacagccttccatccctaatctcaaccattcgttccaggaatttggagtacctcctatatgttcttcttatggaaaacataaaaaccaacaagacataattcctgtccacaaattactttcagtcttgagaggaagacagataagtaaagcaaatccagcctgccgccctggctcatatatttggattgagggttcaaacggaaaataacataattggtggctgtatcagtagacaaggagaccagtttgataatctgacttccagtgtgtagactttatttttttggcattcccttctctcccttctgttttttacagatatttatcctctgttgctaaggtgtccaacacccagtgtgtaaagtcaagaatattagagtaggggacaacatttcctttcaggtttaggtgtccagatatctgcatctggacacccacacagttctctggctggcttcaggaagatttggtattgtctcgcttcttatgtagaaatgaagaaaattaagtttcatgttgaattattttaagttttattatgctctattttgaaataaaatagctctattttgtatgcaggtggaattatctgaggtgtggtttctggcatttgatcagtctgtgatttgataattgtgtttatattgtagttcgtgaagcccattgccactgccagccgcctttgaacactttgcagcaaggagccctagtaaatggaaatggtgggcacattgaggctctcctggttttgaagggctcttccctctttcctacccttcagagagaaatattacttgggatgctgtgttgtgctcccgatttcttccaacaatttagcattgcctgtggggtctggaataataaggccatgtaaactggagatgtcatcttctctctctttgaagttccattttctcatctgtgaagtggggttaacactccatatcttgccttcctcacaatggtattgtgaggagcaaattagaacgttgtaaaatcacatgagacaatttatatgtgaagaatccatcagtcatttgtcagtggtaataggtaagtggcagaattttccttaagaggggagatcgatctctttgtagggagcagggagagtgatctcagctggtctctgggattgggaaaaagtgtgatgaaagcatctggacaggggcaatgatggagcaaaagactggaggtgaactgttcagcgggaacagtgagtaagtgttctctaacctcatactgtaagtcctaggttaggcatatgtttacctttggtaaatatgccaaacagtttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacagggtttcaccgttttagccgggatggtctcgatctcctgacctcgtgatccgcccgcctccgcctcccaaagtgctgggattacaggcgtgagccaccgtgcccggcctccaaacagttttaaaaggtctaccaggttacatggttagtgatgagaaaattgctgttgttctgtgttgttgtaaatacttggcattgtctatctttttcatttgaagccattctggttagtagttatagatatgaattttaagaaccatactatgaattctcacatagcaagtaccataaaggggtacaatgattgggaagttcagaaggggaagagattgcttcctttgtacatggaggaggggcagagggggagttcccaaggaacatttgtggaccagtgagtatttgtgctggactttgtaggataaggataatgaccatctgttgtccaggaccattttaatttctaatattctgtctggttgtacttacagattatgaaataccaatcaatattgccatgtctgtaccttatctcccatactatgcagaagcaacacccagttatcttttctcaaccgatgtgcttcccttccccccttttccagaaagaatggtcacaggtgattaggctgcagagatggagaacattctgtgcaatgggaacaacttgagtagaggcacagatgaatgactagaccgagtagtatccatattcctgctaatgagcaggtggtggaagtgtcccacactttggagatgggtgataccttctcatagcctctcagagcagaacaaggtcatgtcgttatgaagccaatttgtatttaaactggataaaaggatgagaatgagctctttgcttatacttacatcatttcaagaaagaaattaatccagtaaacagtcatacctgaagtatatcaaaagagagtttttcttcttaaaatggttggggagggaatactaaaacctaaagaacttagtctctcagagctcatctattagttgtatatttgctcagggaaaaattgccatttctttgtcagcttttatcctgccggtggaccctagctgggtgtttattttgtgtagttttaccaaatcactttgaaggttggcatgaacattgatcatgtcttagagcctttcctctttgttctgtcagcaaatattagaaaatgtaccttaaattacctggttggggaaaatagggtggccctgcctccttccagagagcagcattttcatgttaaacattagtcagcttctgatcctgtgtcaggtcgcggggtgtttgtcaagatagacagggtgctagagatgccactagggacattcactagagaatttctaggccccctctcgaggagactagtcgagtagttgatttaaaaatctgatgggctgggtgcagtggctcatggcctgtaatcctgacactttgggaggctgaggcaggcagatcatgaggtcaggagatcgagaccatcctgacggagtagtgaaaccccgtctctactaaaaatagcaaaattagctgggcgtggtggcgcgtgcctgtaatcccagctactggggaggctgaagcaggagaatcacttgaaccagggagttggaggttgtaatgagccaagatcgtgccactgcgctccagcctggtgacagagtgagactctttctcaaaaaaaaaaaaaatctgacctgggttttaaatgttaacacagccttgcatattagtgatattgagtgtccactgtgttgagatatcatacttggtaccttttgtttatactaatagagctaatatttactgaaggttactatgtgcgaagccttttatacatataaaatattatttcattctcacctcaaccctaagaagtaggttgtattgatcgtgatcatacagattggaaactgagacaaagggaggttaagagatatgccgtgggcaaccactggtctttttatagtcttcacagatacgtctttgcagaacgtcatacagttggaatcatacagtatgtagccttttcagatttgcctctttcacttagtaatatccatttaagtttcttccatgtctttttatgttttgatagctcatttctgtttaatgctgaataatatttcattgtctggatgtgccacagtttatccacctattgaaggtgtcattggttgcttccaaattttgtcaattatgaataaagatgctataaacaaacaaaagaaagatatgccgtggtcacgctgctgatatgatagatggagttggctaggattgaaacctaaccaattcctctttatttttaatatggaaaatttcaaacatacacaaaatcgaataggttaatgaaatatgatttacccatcacttggcttcaacagttagcaattcattgtcagtcttgtttcatttatacccctacctacttttcttcattttgtgctttgaagaaaatctcagctatcatattttgtccttaaatatttcacagtgtgtctctaaaagatgacttctaaaaacaattataatgccattaccatctttataaagtgtaacagttcctcagtaaaatcaaaatccagatgatcgtgttcaaatgttcgattgttttgtaaatgtcacaaccttattttgatagtttgattcaggattcatataaagtccacacatggttcttaagtcttcaagtctcgtttaatttgtatggtccctcctacagtcacatgctgcatagagatgtttcagccagtgatgggccacagatatgacagtggtctaatatgattgtaataccattttttttttactgtacccattgtatatttaggtgcacaaatccttatcattatgttacagttgcctacagtattcaacacagtaacatgctgtataggtttgtagcctaggagcaactatacagcctatgctatatagtctaggtgtgtagtaggctataccacccaggactgtgtaagtgcacactggtgtttgcacagggatgaaatcgcctaatgatgcatttctcagaatgtatccccgttgctaagtgatgcatgagtgtagttatcccccccattatttgttgaagaagctggatgtttttttctatagatttttccatgttctggattttgctcattgcattcctatggtgtgttttctgtgtctctttgtcctctgtattttctgtaagttgttggttaaggacaatttctcttaaccctcatgacaaccctgcaaaaataggtattgttcttattttgtaggtaagaaaacagactgagagaggtcgggtggcttgtccaaggccccgcctggatttgaacacaggcctacttgtctgcaaagcttttgttccttcatcactaaaccactctgtgagcttaggcaaatcattttaagttctctgggtcagccgggcacacctgtaatcccagcactttgggaggccaaggcaggcggatcacgaggtcaagagatcaagaccatcctggccaacatggtgaaagtccgtctctactaaaaatacaaaaaattagctgggcatggtggcgggcgcctgtagtcccagctactcaggaggctgaggcaggagaatcgcttgaacctgggaggcagaggttgcagtgagccaagatcatgccactgcactccagccttggtgacggagcgagactccatctcaaaaaaaacaaaacaaaagccaggtgcagtggctcacgcctataatcccagcacttcgggaggccaaggagggtggatcacctgaggtcaggagttcgagaccagcctgaccaatatggtgaaaccccatctctactaaaatacaaaaaattagctgggcgtggtggtgggcgcctataatctcagctacttgggaagctgaggcaggagaatcacttgaacccaggtggcagaggttgcagtgagccaagatcgcaccattgcactccagcctgggcaataagagcgaaactccgtctcaaaaaaaaaaaaaaaaaaaaagttccctgggccttagcttctttgtgaccatttgagtgcctaccatgttatggtgtggtactagatggtgtggataatacccatatgagtaagactgtcttcaaggagcatatagtcaatcagggactgcaagaccatatgctatttcagacaaggtcattgtgggactatgggatccttaatctcccttaagagtttcctgcctccctgtcatcctgtcttgctgttttctgtgccatgctattcactgttgcctggtaccttttcctacaaaccatttttgttgtattctccctgctgtaagtctagtatggaagttttggtaaataaaagttcttccagcaataaacttttctttggattgagttactatttcaagggcagctactcttttttttctcttgtgtttggcaaaggtgttattgcttttatggagatgctgaaggaatctggggaacatagaataatgatggaatgaagcatggggaatgccatcctgcatcaggggagaacatatatttagcgttgtactgttcactcccaacggcatctgactgtaatgggggtaattttgctcttttgcaaagacaaggaacttttagttgtgatgttcagggagcagaattttaaaggtattccatttaggggaaccaagctgctgaactttcatcctcattgggaagtccttggggcactcttaaatcctttctgttccagatctgttcagtcttatcctctagatcagaggtcacatactggtagccccttgggctgtatctggcctgtgtacatattttgtttggcctgcagtagtggtgtcattgttttttaaattgagacagggtcttgctctgttacccaggctggagtgcagtggcacaatcatagctcactgcagcctcaaactcttaggcttaagctatcctcacgcctcagtctcctgagtagctggaatgacagagacatgccactacacccaagtgttttttaaatttttttgtagagatgagttattactttgttacccaggctggtctcacactcctggctcaagcagttctgctaccttggcctccgaaagtgttgggattatgtgtgagccattgcacctagcctctatttttattttgagtggaataaaagcctggggagattaggactgcctttcagtggagatagtatgtatgtgtgagatgagaggtcctggcatggggctatgaaggtgactggtttctcatgaaaaaggaggaagatttttgagaaagtagcagaggctagagcctgacgctgaccatgagcaatttttccatttataagagtgggggtaggcctgtcttctccttgagtcctctaccagggatttgttttgttttgttttggtgtgtgtgtggtttttttttgttttgttttgtttttgagacggagtctcgctctgtcacccaagctggagtcagtggcatgatctcagctcactgcaacctctgcctcccgggttcaagtaattctcctgtctcagtctcccaactagctgggactacaggtgcgcgccaccatgcctggctaattttgtatttttagtagagacagagtttcaccaatttggccaggctgatctcgaactcctgaccttgtgatctgcccgcttcagcctcccaaagtgccaggattataggtgtgagccaccacgccccagcctctaccagggttgttatattgtgactccttgtacactggctagtccatgctttagaagcttgtaaactgaagcaaagagacatggcttggatctttgggcaactctttggagcttcggccaaatttggcagaagctttgagtttacaacttcatgttcttcatttctctacttttttccacattctgcttccttattgactggcttctttagacagcatatttgttctcaagtttgtcaaagccacaccatttcctgttgtttctttgatactcaagcccagtgtcagttgccgtttatcaccagagtatagcactttttttgggaaacacttggtcaattcatttttgctacctgcttgccaccaaggtccagcccagctctagaaggaactctaatattgaagagactttacctagttaaggtgctggtgaatcccctgcgactaagtgaattatcttcattttactgggaacttttggtgcccttattggctgataaatctgtctcggcctatcttaggacttcatatggacagcaaactagtcaaggctcagtggatcatgtccttgtcaagttggcattttttgcaatccctattatatatttgtaaggtagagtggaagtgagtctgatgtgtcatgaaggaaaccatggacattaattcagaatcaaaaccgttttacttatgagttggtacctggtctttttttcttccagtggcactctgttgcccaaactggaatgcagtggcgtaatctcagctcactgcaccctctacctcccgggctcaggtggttctcccacctcagtctcctgagtagctgggactacaggcacgcaccaccatgtcctgttgtttttatttttttattttgtagggatagggtcttgctcttttacaaactaggctggggtcttgaactcctgggctcaagccatcctcccgccttggcctcccaaagtgctgggattacaggcctgagccactgcaccaggcctgaaagtaggcaaaagaatcacccagaaagtcacctgctggttccctttgacttcttgtgattactgaaacatcatccagtatgtggagtactgtggtaatttccatgacaactgatcctgattttccagataaagagaggaagctagtaagtgttaggaactcaaaaagcgtagtaagctaagttcttgtgatgctaagtagaatttttagctgaaaggacctttcagcagcaactgcctgattaaacctcttcctcttataggtctggagaggttaagcaacttgcctaagggattgctgtgtttgtggaataaactctggatcctcagcttagtatctctctgtgcctcctattctgcatgacttttttcattatatctcggctgaactgtgagctctatgaaggcggaaaccatgtctgtcttgttgatgagtgttttcccagagcctggcataggatctaagtattttttgagtgaatgaataaactgggtggggggggggttctcaaactggaacacatggctgcatagtagatgatacatgaaatcacaggataaaacatacatcttcctgaagtgtcagtatacttattttttcagagttggattaaatattataactggtaatttaaagtttgcttttaactttaaatatttttatggaatgaatgataaattagcatgaattcttgagataaagtgagaaagcatcaaataagttacaggattatagcaggccctttgacttctaccccagggtgggtctggcatcgccagacctctgacatttttaagagcagctagaaatctaatttttttaaaagtgagatctgattttgaatgttggcagttaactcagaggtttttaagtaaatttttacatatcagacaaaaacatatccttgggcctaaacatctgcttgtgacctatgagataaaatacaggtctgagcagtaactagactttggatggggccaagataggtggtggtgtcagggatatctcctattctgagtctggctccttcagatttgaaactaaccataagcaggagtggaaagaataaagctagagacttgattagaacaaattcccacattaaacatcctctgtaggaaacagcttctataactcacaggctaccatatcccttctcgttgactccccttgttttgcagatgaaactaaggtccagagaagaaaccagagctttcttgtaggacccttaagaagcagccatggggccagacacggtggttcatgcctgtaatcccagcactttgggaggccaaggcaggcagatcgcttgaggtcaggagttcaagactagcctggccaacatgatgaaaccccatctctaccaaaaatataaaaattagccgggtgtagtggcgcacgcctgtagtcccagctacttgggaggcttaggcatgagaatcgtttgaacccaggaggcggaggctgcagtaagccgagcttgcgccactgcacttcagcctgggcgacagagtgagaccctgtctcaaaaaaaaaaaaaaagaaaaagaaaagaagcagctatgggtcctgggcaggccccgcttcaaactcctgacctttgtttggttttcctgcctcacacactcttgggccatggggcagtggcttctgccatagcctgaggtggttgggagagctgggctaaggcttcttggtgcagccctatcatcatgaggtggcggaaggttgccgtggcaggtggtaatgtgctgagcctcttcttggtgcaaagggtctatttctgtcactagcatcagattgaccttattttattttttttgcctagaaagatgtagaagacagctcagcaaaaagaagcctcagggccgagatagatctatccctcgttgtgccttgcttgcctcttctctttctcttctttttcctttcctccgcctcctttctttttgagccctacttaccctttcttctgcatcctcccccacccgccatcctttgtttttttcctcactgttgcccttcttgagaaattcttgtaatgctactgcagtgcgcagagcttgggattgaacctgttttctgtgtttttaaaggggacttgcagtaaaaagtagggcatctaaaatagggagactagacatcttgaaactgtcccctcttcttctccattcccaccccaagtcataaaggataaaatctaaactctggccttggccgcaaggctcatgcagtctggtgccatatcactttgctgccttttgtcagcagcatagtgcttaatacccactgtttccctgtgtttctgcccagtagaaggttccctggatgtgccaggctgtatcatgactttgttttgactacagatagtccctggtttacagtttgacttactgattttttgactttatgttggttacaaaagtgatatgcattcagtagaaacggtacttggactactcatacagctagtctgttttcactttcagtaaagtattcaataaattatgtgagatattcaacactgtattataaaataggctttgtgttagttgattttgctcacctgaaggctagtgttaatgttctgcgcatattcaaggtaggctaaactaaactagggtgtttggtaagttaggtgtattaaatgcattttcccagcctgggcaacatagacttcatctcttttttaaaacaaacaaacaaacaaaataaaaaaaaaaactagctcgcataatggggcattcctgtagtctcagcagctacttgggaggctggggtgggaagatcgcttgagcctaggaggttgaggctgtagtaagccttgattgtgttactatactccagcttaggcatcagaacgagaccttgtctcaaaaaaaaaaaaaaaaaaaaaaaggcatttcgacttacagtattttcagcttacaaggggcttattgggatgtaaccctgttgtaaattgagcagcatctgtatttcccctaagtagaaatccccttatcttcttatcccctttacctgacagactcctgtttatctttcatatcaattccaatgccacttcctcagggaagctttccctgatcactacagaagcagaattaattttgatcaaataaaatacaggatttatagcaggccctttgacttctaggactgctgtagttgtactctagtgctgtgtcacacccaaatcctctctcattcattggatcgagacagtataggccaggggatagtgtgctacttatctctatttcccttgtgtctctgaaataggcttggcacaaatagtacttacaaaatgaatgatggaaatgtgtatgcattgatacttatagtatagtttggtgttgagtgctacagatgaaatatgacagtgcgctttaaagaagaggcttaatttgggggtgactaaaataaaaaattattgacttgagggtctctgttttgcaagaatacataattagcttaaataagcagcaaaaggttagttttaattatgtagcttctgttaatattaagtgttttttgtctgttttacctcaatttgaacagattaagtttgcgtgcatgctggacatgcctcagaacacatgagtagcccgtactagatcttgggaacgtggatcttagagtcactttggaataagttcttatataaatacccccagccttttgagaacggggcttgttaaaggacgcgtatgtagggccagtacctactggcagttggattcagggaaatgggattgacttggcctttggtcctttggtcataattttaaaatatgggagtagaaaacaacaaagaatggaatggatgcttaaaacaatgaaagagcatttatcatttgtctcttgaatgtagagtttgtttttgatttcataattctgcgggtaaacgtgacagttaaagtggtggattatgtatatgtattataatttagaaattccattttataattttactattccaaggtgaaataatgcatttaaatttgggatttgggtggagtattatgtttaactggagttgttgtcaagtatgaatccctcagggaaaaaaaattctgttttaaaaagcagtctgattcttagctcttgaaactattgttacttaaatttccaataattaaaaattaaaaattttaaaattagaattgccaatactttgacctttgagaagggtttcttagaaatacatttagtaatgtccccaagacattagtcttacatttaaacttttttctttaaaacatggtattggttgttaacctttacacagttctgagtactgttaatatctggaaagtatcttgagatatcagtggaaagctaaacagtctaaatttaacatgaaatacttctttatgattcagaaaataaaatcagattttttcaaagtcaaaaaaagaaatgtgacaaagtgctctggaaatttactggaattcttgagagagaactaactggaagaaatcttggaagcttctagaagctggtagcatttgagcttgtccttaaagattcaggagttcagttggcagagatggtgggaagaacattctagatggaaggaatggtaggagtaaaagtaatgaggaagtacggaagccaggccctacctactaatccacctgtcccccttattcagaatttctgccaaatgtgtgctaaatctctgtgggccagcctaaaggatatttacttttcttcctattctttccttcccttcttcctacctcttttgtcctttttgccttttattttttgtttcttctcaatatttccccctttttttttaaatctccccctttctccagtccttcataaaaaaacaaaaaagcaaaaaactttatttacctttctctacctacttcttttttgcacttttcctaggtaacccaagaaatccaagtctttgggtggagatgtgaatcagccatacaatgtttaactccaaataacacctccccttgtgaagctgagaagtaattgaggcataattgcttctcatctgtctcttgtgttttattggcatagacttttttttttttaacctcccacagtgctgggggtgtcattatcattttatttttcgtagttgtcaaaatgtcaattttaatgagaaatttctgcagataggtttgcccttgagtggtaggagccttcaggcaaagccagggctagatgagtcaggaatgttcatggatctgttttctcatgcatacaggtgtataggccacacagaggcagacacctacttttccccatccctacaggctcaatgctttgcaacatgtgcacacacacacacacacacaattgatgtgcatgtatgtcctctcttctatacacaaagtatctcccttacactttcaagccatctattcctcctcctcccgtatgtgcacacatttaccctcttacacccctgtcccactgtcttctacccagatacccagaattgtgtgtgctaccaaagtatctgcaagcctaactcagacaccacactgttcactcccttacatctgcgcacaagtcctcccctccacacatgcccacataatctctgcccgtgccagatgccacacaccgagtaccacagcatcctccacatttctttatacccaggtgctgtcaccaccaccccttaggtttctgtatcttcataacagacattttagtttcagactagttttgaaaggaaatgttctttgctgacagccaagctagcagactgttaggaagttggaaccatttatgatagatcctttggattcaggccgctagtataatgatgggggtaggggaggactggatcagacaatagtgggctacctctgaatgttactgtttatgacccaaggtgagtttgaacctgagttcactgctattggaaggtgatccccatacttagcacaagaaagccaaagctactgcatgtgttccaaatcagaatctctggggtcaggcatagaaactgatgtttttaatgaattccttgagtccttctgttgtgtagccaggttgggaaacacttatctagagaaagaactagaagtaaaaagatatgcattatcttctgataccaccttggacaagtttcttttctggacatcagctttctccactgaaatattaaaaacctatactcataaaggaccctttcagttctaaaatttcatgctgctttatgatgagtttagtctgggatctttttctacctcatagtgtccgttctctgggtctgcctggggcggggcattttagggcatttggccagaggccagcgaggcagcccaggccctgaccttctgccagaagcactgacacagctcctaattagaaatggatcaatatgggcctgtagccaggcctggggagcctgggaggaggctggagcagtgctcctaggtagggagaatgattaccgtgaaatggatctggttacacttgtcaatacaacagttctgctggtgtagcccacctcccctggggaccagcaggcagggctaccctgaacaaacggggaaatggttaacttgtatccctatttgatgtgttttcctcacctttataaactcttacctaatgtgatgctaggtacatcgtataggccccctcttcagatggaaaaatcacttattgaatacctactaagtgttaaatactgagcctcattgtgtttatttctccttgcaacctactggcataggaaggaaaggaaactgaagctcagaaaagtcaaaatgaagtgacttggctgcccattgtcatatagcataatctctattgtactatgctattaatacatttctgagcatttgcaacaccgattccaatctgatgaactgttttctaccagggccctctcttacttacccttctacagactgaacgggagctcaggctgtctccctggagctgttcaaagactggaggaaattctttaaaacctgtggtaaggcaggtgcagggggtggagagggatgctctgcttgcttttactttctcttgctttctcatctcctttccaagttccctaaggggtgagcaggctctaatgggagagatcaatcatcatttgggatcaatgggaaggttttctcctctacggagtgcagagtcaggtttctgaactggccttgtgcaaggagagggaagggattcataactggatgcattggagaacctgcaggcttaacatgctcagcagccagtgtggtcagaccaaattcctcctatagttggtcattcaacagatacttgttgagtgtctcctgtgtgtcagggcttgtgctagtgctagggattcttagatgacctcacaatctagcatcagagtcagacaaagatacaaaccacagtataatgtatgttccttgatagaagagtttataaggaattctgagattccaaaggcatgaatgggggttctcctaggggatgtaattatgatctgtgttttgaaggaagaatgaagggtaagagttaagccaggaagggcactccagaccagggaaccagcacaaacaaaagcataaagatgtgtccaggaattactggtaaaggggtgggcattagagcagtacctaacgtgtagcaaaacagatggactgctctgagcccttatcctttgccagatttaaggttgtagtagtagccattggatggcagtaatgcaggtgcagcaggtagggaggagaagattgatttattagcaagtaccaactgaaacttatttctagacttctgtgggggagaagggaggaagcctgaagagcagcagtcctctgtcctctgggccagacctgcagaggtgttgtggttcttggcattggtttgaaagttcgtctggcccaggcaaataaccttgcttctctcatggcaaaatcttctgcttcacacagcctgcccctcctttctgtgttcttttacagaaagaaattaatggaatctgttcaaaatacccctgaaatgaaattacatttttaactctaattaccctaattaaaacttgacagccgtaatcctggaatggaagatatgctaagtaccccttgcctgtgacaagctcacttacccagatggaatgttgttctgttctgggtttagaagaaaatttcttttggtgtttgttttgttttttccattagcaatttagtcttccaccccacaaatgccccaaggtaggatagctgtacttgtggactacaggtttgcccaggacccctaatctcaatagaggttcctttgcatccggagatggagctcctaatgatccttactacatacctttgagttttttcttcagttgaggttgaactgcagcctttccctcagtgaaatcacctgccttggggaaccaaggatctgtacttgttagaaggctgtcttctggtctagggctaaatacggattgggggtcagtttagggctagtatttaggatacagtttgagcccagggacaaggaggtctaaaaataggatccctcggccgggcgcagtggctcacgcctgtaatcccaccacttcaggaggtcgaggcgggtggatcacttgaggtcaggagttcaagagcagcctggccaagttggtgaaaccctgtctttactaaaaatattttaaaaattagccaggcctggtggtgggcacctgtaatcccggctactcgggagactaaggcaggagaattgcttgaacccgagaggtggaggttgcagtgagtcgagatcatgcatcttgcactccagcctgggcgacacagcgagactctgtctcaaaagaaaaaaaaaaaggatccttctgctcttcacatagctccagttcctttaactcagcacaggtgagagcaacctagtgagatgcctggtcttggcctctgctttaagtggttacctggccagacccgaaaacatgatgggatgggaggtaggggcaagcccataaagcagactgaaggattctttgatgctgtgggtcgtctcacatttctgctagaaccgaagatccccatgttctagtaatctactcagcttagaagcctgttcagtaggcagacactgggtgctctgttaggtactgcaagggacacagagttgagtaagacacagtccctgctcttgagaaacttagaattctgggggagtggggaggtagtggtgggtgagggacaaccatacacatacaaattatgtaagacagagcaagctttattcggtagataggaagcttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgtgaacccgggaggcggagcttgcagtgagccgagatcccgccactgcattccagcctgggcaacagagcaagactctgtctcaaaaaaaaaggaagcttgagtgcccactgtgtaccaggttctgaaaatagtgtatagacatatgaaacacagttcctgtttttcaagaactcccagtaaattagataggcatgtgaaggttcaccgtaacacatgtaagtggaggatgtgctggacagattacctgggaaggaggctagtcagggaacatgaggaaggattaactcccatgggggtgaggggaggaatcattggcaaagacttctcccaggtgttggcatttggacttgtctctgagtagataatattggcaaagggatggagaaagtcattgaggatgttagggaacagcatgaggaatggtagaagctgccaaattacaactcagtgtgattggagtgcagtgtgcaggaaaaggatgtggtagaggatgaataagggtagagtttaaaccatcctgtaggcaaaggggatccactgaggttacaggactgtggtaggaataatggattagtcaacaggtgattggagacagattagttagaacatgtcagcaaactggtggggcaaatctagcccattgcctcttttgtaaagttttactggaacacagccacactcatttgttcatccatgattgcttttgcactacagtggcagagttgaataccacgcagactatggtagcccacaaagcctaattactatctgatcctatacagaaaaagtttgctgacctgtaagaaagaaggtagttatgcaagttctgtaagagaagataaatgtcagaactaggcctgaaatggattgcaggtgtttgaagaagggacatgatttagtagagaacacctgtcctacctaccgctcaaaactataaaaatcaaatttgctgaaagtcattgtctttttcttttttttttttaattagtttattttttttgagacagagtctcactcagtcacccaggctggagtgcagtggtgcaatcttggctcactgcaacctccgcctccggggttcaagcgattcttgtgcctcagcttcccaagtagctgggattacaggcgtgcaccaccacgcctggctaatttttgtattgttagtagagatggggttttgccatgttggccaggctggtcttgaactcctgacctcaagtgatctacctgcctggacctcccaaagtgctgggatttacaggcatgagccactgtgccaggctgaaagtcaccgtcttagtccattttgtgctgctgtaacagaataccatagactgagtcatttacaaacaatagaagtttgtttggctcatgcttctggaggctgggaagtccaagatcaaggggccgcccgcatctggtgagggccacgttgctgcataaaaacctggcagaaggcatcacatggtgagagagagtgggagggctgaactcacttttataataaacccactctcaagatagcagacactttcctgcagtaatgacattaatccattcatgaaggcagagccctcatgcactaatgttgcctctcagagtcccctgtctcaacattgttgctttggggattaagtttccaacacatgagctttaggagacacattcaaaccatagcagtcatggccataaaaggatacttgatacacaggcaagtcctgatttgcctttattagctgcgtgaccttgggccagtcacttaactcagaagttcgggtgaatataataagtagaatatggtgagtagaataaagaaaagactcatcagtcagatcttcctcaggagacggaactctttttaaaaaatttgttcttttaaatttttttattattaaaaaaattttttttaatttgttcttttaagtttttttattattaaaaaaaaatttttttttaaatagagacgggtcttgctctgttgcccaggctggtcctcaactcctggcctcccaaagtgatccttccaccttggcctcccaaagtgctgggattacaggcatgagccaccacactcagccttctctttctttccttttttctttctttctttctttctttttttttttttttaataaagacaatgtctcacttggctgcccatgctggtctcgaactcctgggctcaggtggtctcctgtctcggcctgccaaactgctgggtttatagatgggagccaccatgcacagcctggacaaagctcttattctcttctctataccttatacctcacccctagtttttaagtttgagggccctctagtggaaaagacagataccgtagaaaatctggatcatagtatgagttgagaagttggggatgggtaggcagaaggttttgatcactcaaagcagctgatgttgtgggtggaggggcttatgatactttgagacaccctatacctttcccctccataactgttgacacttgttctggccagtttgaacttgtttctgcccctcaactgccagagcacataaggcccctacgaaactaaaggctggctttatccctcagtcacctttaccaaacagaaactttgtaagtgccacttgatgtccctatgtgcctctccctgccactctactgagcctcctatgcctcacttcctttttccttcagcactgtgcatctgccctgaaggacggaaaaagtaccatctagggagaccacagtggtgagttttaagctcatttctgccttcagcttcctatgtgaccaaaggcaattcatttcatgtctctggcccttctgtaggctccagtgcagattatcttcagccactttttgggacttgggatttcttctctaagcctccagcttcatagcatagcattttttcccccaaagttcccctctcttttcaatctagaatattagtatatgctcaaagatcatttgcttgaaattcactaccttcacctgtgaggagagtagtcgtatctgtttttattggtagagttccaggaactggcagtcagtctgactgctagagtggaacagaccccgtcagcaaggcatgatgtctccaggatgggctgtgtagttcagtacagacaaacttttggccctgggaatccaagatacagtagaggaagaagggccaggcactagtctaggcagtttacgtaattttttcccctcatttatcttcactattctgaggtaggtgatttaatcaccattttacaaatgtgaggacttaagttttagagagtatcatttggtagacagtgactgactcattgtggatacaggaaaacaactgaatatttcttgctcccaagtagggaagagtggtagaagagacaggcaagtgaacggtggtcaaagcaccaaggatacccagttttggtgggagagccatggcttaaacctaggtctatctgctaattgtttctactatatgctgccttccttacagaggggtggagagagcagcaaacccaagtggacatccaggctggcaagcagtctctggacaatggccattggtggggaggcctgtccttggattttgagttgggctttagttcgagggggtgggggtctgaagtcttaagcgggtgactaaggcaggggctctcatgtggagctaaccccatttatagaataaagcacctaattttgtgcactctagaaagtgaagccttatggtcagcactgatcatatgctggagtatcacaagagccccacagtcagtctatggtataatagggccagaaccagtctccttattcccaatcaggccacctctcacctcactcagacttaatacagtatagaataactttggaggggacctcagtgtggaggctggaactgcaaatttcaagcttacatatcagtttttgaataggtattcaaaaaccaatgacaggctgggtgtggtggctcacgcctgtaatcccagcactttgggagtccaaggcgggcggatcacctgagattatcaggagttcgagaccagcctggccaacatggtctgagtgaggtgagaggtggcctgattgggaataaggagactggttctggccctgccactgacttccctctgtgactttggacagattcccctccctgctctggtcttacctccctttttataaaatggttgagcccttccaactctggtctcatcaggggcatgaaagccattttctacacagtctcagttgcacagagcagtgtctggtcggagctttggtgtgttggttactgattataaagctttagattctcacttccagctcaagagggggaaggggaaccatccaactgtctcattagcatggagaaaagaaaacagtaattactcgtgcctcccttgataattcctgcagggttggatcttctagggaaggaggaggggaaaactagagatagcttcagctgagaaaggagaaatgctgttagctgcccagaaaatgcagaggcaagaatgattgtcttgcacatctgttgtattctgtggacgttcctccaggcagcttggagactgcctagattgagtttcatctatttatggcatgcattatgttctcatacgtgaacatgggttgggctcaagacccctaatgtcacctgtcattaagaaaccagctgtcctctagggcctactttttgatacactgggcatcctgacacctgtctttgtttgggagtatgggagggttttactgacccattttgtgtcctggctgcattttttattatgttgtgaggtcattttttttacccccacagcaacacagccagtagttttattatgcctgggcataggcaaccatacagtagagccagtcacaagagtcaaggtcaggtatccttgtgaggggaggagtctgggagaactgcaagaccatggggtttagtaaaggctgggataagcaagccttacagaagggttgaggcagttttgaggctgaggggttagggggagctggaacccaactgtcaaatagattggcaagttggcttgtgggacaagggctatttgccctgtgcctttgccctgtgccagtcttttactccctgtgtgtggtcggttgtgagccctgaagtgctgactctagcagaaatgcgttggaggctgccttcaggggagccctgcctgagggagcctggagccattaggctgagattatctcccgtggctgctcactggtgccttggttgccaccccagaggcctagagaacgcagcttccctttctcttcctctctcctgaggaagataacccttcagcaacacgtctctctctctctctcttttttttttttaagacaatctcagtctgttgcccaggctggagtgcagtagtgcaaacacagctcactgcatcctccgctgcccgggttcaagtttttctgcctcagcctctggagtagctgggactacaggcatgcaccaccacaccacacccagctaatttttgtatttttagtagagacggagtttagccgtgttagctaggctggtgtcgaactcctgacctcaggtgatccgcccacctcagcttcccaaagtgctgggataacaggcgtgagccacctcacctggcccaacacctttcggtcagtcttcctgcaggccctggagcttgcttattctaaacaacaagagttctgtagggacatgctattttaaaaaaaaaaaaaaaaattgttttacaaatgtaggagattatttcctctgttaaaatcgtcttcggtccccagggaatgctccctttctcttgtcccagaccgtttgcttgattccccaccctttgatgtccacacccaggcttcccataattttcactcttcattcacttcctggctcctttccctagcttccagcagtagattcctggttgttttttttttttttttttttttgtggggggtggggataaggaaggtttttcaacaaagctttcatgatggggagctactggagaaaggtccagaggatgtcagtaaccccttagccacaaggaacgatatactcccaaggcttgttagcctggagtaatgctggtagaggaggaagctgtgacaagaggaagaacctgcttgtcttctgacctctgcaggcttcagcttaaacctggcagaggttgggctggggcagggcaatagtgagggctgagggttggagccctgagcaacttgtcgataagtgtttcactttacctcctattgacacatttagtttggagtttggacaagcaaactcccttcatttaacatttacaaagaggaattcctgctgcttctcttttaaataaaagtccttggttctggtatcggaaggaaaaagatcttttccaaagtctagacctcagacattttatttatttatttatttatttatttatttatttatttatttattgaggcggagtctcgctctgtcgcccatgctggagtgcagtggcgtgttctcggctcactgcaagctccgcctcccgggttcacgccattctcctgcctcagcctcctgagtagctgggactacaggcgcccgccagccatgcccagctaatttttttttttttgtatttttagtagagacggggtttcaccgtgttagccaggatggtctctatctcctgatctcgtgatccgcccgccttggcctctaaacctgagacattttaaacctgctcaggtgtctccttccttacctgttctcccttcacccctttcccatcctcttttctctgctccctgcctttgcactccttacatctcccttgacttgtgaaaacaagaatgggaaaaggacaccttaagccaacagattagtagatattcggttgatattcatactggggctgagactctgaatatggagcttgagattttggacttctagtcctcagaataagagttgccgggcaggttttgtttattcctttatttactcacagatacttaggctgacacagagcctggcaggtagttcgtaagaccctaatcctacatgacccaagacccatatgacagttcataagaccctaatcctgccataaggtcacaatcttacggagaagacatagcagcagtgagcacacaacccccactccctccacatcccccgttcaatgattgaattttgaggttagaaagaactttagtttttctggtcttctttcatgttgctgtgtaataagtaaggcagatcatgagagtacacaggctctggagtaaagtaaagcagacctgggttcaaatgctagctttgttgcttactagctgtttgaccttgaatggcacacttagcctcacctgtcttcagttaccttggttgtaaaatggacatgtcatcacctacttcacagggtatcataaggattaacagtttaacacccagccgtgtgcctgaggcatagtagcagcccatgtctttctgtcaccttgcatcaaggcctggcttaaatctttgcttcttctgtgaagcttctgagacaaacccaggtcagactgatttgtttcttcacttccacaatacataacattctttgaactgttagatcctgcctattattagtaattttttgtgggacatcatagtcccatcctgaatgccaagtgcctaaggataaggactgttctcaatcatctgtgcatcctccataaccccttattcagagctgtttacacagcaaagccaaccagtacagctagtatcaggaaatattttttgactaattagatagaaggttcatgtatgtactctgttattcagcttacaagaagaaccataaaagacctggctgggactctcccatcctaactctgcccttttcctcacctgttaccacattgataaaaacatgtgattataaaatccttgtgttggcagtataggaattcccattttgcagatggggaatctgagatgcagattagaactcaggtctcttattgggaggtagatccagactaagtaggaggaatagaaacagaaatcttataactggctgggcgtggtggctcacacctgtgatcccagcactttgggaggccaaggcaagcagataacttgaggtcaggagactagcctggccaacatggtgaaactccgtctccactaaaaacacaaaaattagccagacgtggtggcacgtgcctgtaatcctagctacttgagtggctgagacaggagaatcgcttgaaaccaggaggcggaggttgcagtgagctgagattgcactactgcactccagcctgggcaacagagcaagaccctatcttaaaaaaaaaaaaaaagaaatcttacaactgactaggtctccattcttcagaagtagtaggaatttctacaaggaagaaggggaacaggggtactgtattcctgaggccttagctgatggtgagtgcagaaatgaatatacccacaagccggagatgtttcaagaacttggcagatttgggaggccgaggcgggcggatcatgaggtcaggagatcgagaccatcctggctaacacggtgaaaccccgtctgtactaaaaatacaaaaaattagccaggcgtggtggcaggcacctgtagtcccagctactcaggaggctgaggcaggagaatggtgtgaacccgggaggcggagcttgcagtgagcctagatcgtgtcactgcactccagcatgggtgacagagcgagagactccatctcaaaaaaaaaaaaaaaaaaaaaaaaaaaaacatggcagagagagtggcaagaaaagggttcaggattacgtcatagattcactaggccttgaaaattaagaagggtttgaatgtgtgtaaatgaagaagggcaattccagtgagacaacagtgtggaccaaaaatatgagagctggaaagcccacggtagaagtaaggcggatgatgaccagatactggcatacctaagagcaaggctgaggtgactgggagccatgactttttttgagcagggaagtgtcattaggaccattagtctggctgtgtgggtctaatggattggaataggaggggtaggggagactagtgaaacagagaccagggaagagactcctgtaagtctgcctttgtaatgtcagtaagtttcaagaaatatgccagcagtgcaagcaagagataatgtgatcctgaaccaagaggaagttgacatagtagggaataaagaattctttgagaggccaaggcaggtggatcacctgaggttgggagcttgagaccagcctgactaacatgaagaaaccccgtctttactaaaaatacaaaattagctgggcatggtggccggcacctgtaatcgcagctactcaggagactgaggcaggagaatcgcttgaacccggggggccgggggttgcagtgagccaagatcgcgccaggatattccagcctgggtgacagagtgagactctgttgcaaaacataaagaaaggaagaaaggagggagggagggaggaaagggagggagggagggagggagggagggagggagatgatttggatgtagaactcttagagggggagaaaaaaaaaacccacaaggatttggcagttgtgggaatggggaagagagagaaagaggggttgagagcatgaatatttggagtctaagtaccccggagaatggttatgccattctctgaatcatggaggctgggaaatagaagatgaattgagttggttgacttgttgattggaggtgtccattcttgactccctggtgcctctgcctttgtcttttgatccagagctgcagagatcctttggttccttgtgcttgctgctttgttccagacctggaggccccccgcaccctcaatcccttcactcatgacttggagcaactttcattccctctgaaataaaacagtgcttaggccagtacctagtctgtttccaactgtgcggtaaatgcctattaaatggccgttgttattatagctttgagattacagtagctagagattagagaagcctctggaaccacctggctgaaggactcaggagccattcaacttgtattcagtaaaaagcctggactgcaagtatatggagaggatgtcaggcttgggtgtagatgggtggggaactctgagccatgtaaactagaacaagagaacatgtttcctgccttctgtttttgagaattgttatatataatgtgagattaagagggcaagccctggagttggacttctgggttcaaatcccagctccaccatcttgttagctgtgcaatgggcaaatgtacttaatttctctgtgcctcaatttctccattagtaaaataacataccaaccttacaagattgttgtaaagattaaatgagttaatacaaataaaaggtttacatcagtgcctggtatgtgctgctattcttattctagagtctgctctattccattccacattcctgggaacgaatatatagggatttctcttcttcaccatcctcacccagcagaggagggagctgagcacagaaatgtgaaataaatctcagagtccttgaaagtttgtctcagctagaatccaggtgatctaagcctggaggagcctgggccacaagtgagacagagttagagttgtccagaagacctgagtttgactcccagttttaccacttgacttattttgatcttgcgcaagtaacctagtctctgagccttagttttctcatatgtaaaatacagaacaaattccttcttgtgtctcttgtatgtacctcattctccttatgactccactctagctatattattagtcttcttgttccttaaacataccaaggcctcagggcctttgtacttgctattctctccctggaacactcttccctcagatcttttcatgtcttaccccagacttcattcaaatctctctggatgtgaccctttgtagaggcccctccctgaccattttatctaaaatagacttcacccttaccttttgtcattctttatttccttaccttgctttgcttcccttccctccctctccctttccctccccttccctccccttcctccccccctttttttgagatggattctcactcttgtcacccaggctgtagtgcagtggcacgatctcgctcactggaacctccgcctcccaggttcaagcgattctcctgcttcagcctcccaagtagctggggttacaggcgcccaccaccatgcctggctaatttttttttttttttttttttgtatttttagtagagacagggtttcaccatgttggccgggctcgtcttgaactcctgacttcaggtgatccatccccctcggcctcccaaagtgctgagattacaggcatgagccaccgcgccaggcgtgccttatttttctttatggcacttagcactacttgaaattatatactgtaaataattgacctgtcttttgctaggatgcaaaatgtgtgagggcaggaattttgaatgcctgctgcctgttctgagcagcacccctaatggacttctctctctattgtaggtgagccctattcccagaggcaggtggtgctgaccctgtaacccaaaggaggaaacagctggctaagctcatcattgttactggtgagtgaggttgcctgggaaagctctgggcaagcttgggccaacatggagggtaactcgtttggggattgtttttacctttagtacagataacttacaagtgattatcttcctactccatgtctaaaagattggatgttgcacaggtaaccttctgaactgggagggttgagactgctctcctagaattgccacaagaatgtctgagatcatttgccatgaataaggcagagcaggtctgcttccttcttgcttctgctagctgctttctgctgggatgtggcaggtggggggctatcctgggacctggcggctatacctgtcctctcacaagctctttaacatgacctcacagcccttagagacttgttttttgagatggagtttcgctcttgttgcccagactgcagtgcaatggcacgatctcggctcaatgcaacctccgcctcccgggttcaagcaattctcctgcctcagcctcctgagtagctaggattacaggcatgcaccgccatgcctggctaattttgtattttttagtagagacggggtttctccacgttggtcagactggtctcgaactcccgacctcaggtgatctgcctgcctcggccttccaaagtgttgggattacaagcgtgagccaccgcgcccggccccgtagagactttcttagctttagtttttactgtgatctgccaagctcataggtcagctccagaaaatcctgtagtttcttccattctgcaaaatgtcgtatgaataatggtgagagtggagtgattagggttttatgaagtggatgtcaggggaagctgacagatggtgagaaggaaggaaaatcaacgcattaagaacttactatgttactgatctcaatctagacaaaatccctttttgtgtgttggggggggttttatttttgtttttgggagacaggtctcactgtgttgcccaggctggtctcaaactcctgggctcgtgtgattcaagtggtcctcctgcctcagcctcccgagtagctggaattacagatgtgtaccaccacagcctgctctgaaacctcattttatagatgaggaaattgaggctcaggaactgaaataatttgcccagggtttacacctgggaatctataaagttgatgttagaacccaggtcagtctgaccataaataccattgttcttccagacctgaccttccttgggctgttaatctccctctctaattctgatttttcttataaagttcaagaaggcctacttacttagggattcagaaaggagattcagttgaggggctgaacagggcaggtaggagttaggggtccctctgagcagtggtatttctagtgagggggactactagactgaaagataggaagaaccttcaagcaggcagaggcccaggctaaaagtgaccacaagaagaagaatacgtctgtaacacatgggatctcataaacacttgggccagtacagggtaaggacctgagtgctggcttgaagttgagaaacctaggtttttatcttctctctcaacatgtgcccttggacagtcttcatttccctatttgtaaagttggagtgcctccctgtcccctcacgtctcatgtgtgtactcctaccatgcaggtatgttacagagaatcaaatgagaaatgcaagttggaaaactttgtgaattgtaaagcagcatgaacgaaacaagaaagtgagaagaaagcattttaagtgtctgtcttagctcgttttatgttgttataaaggagtacctgaggctgagtaatttataaagagaaaaggtttatttgtctcacaattcgaatgtctggaaaagttcaagattgggtgtctgcacccagtgagggccttaggctgcttctactgtggtggaaagggaactgctgtgggtagaaatcagatggtaagaaagggagaggggagatgccaggctcttcttaacaaccatctcttactggaacaaagagagtgagaattcactcacttcccctaccctccttccagggaggggattaatctattcatgagggatctgcccccaacgatccaaacctcccattaggtcccgccttaaacattggggatcagatttcagcaagaggtttggaggagtccaccatccaaaatatagcagtatctgtagcgtcccagtccctgacctgtttgccgccccattccccaaaagtaaacgggagggttttcctttggaaattttcactgtaaatcttcttctgtgcccttctcctcctctcctttcttttgtgggccctacccatagcttagtctttccataaggaaagggattccagggcagagatgacaaagccaggtagcacaggcagccacgatttgcaatatgtgtgctgcagagtgcaggtttgagtgcactcatgaaccgtggtataggatactacagcagttcccaagagcccatcccaacaggagtcagcactccactgagatgttgccttgttccctgctgtcatctcttgaagaaggctattcctcttttggccctaggttccctgcctgcctctgcttactgctagtgaaaaaggctcttgtgctgtagcctcacattttatggaggccatggtcattccagtttttctaccatcttgttctcccccttcaccaacgatgggggccattctcttcgcactgtgttttaacaatggacattctgttcttctgtctgcctgagagtgcacagagggttttgacccctaccttccctcctactctgaatatccaggctcttgctgccacttctttttgccttgttaatctaaagttctacagcttctggcctttccctggcctgggtgccaagcttggatcttatatgcttcctgtaacaactgccctgtgaaaaagctccactattaacttttaaaatatgaatgattccacgtaaataagtgtgtaatatatacatttatatatgataagctacccatataatagcttatttatctaacagcctcatttttccagagtccaactgaaaaacaagagggaagtaaagcattgtcatccttaagtatttgcacagtgctaatttattcttatttttatgtgttgttgtaacaagtttagcatttggtttctaaaaccccataagattaaaagaagaatatcaaaaaagggagaagagctgctatattaataccatctaggggtgagagctgaaagctgactgaaaggggaggggtgaaagaagaagttaaaacaacagtctgggccgggtgcggtggctcacgcctgtaatcccagcactttgggaggccgagtcaggtggatcacaaggtcaggagatcgagaccatcctggctaacacggtgaaaccccgtctctactgaaaaatacaaaaaattagccaggtgtggtggcgggtgtctgtagtcccagctacttgggaggctgaggcagaagaatggtgtgaacccgggaggcagagcttgcagtgagctgagattgcgccactctactccagcctgggcgacagagcgagactccatctcaaaaaaaaaaaaaaaaaaaaaaaaaaaaaaaaaaacagtctggaggccacttaatttaggagcagcacctccacaaacatcggtgtccctcagtaagatgagggtggggctgggtaatttctgtggtagttttgggttcctctcgaaggctagagttatcagaaaatgttaattatttatagtatctactatatattatcaggcactatactgaatgctctacataaatatatttcattttcatagcaacttggcaggtaggtggtgatattcttattttataaattacttgagagttagagagggacgtgtaggcagtgatcagaagagctaagcttagaacccagaagaatctggcttcagaaaaccaagtttttttatgatatcctacattggctctttccccacgacctaaaaccctggtcctcctcagcctcttgagctagtagtcccccactcctcctttttgttcattctcctatatacgtttttctttttaaagatacacatttattcattcattcagtgagtattggagtgtctgtcatataccaggcacagtttcaagtgtttgaggtgtagcagtgaataaaatagttttctctctgtagtttacgttctagtagaggaaagcagataaatgaataaatctgaagaaaaatagcagggtaagggaatagggagacactggattattaaagaaggcctctcagaaaataaaatttgtgcagaaatatgcaagaactggagtagtgagctatgtgtatctttgggggaataactttctaggcatagagcgtgcttcttgattctaaggaacgaaaggaggccagtgtggctacagatggagtaaacgaagggggagataggaatatggagaagtcacaagggtagacagggaccagatcatggagagctttattctgagttaaataggaagacattggagagttttgaatagaggaatgacataatctgacatccattaaaaaaaaaaaaattcccctgcctaattgtaccagctgggatctctagtacagcgttgaatagaattgataagagcagacagccttccttactttgttcccaattttaggaggaaagtattccatctttcaggctaaggaagttcccttttattcctagtttattgagaggtttcattatggatgactgttggattttgttgattttatggtctttgttctttattctacattgacattacattaattgattttcagatattaaatcaacttcacattcctagaataaatcccacatggttgtagtgtataatcctttttatatggagttagatttgatttgctggggaatattgttctgtagttttcttaggtctttatctgcttttggcattagggtggcctcatggaatgaattgatgtgttccctcctcctctgatttctgaaagagtttgtaaaggattggtattatttcttctttaattgtttgatagaattcatcagtgaagccacatgggcctgggcttgtctttgttggaagagtttaaaattactaattcaaatgtcttacttgttaaatctacttagattttctctttctttttgagtcacttttgataatttgtgtatttttaggaatgtttccatttcacccaagttgtctaatttgttggtaatttgtgtctttttttttcttggtcagtctagatacaggtttgttgattttgctggtgttttcaaagaaccaacttttggtttcattgtttttcttttccattgattttttattattttctgttttatttattttgtttattgtttttattattttctaatttctgctgctttgggtctagtttgctcttttctagtttcttaaggattcgttcattgatttttgaggcaggatacaccccaaaccaaacaattcttcaggcttgactataccagtggactatcagtttgctccttctgatacagtagcctctggagaagtatcaaacttcagagggggcctgattcagaaacaatagggaagacaagtggcctacaatgtatatgtgttaccagtagagagggtgctagggctagacccatagtgctcggcagcctggctcctgcctgccccaaatcagcactgggcaggctgagctttgagtaagacatacgggggtggtgtagcaggaagtcaggtgacacatggcaagccagggcctcccaggcttctgcagaaggttgcctgatacagagctagaagagaccgctgcccgcctcatggacttcagaggcttcacagtggcttttgggggaccattctgaacacctcttttgcctgttacaactgaaattctaagcagagatttgattccattaaataaggcttacagtgcagatgccataggtaacattgagataggaggggctctgagcaatgcctggcttgctggtgacttacttgtggcctttagtttcctcatctataaacaaggaataatagtttctacccagcgtactgtgtaaagcacatttcagataagtgctatataaaaccattggatagtgtacaaatgtacaagactattaatgttagtaattacagtgatagggacctgggatagagtctgagaaggtctaggagcagtagcagtgcatcattgtccttcagggtatggggatgaatgtttgaccagagtggacctgatagcttagaaagggcaggagactcattgtctgccagtgtaatcatcagatggctcctagagaattctatgcaggagcgggtatctgtgggggaggctgccagagcagctcatgtaagaaacagctgttcctattcactctccacccaaggattttggccatattttattactttggttccagaaacagctggcttgcttgaggattgctgtcatagcaaagcaataacctccagcttgcttgggggaaaggaattgcatgcaaagggctctgggctctatgaggtcccgggttcccctgcttccttccccagttttcattaaaactaaagaagatccttttgtccctttggagcagcaggccagagcagaagaacagccaaacaggagagggacctgtaggttagattaactggaaggcagttctagggattttggctgtggcagtgagacagggtcctgagcctgagaacatggccaagagagcaaaatctaagctggataacaacagcttaagaaaccaaggtctgtgagcgttggtggttctagaaccttgagatgagtgagagatgaataaaggggtcttattgaatgggacagattggggggtgctcaaaagctactttaccccattaacacaaagcagaaattgcttctttggaattatctgtcattgtattatttgagtctccactatccatccttcccctcattgccacctcccatatccccaattaacgtaaactgtcaagagtcaacaattctgagtacatagggcaagaggtaaaagataaaagatatctgtggtataactggtctttaggaagatgaagtaactgcatctttcccaccattgtgtgtattcttaataccaagatttgggtccttgatctgacatttattttctgtgtgactaacttctctgagctgtagtttgctcatatacaaaatgggaataataatgcctactttatatagtgattgtgttgctagtagatgaagaaaatacctggcctggcttggcgttcaatcactagtgattggaataaattctgataccatgtgttgagtgtcagattgaagtaggagagtgtggcgatccaggctcttaaccttgttctactgactcaaacctgggaaagcattttatacctgggcctctttttcctcagttctacaaacagggaatgaggtagaaagttggtctgtaattgctgatgtttcttcctgttctgtgtctccaaaggcgcattggtctgtggtccaaggagattaaagagtcaacagggacctaagagaagtctcaacttcggtcctgcttaagcctgcagcaggaacagttaaaaacaaaaagccgctatctatagtaaggtgttagaagtggctgggagtatgctgcaggggcagtgacctgcctgtcacccagcatttggaaaataaatgtcaaagagaagatcataatggcctagaaggttggaaactgagtagctagcaagtgtgagagagggaccatgagacataggacccagattgtgctctatcacccactcattgggtgttcccagtcaagctatttctctttgcatcctccatatccccatctgtaaaaatgagttaggcattgtattctccaagtgcctcttcagggctttctgaaatttcattggccccttttttctggctcttgtgtttgtactctagcttttgcctttggtactgaggatttcatttatgagaaggctttttaaccagccaggctttgtctagccctagagtatttagaatgctcctgaaactatgatttcaggccattcaatttgcatctagaaatgccttggttcacctgatcctactccctcatttaacattgagagataatgcaacagagaagaaagactacaggcttgacaaatgacccccaattcagattcctgccagtactagcttaatctttctgaaccatatcaccatcatttaaaagtgcaataatgggctgggcgcggtggctcatgcctgtaatcccagcactttgggaggccaaggaggaaggatcacgaggtcaagagattgagaccgtcctggccaacgtggtgaaaccccgtctctactaaaaatacaaaaattagttgggcatggtggcgtgtgccagtaatcctagctacttgggaggctgaggcaggagaatcgcttgaacccaggaggcggaggttgcagtgagcagagatcccaccactgcactccagcctgggcgacagagtgagaccccatctcaaaaaaaaaaaagtgcaataatgataatagattcagcacacagagaattatttagaagaggaaagaaaaaactgaggcccaagaggtgaagtcacctgttcaggttcaggttcacacccgaatccagatctcttgtgtctcattccagagtttttttcccctctagagccaaggtcagttgtgcccatatggatatggtagcaaagattggaactgaaagcatgtcagcttttttaacatctccgccaacagccctctcaattcccctgtggcacgtgtcaataacacagcccgtacttgttttagaaacaagcgctccataagcactcctgtttgatttgctttggctggtacaggatccagatgctcttagaatagcacaacagactctccaaatcagcctattcccattccgagccactcacagctctgatctgctgctggctggggttcatccccgagtcttccctacctatcatgtgaatcacgttcagacttttgctagtttgtcctttccctcttgagtagaagtaacatttattgtgtgcatactgtgtgccaggtattgtgacaggtactttaaatagattatctcccttaatctttataactcattaagctattaatagctccaaaggggaaagctgaggctcagtgaagtgaatgaatttactgaagccacatatctagtctctgaaagagctagagtttgaactgagtcctgaccccattgactaagctgtaaggtaagctgtttcctgagtatcatactgcctccctgtcctctggccacggcccttccaggagggtagagtgtttgggagtacccaagaataggcgtttggtgccctgagtgtaataggaatgtcttccatgccttcagtgtattttcctgagagtttctgcactctgtgcctcaaaccaacttctctagaactcagatatagagcccagagatccaagcactgagttagaagctatgtttccatcgtgatcatggaacagagtccctagtgaaaagtatatttgtccttttcaaagttgaatagagagagtatttcaagcaataacccctacttgtatgaccaactccaaagtacagggaaggaaagggaaagggtctgtactcctcaaccgtgataagtctcctccagggacctggcaggagtggagacatgcacacacaaaagattttaggactaagattgttctgataggttctcaaatctgtactcaacagtttgcaaagcagtttaccttcaagaaaccgtactgtgaagaaactgaaggaatctgcctttatgtgacagagccaggggctagagtccaaatctttagtcttgataatgccagtgaggctaagtcttccctgagagggttttctctctggcgttgggcgtacccagtctccacttgcaaaaggagcaggcccttagtctctgtctttttctcagccttcctctgccctcttgtccccctcctcactcattcatactcaattgctagggacttatttcaaccccttatagggtgttatttttaggcacagggtgataggagatattttttgtttctgtattttccccaggatcaattgccataaaatcatggaattttaggatatcagagtgggaagggaccttaattgacaatcatcaagtttacatagtaaccctttttttaaaacatgtaacatccagaacagagcttctggctgggtgcagtggctcatgcctgtaattgccagcactttgggaggctgaggcgggtggatcatttgaggtgaggagtttgagaccagcctggccaacatggtgaaaccctgtctctactaaaatacaaaaattagctaggcatggtggcatgggtctgtaatcccagctattcaggaggctgagatgggaggattgcttgagcgcgggattgccatcccggcgggtggaggttgcagtgaggggagatcaagccactgcagtccagcctgggcaacagagcgagatgccgtctcaaaaaacaaacataaacaaaaacaaccaaacagagctgctttggctgaagcagcagcaagaggcctagtagctcagcctccccactacccttaccaaacaaagacgatccccgctcccgccgaggcagctgccttaaacttccagggttcccaggatcacagttcgtaaaacgacactgacctgaaccaactctcccattttatcattgttaaattgaagcccagcaaaggagagtaatgtgccaaggtcacagagtgaattagtggcaggtgccctgactctctgcctggtgtcctttttactaccctgagctgtatgtcattatgtcatttcgttaagtgaccacttctaacacttgactggcatcctgtgcctgggtgtcaggcttctcttgcctcatgacatctggttcctgtgaggtaggcaggcttgtgaatgtgtgtacctcgtcagggcataattttcatacatagagtgagcatgtgtcaggttttgtttaactgattaatgtggaaaccagcagaagtagaatagctgagaaatcagatttagattgttaatgaaagaaggattgctgaaataaaattgttttggttagtaccctaatgaaaatataacctttggaaatattttatctgcgtattaaaggtatataccttcttagttttttacacattaacctcttactgcagagttttaaaacatttgggccctaatcgtttgtgaagaataacaaaattccatttcccaagagtgtcagatgacttagttcatagtaaacaatgtgtctaacatgacttttaagtggtcacacaatcatctttttgccttccaaattttggataattttccttaacatacaatcactaaaaatgatcagaacctcttgtgttaaagccagctagagccatcccaacccaggaaggcagctttctgctcagggaacagatgtgacctctttactaaggtttctgcagtcagcagccatcaacaagatcttgagctcactctccttgcagccctgctcagtggcctgggatttggcctttgctaatcctagacttgcttctttttcttcccctgctcaaggaggctcttttcttccttgtggtctcaccctcaggaccatcttggatgcaaagaggttacagagttccatttggaggaagtttattttatgtgcagagccagttctactcagaataggcagctgctttcattatgtggttttgtctctgaacatgttttgtccatctttccatccccactgctaccacccaaggccagatcttaataatctgtctctggcagcgttttaattatcaactcacttgccactccatgtccagtctttaccctgaaatataaccttttctctctccatagcttttaagacacagatcttattcctgtgacttccttgctcatgaaacctctaaaatctaatcttcttagaatgatatttgaggttctgcaaagacttttgcccttttctttccagtcctttctccaatcgtctcctcataccctgttccatgggggttcatactagtgggtaggaatattagagaaaccatctttgggacagtatgaaggttaggaaggattctttgttgtggggccatgttaagatttaatttgataaaactttgtgctcggcacagaagtaagtcttaggaataaggagtagccaaacacatggttaaggcttttggagcctgtagttgatgaagaaggacaggaaggtaaagtaagtaggctagagcgataatcactctgaatggaaacctggagagagtgctttaggagcttggaggggaccactacctgagagatgaaggaatacctcccagaagaggtaatatttgagttggacttcaaagatgaggcatttggtaattatgaaggggagactgtaacttccaagcagaaagaccagtgaggacagaggcacagaagcttatgtgggtgtttcagagaagggaaaacagtccattgtagccagagtataagagttcaggaataggactgtggttagggttaaagttaccaaagtaagttagggtcaaactctgaaggacataatattggaggctattgtgtatgtactgtgttttacacatagcatgcaacaataattgattaattaggtgatatatatttgtctatttgtacgagtatgtagctgtgtgttggtatgtgcgttactttttttttttttccgagatggggtttttctcttattgcccagaccggaatggcaatggcgtgattttggctcactgcaacctcctaggttcaagtgattcttctgcctcagcctccctagtagctgggattacaggcatgcaccaccacacccggctaatttcgtatttttggtagaggcggagtttctccatgttggtcaggctggtcttgaactcctcactttaggtgatcggccgacctcaggtgatccgcctgcctcggcctcccgaagctgggattacaggcgtgagccaccacacctgacgtgtgttaacatttgaagaaccattgaggccaagcaaatatcaaaaattgaagccagaaggacagattggacctaagcttacctaggcttggagctcctgagatgttccccagttccacaagcccgtaagttagtcacagaaagccagcattggaagggaccttagggacagtgtttatacttacatacattcagttatccattcaacagatgtctgatactgcccatagaactgggatacagtaatgaacaaaacaaggactgccttcatggaacttgttatttatttatttattgagacagggtttcactctgtcacccaggctggagtgcagtggcatgatcgtggctcactgcagccttgacctgagcttaagcaatcctcccacctcagcctcctgagtagctgggactacaggcatgcaccaccacacctagctaattaaaaatttttttttgtagagccagggtctccctacgttgcctaggatggtctcaacatcttgggcttaagcgatcctcctgcctcggaggcctcccaaaatgttgggattacaggtatgagccactgtgcccagcgtagaacttattttaatggggaaaacaatgaaaaaattagtaaatcaattatgtaattctatatgcattatgaagaaagataagcaggagtaaaatgttaaaaagtggccagagtagacctctctaaggaggaagatcattaccagctgagagaagggcaggtgaaaaggccctgatgcaagagcatgtttgtagaataattagaaggcagccagtgtggctggagtagcagcagtaaagaggaaagaggcaggagataaggttggagagtgggcagctgaggccagaacatagggccccgaggtccattgggctgatgaggaaatgaagttggcatgtagccaggatcacacagcaagttatgagccaggccaggattgggaacgttctggttcaggctcccttcctttgctctctgccatcttctgtcttttggccaatattaacttgaatcccatttaataccttcattttcttctccctcatgtagctctctcccatttctcagacctacatttgctcacatgatttggtaatagagtgatttctggaaggtcatggctagagtggtccttggacatcttttagttaaatccctggtattagaaatccacagagggaaattggcctgctcaaggctacttacctagttaggagtaaaacttgatttcttttccccagttctcttgccgtctggtgtctggctcttcattttctgtgtgccgttccccttttcttacagtttccagcggaagggaatcaagttgtgacccatgtaattgacacaagcagctagcagcattccaggaccccatgccacctgccctcactttagctttttgtttggtctttgtcatgtgaatttactgtttgattcaggccggtgtctttgaactactaccctctgcaaagacatgttgctaactctgcatccttgctcatgctattatttccacacctgaactggcagcctgctcttaaccacaggtctgtatccaggaggcttgtctttgaagcccagccccagtcttatctccaaagaagcaatgtggaaagaggataaagtttggagttggatatagttggatttgaatcccagctttggcacatgctgggaccaaagaaatcttagacaagtaacttgacttctgggagtggttttcctgtttgtaaatgaggctattaacacctgcttcatggggtcattggaaggattatttaaggtattgtatgtgtacatactttaagcattgggtaaagagaaactcttattcactcctcctcaaaggtgccttctgaatgccctttgcctttttcgtaatacttaataggtaacatttcttgggagggtttctgtgtgaccggcactttgctaagtgtccagtgcttttaaaaggacttaccactgcaagtgattccatagttgtctccaaataaaaagttaatttttaaaaagcactgatctcattttttatatatttgttattcttgttgtgtgtagatagaggccaggttaggattcagtatatacctgtgttccagttgttgctctgtgattttctagctgtgtaaacttggacaagtcactggacctccactctttttttttttttttttttttttgagatggagtttcgctcttgttgcccaggctggagtgcaatggtgtgacctcggctcactgcagcctccacctcttgggttgaagcaattctcctgcctcagcctcctgagtagctgggattataggcatgtgccaccatgcctgactaattttgtatttttagtagagatggggtttctccatgttggtcaggctggtttcgaactactgacctcaggtgatcctcccacctcggcctcccaaagtggggggattacaggtgtgagccaccatgcctggccttgacctctattcttaatgtgtttttcacactagagccctaaaattcaacactagttacatttggaaacctgacttgctaatctgctgaccttggaaaatgtgtctttgttgaatacagagcagtagtacctgggctggccctgtgtgacttagagcggacagtatgggaggtggagaactgggtgcatgggagccattagatcaagaattggaaattcctcacaaataaaaggtttctggggtaggagcagggggcagtgttgatggtgactctgcttggattatcttctagggatggaggattgccagctccattgaatggaaggactggtgatgcgcagccactcttgcatgtgcccgggcaaaagacagtgtgttggtggcaaatgcctaatgtgtctatggctgaccatgggccatctctgccattcaagacatcagctcctggcagagttgtattggtttgatagagctttagtcttcggagtcgcacagacctgagttcaaatccttctctgccatttactgtaataattgtgttccttaggctgatcctttagctctcagatcctctttttccttttctctaaaatgatgtggttgatatctgcttttgaggttgtgaggatttaaaataacaggtaaataggtgccacacagtaccagatacttagttgggtgagtagcctggtgatctgtggctgttagctctttgaaggccagtatccctaggagatagcagcaacgtcagcactgctctgattccctgaccaacccccaaccccacctttgccctcagaaataccctggacccttgtttccttcctcaagttcagaccccagaaatgttgggcaagaaggagcctccaggccaggctttattgtgccagatgttatatctgagtaagcaggattgttacacagcagagatacaggagcagagcaggtagctcaggcagctgctgatgaacaaaaggcttcttctctctgttcccaataaattggtccttggggatcctagctttgaaattctaattgacacaggaaggaaaagattcattaggctctggactcgttaaaatgctctgctgctcacctacgatttattcttggcacttcatcaagaggaattaagtaaaccaatgggctgggaggctcctgacagcagagtcgtgtgtctctcgtgctcctggggggatgagagtgttgggtctcctatgctatggagcatatagctggctttggaatctcctcatccctaggacttcacatgagtctaagtctcatatgcttttaacaatggagggaccttctgagatcatactgtgtaactcatttatagatggtccaaagaagaactgggacttgctcaagatcacgaaacgcattagtagtggagttagaattagaatcagtcaggctgcatgacttccaggtcaagaatattttctctgcggccgggcgtggtggctcacgcctgtaatcccagcactttgggaggctgaggcaggtggatcacgaggtcaggagatcaagaccatcctggctaacacggtgaaactccatctccactaaaaatacaaaaaattagccgggcgtggtggcgggcgcctgtagtcccagctactcgggaagctgaggcaggagaatggcgtgaaccctggaggcagagcttgcagtgagccgagatcgcaccactgcactctagcctgggagacagcgagactccgtctcaaaaaaaaaaaaaaaaaattttctctgcatcacctttggatttctacacccagtgtttcattcattcagccttcaacagatacttttaacacattctgtgtgccaggactctgtgataaacaaaacagccatggaggaaagtaaatacctgacccagtattaggagagattagaaaggcctccaagtctgagagatggataggaattagctcagcaaggagagatgaggaaggttatggctgaggaactggcatctatgaaagccagattcagctttcccttcagagcctggctttggcatctatgaaagccaggctctgaagggaaagttgaatcttgctagagtggagaattgaggaagagatgagatgttaaggcaagccgagtctatgaggtttgggccactgtatggttgtaaagaaccctggatctgggattaggagtcctgagttctagatatgtttctgctaccaatatgttagtcatcattctagtaacacttcacatcttttaggtgtgccatgatgggcactggggtacaaaaatgtgtaagatgtatgtagtcccctccctcagagatctgtcagtttaatgaggcaagcaggctaattaagaacccctgtagtaaaggaacagttacctctgctgtaagaagtcagaattgagctgtgtgttactttaagcactttctctgggctttgatgatctcacctgtcaaatggtaaataaccactgtcctatgtagctggtaaactgatgagaagacagacaactttgtaatgattggcgtttgtttggcattttgtggatttcaaaacacttttgacatcattaattcattgaaccttaactgcaatcttatgacttaggaaatttccccacaatgtacagatgaggaaactgagagaggttgaggcttgttcatagtttcacagcttttgattaacaaaagttaggattataaatccaaatcccgtgctcttattttgaaaagtataaagatggcaacctttctttctatcccctacttagtggcaaattatccccttccccttttcacagtcaccagaaatgcagagaatgtctgctgtgtttgaaaagcagatctaagctgactggggagaaagaaaggagcttatttcaggtcttcttcaggctggactctaaacttttaagatcatgtgcgcccgtgctcccatcagctcctgctgttccatctcatgccatttacagagtgccatttactgagccactacttcattggctactcatagcaacttgtggggtagacaaagtgcactttacagatgggcaaactgaggtccagagtccctgaattgtacatgtcagaaccaggattgaatctagaagtcttgggctcctgacaccaaacaggtgctcttaacttgcagaatgtaggttcctttgattcagttcggttcaaacaattcttgaatataacccatgtgccagagactttgctatgcaagagagcctctagttaggctcaaaccgtcttggtctagtgccttacttaagaacagggacttgtattatttacttctctgtccccaggcaggaccttgatccaaaaatgctttgctgttgtttttggccttaatctgccagaaactagagggagcagatggccacagcaatgtgggttatgaggatgtgatatcaggcagggttgaaggatgaattgagagccctgcacccaactacttctgtgtctgtgcctaggcccttgtcagggtagtctctatctgagagtgtagctggtcagcctggtcccatttctcatttccagtcacctccccctcttgccatcccatataatggggttagtctcctggacagatctcatacagaggctgctgggatctgctgtccaaatgaccctttggacctatttcccagccatgttccaagatgatggtgaggagtctagccccacagccagtatgctatctctattcagataactcccagctcacaggcctcccaccaggctctcacccactctgatgttttcactcctgactcctaagaagcagattggcaatttagtgtgagtctgtcagacagcctagagagtaatcaatactgagagaaatggacatatttcctgtttattcaaaatcctgatgaaaattttaaggagcactatttgggaagggatgactgggaaccttgcaagaacaaacagcttaaaattcatgaacagaaatagcaacgtttattcatgatgtttcaaatgcccctaatattcacatctttatatattacagacccctttcatacgtgttactgcttttgaaccttagagcaactctgtgagggaagcagtgtaaggattactattcccacttgacagttgaggaaactaaggcccaggaagctttaaagagagttagggaccatctgatagtcatggtggcagagcccaaaacagaaccaagatttggaaaatgagtactcctgggtttgaaatctggtgctcgccactttctagttgtgtgacctttggcaagttacttggcctctctgagctcagtttccttctctgtaatacgaggataacaatgtctactccttatggttgtgtatggatttaatgatataattaatggaaaatgctagcacagtacagaacatgtgttaggagcttagtaactgcaggtatcctatctcataggatagcgttttcagtatattgcactctgagtctttgaaatttgatactttttttttgtttttgagacagagtctcgctctgttgcccaggctggagtgcagtggcgtgatctccgctcactgcaagctccgccccctgggttcatgccattctcctgcctcagcctccccagtagctggggctacaggcgcctgccaccacacctggctaattttttttgttgttgttgttgtttagtagagacgggttttcaccgtgtttgccaggatggtctccatctcctgacctcgtgatccaggtgccttggcctcccaaagtgctgggattacaggcgtgagccactgcgcccagcctgatactttcactacagtaaaatggactacatataataaattctcattaaccagagtatcatttaaatgcctcactaggttaagagaactggataagaagggaagcagggtgctccaggcactggctaagtactcctgatgcaaatcacagtaggttagagctgacagggaccctagagatctgtcccagtgtgtcttcctcaaattgtgtcttcctcagaagagatgttaataatttgggaaacatcagattgaataatgctaataagtaaatttctttaccgctgcctttgcagacccttattgtgtgtgtctcttgggaacgagttgagagtgcaatatgccaaatttcctcttcttatttaaccttggagccccttttttgaggaactctcattaacatcttgaggaaccctggttttccgtggaagatttcatgtaactgactcagtccagttctttaatttttaagatgagggaagcttaaggtctctaaccaaggtctacagcccatggcagaaccaagtctaaatctcagggtgcctaactttttcctaggccacaccataatttgtactccactattgttccttttctagccagcaaatcctaaaattacagaggatcctgcaaaccactaatcagagagcattgttagagcatcaagctttctgttttgatgtgtttatcccagtaggcaggaaaatgaggaaacaacaggcttaatggccatcagatgtttccaaacagttgaaggaccaggggtcaagtaattatctcagtaactggaaaggtgcccttaccgtgcaaagtcgaactctgttcttcctgctgtaagaaatttgagttatatctgggggactcatccagtaggcccacagtccccacagtccagctcctactaagaactaagctctgacaccagtaatataaaaaagatcctgagaggggtttgaagagaatgtgtaagtttctgctcctctgtcaccgtctccatcacaaaattgagggggtaggaatgttctgctggatttctatccagacagtggcagaggaagttggctttggcatttagtggggctatccttgcattttactaagccctctagttaagatcaaatcaagtttaaaaagaaactttttttttttttcactctgttggccaggctgatctcgaactcctgacctcaggtgatccgcctgcctcggcctcccaaagtgctgggattacaggtgtgagccaccacatccagcccaaaaatatcacctttaaatttgcaagtttatatggtagattgttcaaagcacatctgatcacaacacaatcccgtgacatagaggttcttttccatgtatcatatgaggacgttaaggttcagaaaagagatggtgacttgtccagggtttgacggcaaattagtgatagacccttttcacaagtgcctagtgcaaggccaacatttagtagatgttcaataattttttttttttttttttttttttttttttttgagacaaggcctcgctgtgtcacccaggctatagtgcaatggcacagtcatggctcactgcaggtccaaccttctgggctcaagcagtcctcccacctcagcctcccaagtaactgggactataaacatgtaccaccatgcccggctaatttttaattgtttttagagacaggctcccactatattgcccagactggtcttgaactcctgagctcaagcagtcctcctgctttggcctcccaaagtattaggattacaggcgtgagccaccatgcctagccaagaaatatttattaattgaaaattttagtacattctcagggattaacttatggtctcctaactctttgcccagtattctttccattaagatagcttggtggggccagtggttgggcttcatctcagggtgaccagataataaagagagggagggctgaatctctgtcactattgatattgctgacaaggatggcattttctggcctttgctgctgtccttatacatactacccactacagaaagcccagattcagtagtctctgggctgcagactcaagcttttgttgcctttgctccctgtagtatactgaacaatgatgccagtgacccccagcttctcactctgccttctcctttattttctttctcatcagtgtcttacatctccttctattctgctgatggatgaggaatttgagctcatctcacaaacatcagctacacggttcactgttaaggagttgttgtatcatgtaccttgggaaaccatttactgaaaaacgcccacctaggattctttcacctgttcactagcagaaatttcactggttgctagtatagtgctggaggctgggattgcaaagattaataaaatagtctctgccttcaaggagttcagaatttaatggagggagacagatgtgtaaatacaaaagtgcagcagatgttgcagtagaggtcagcagagagtatctgggtccagaggagtgagtggctggatctgcctacggggtgggatacaaaagctttcccgaagagttttctacagggacgtcacatcagtgggtttgtactcagaaaactcctggccccagccaccactgccagatcagaaattggttgcaggctgggcatggtggctcaagcctgtaatcccagcacttcgggaggctgaggcaggtggatcacttgaggtcaggcgttcgagaccagcctgaccaatgtggtgaaactttgtctctactaaaaatacaaaaattagccaggcgtgatggtgtatgcctggcatcccagctacttggggggctgaggcacaagaatcgcttgaacctgggaggtggaggttgcagtgagctgaggtcacactccagcctgggtgacagaatgagactgtctcaaaaaaaaaaaaaagaaagaaagaaagaaattggttccagttgtactttattgatgaagcggtctccctcttaaccttactcaatgttgagtatgatattttgagctatctgttaaatgggggcaatagtaataccattttcatttagaaaattcctgagcacttaacttgcattatcttaacattatctcattgaattctcacaacagccttatggagaaagtactgtaatattattcccatttttacaaatgagaaaaccaggcacagagaggttaaatcatttacccaggatcatacagccaacgtatagcagagctgggatttgaaccccaggtagtctgattccagagtcattttcctaaaacaaccccaaaaagagccattgtgaccttgatataattcttacctcaaagagttgtaaggatgagaatttaaatacttagcaatgtatcttccatgtaataagcaattaatataatgatcatttatattacattctttcctaaatgctggggtggattgggctgttgcaaagatactgccttcctgtctctctccaacttttcctggctttagcatctgtgcagcctgccgctttgtatcttaaacagcatagataaggaaggaagcaggggtggggcatgggggctgtggtatgtggctctgctggagttcaattcagcagatactccctaagcacccactctgggctagagcctgttctgatgccagtggggatgccaagatgaaatagattgtggtccctgctgtccaggaattcacagtcagtctgggaggagagatgacactgaaacagagtattttaatacaatctcctcaggtggatcttagccagcacatcagaccccactgcccaacggctcataccacaactagcagggcaagaatgccttgctattatattgattgttaaaataataaacttgttaatatctttgacatcattaaagtcactgttattaatgtagaaagtagcagtatgtcttattgcatatattacctccagttaatggatccatgggcactattggtgcttccatcacatgtctagcaatgtgcccaaaaatctctatgttgcttgaggagaggagactaatacatgagacaaaaagggtttggcacaagatgggatgctctgctcaggggttggattggtggttcagatgctcagaagctatagggacttacaagtgcctccttactgagcactgggctgcgtacaacatcagaacgggtgatggctcactcttcagtgtccacaaagccctttctgatctgatctcggctaggcactctagtatcatcggcatcatttcttgttacatcctagactctgggcaaaccacaatacatcatattattcattaaatgtgggatctctgtcaaacttctgtaactttccttatgctatttcctcttaaatgtactctcttacctgtgtgtgggttaacttcaactcatccttcaggacaagattggaacttactgttgactcttcttgtctgagtcgtctccctttctttctgtcccttaggtaattgacatgcctccaagttcctagttgctcctgtcatagacctcatcaagatgaaacataggttctggttttcttgaggttttcaccactgactggactataaattcttccaggggggagattgtactttattaacctctgtagttttatacagtgtctggcagtaataggtgaacaataaatgattttttgataaatgagtaaatctttttagcatgttattcctctacctaggaacctacagtaacttcatggcactcaaaactttgtagactcaaaagctagtaaacacagtagactatacatcttcacatgtacatgaaaacagtaatgaggatttgattttccctactaattcacctctactctccctaccccaccacctgcccaatatggtaatacatggtgctgcgaggttgccatgaaagtggcattcattggagataacagtgtaaattggtgtaactcttttggaaagcagttaagcaatgtgttgccagagccaataaaatgttcatatatttgaccagtcattccacttctgggagtctgtcctaaggaaatagtctagtttatacaataagctttccctcagatgctattgtttataatagtgagaaattggaaaaagcctaaaagaccaccaatctaaactatgataaatctactcagggaaaaccacgagcttttaaagcagtagtgtaaaaaatgatgcttaccgaaaactatgcggcagtaaggacaaatatgctataatatatataataaatgtgttataatgctaattgaaaaaattaggctacagagttgagttatctaaccatgtaatccaaacataatgtgcaagaaaaacactggaaggaaatacatgaacatgctaacagttatgtcccatagaggggtgggggttagatgatttcatatggtaatttcatataataaacatactcaatataatagcacaaattcttacccaaattattggttaagaattttaaaataataaaccagccaggtgtggtggctcacgcctgtaatcccagcactttgggaggctgaggcgggcggatcacgaggtcaggagatcgagaccatcctggctaacacggtgaaaccctgtctctactgaaaatacaaaaaattagctgggcatggtggcgggcgcctgtagtcccagctactctggaggctgaggcaggagaatggcatgaacctgggaggcggagcttacagtgagccgagatggcgccactgcactccagcctgggcgacagagcgagactccgtctcaaaaaaaaaaaaaaaaaaacaacctctgatcttacccattttaaacaaagaaatgatatggtaatattgctgtggtgacagtagaggattatttaaagaatggtaataagaatggagagaggggggctacattctaaaaatattgaggccaaatgaggagggcgtggtgaataacagtatgtgggggaaatgtatatgcctaatagagaacattggttcatggagtttaatgagatgtccaaggtcacacagctagtaagtggctgatcctggatttaaaccttgttctgtctctgtccaaagccatgccctttctcctgcagctgagacacctattacagttttggagaaactttttttttttcttttaaccagttgcagtgtagaagcttgtttagtgtagtgcctcctttttgaggggaagggggccgggaagggttaattctttctaagacaatgacaagggggaaagaccatagataccaaagctgcttctgtcatgatcagttgaattgatgagtttagaagttcactaggcattgggtgtgttatacctgtcgttttgagggctgttttttgtgaagttgcaggggttcattggttggctttcgtttgatgcttagcttatggtagcagggcatcttggacataagcgtgcatatgtataccgtattacatgctaatgaacattttgttcattacaccaagtttattaatgatgctgctgctgtgggagtgagagaggggtcagggtggcagcttcaaacaagggacagtgtctaagctgctctctgaaaggaacggttcacctgaaccatacaatgccctatccccatacttctcaatgactaatccaagaaaaggtgattttgaacttgagtctatcctttggagtatgatactcatcccttcggaagaacccatttcacattgacatgttcactctctgaccttaggcatgttctctgcgctagggtttactctctgcactagggtttgcctaatagagaacattggctcaatgagtttaatgagatgtccaaggtcacacaactagtaagtgctgatcctggatttaaacccactagggtttactcatttataaagtgaatgacatataaccactcagaggattgttgtgtatagatttggtagccttaactcatgaagagtcttgtaagccacattaaaggatttgaacttgattctttatggtgggaagcccttgaaggattttaaacaggaggtggcaggggcacacttgattgatcacacaggaagcagatgcttagtaatgtttgtggagttaatgttgttaccagggagacaaaggcagagtggctacaactgtggcatcattctcagtggtcccctgtagaccaaacatgtgacactgtgggagatgatgcttagagccctaagttatgtttggatcagcaccctggagagaggtcacccgttccttccttcccctgtctgaatgtgggaaatttaagatatatgttgatgcatatgctgtcttatagggtcaagcctttggggctgtgaggggtgccactcagtgtgttcaaggagaaggattgttgtaatgaggaaaatactgattctgcatgaaaggattttaatcaactgccctgatacctgagggacacagtacttggctggagtgctgaattgtgcaccatccagcccttgcttccagcctgctggcttcctgcttgggtgcctctgtctaggaagacctgcagcagctgtccatcctgggagtattcctgtctatgcttacgtggcacatgtcaggtaacagagcatgttatctcctttgaccctcacaacaacctgtgttacagggatttttatccccattttacaggtggggaactgtgaacctcagaaaagtcaagtgcctttccaggtcatacagctagtagacacgggattcaggccccagcgctctacaggcaaggagaaatccaaagctaataagcccccattactattttaacttagagctatgcctgttgtggtaggagttaagcctccctgtcatacaggttgggagatgagaacaggatgcactaccacggcacagccttctgcacccttactcagccacagaatgtaggagttccatcagagataccaaatagtgagcaactgagggcttcttgaaatatcagcccttggggccctgttgcccagcaggggagcccaatctgctctagagggtcctcaaagcacaaggaggccttggtgggaacctttgcttagcgtcctcttccacctaatttctcaagttgtattccttatgagctctggcagctgcattgttccatatgctcatttatttattcattcagcacttaataagtacctactcttgtctttccttttatgttcaaggcacatttccaaatactagagttttggtgagacacttgaagagactttatcgcatccaccgtgatagtatttttttccttgatcacagttcagctctaggttaatattccattagaactgaccaccttctcttttatactcacatggaaaagttattgcaggttccaacaacaacaataataattgaggttgagcatccgtaagttgaaaatccaaaattctccaaaattggaaactttctgagtgccaacatcacattcaaaggaaacgctcattggagcatttcagattagggatgctcagccagttaagtatctgcagatattccaaaatctataatctgaaatgcttcttgtcccaagcatttggataaggaatacttaacctgtagcagcaggagctaatatattcgcatgctttctgatgtgctggacactattctgaatgcttacatgaattattttatcctctaacaaccctagagatatgtattgctatttccatcttacaggtaagatagacacttcccaaaaggtcatgtcagccagttcagtaacagagtgaaggcatttggtttcaggtatctcctgacgacattccatgtcctgtcacacaggagtaaggattcaggctttggctcctgcttgatgtcaagccatgtatttaactcctacacacagcaagctttacctctctgtatactgtgtcatatgacccactcagctctgagttatgctgaaagaaaacactacataagctcaaagcaaaaagcagttttgtacactgatgaaaatttgacgacgcacatggaagattgaaggtgcactaattgtgcctttgagcactggttaagagctactcaatttgcccagtcatagtcttaggtaagtacagtagcattcaggaatgaatctggtgtccattcctctcagctccctagatggagagagaagactggtttgtaaacagccatgataaaagacagaaaatgagaaaaccttttcttctccctttgaccttcctggctggtttcctggtgtttgtcaaagtatggagagagggtctggaataccagactcttcaggaatatacccccaggcttcaggaaagtggttccagccccccattaagcctagattgtcttcccttgcaggatgtagcatgacgtagagcagagaccaagataaagcaccattagaagtgtttggtggcaagtccttagtctccctatccccttctctcttaagagagagacaagaaaaggaaaaaaattggatagttttttgtaaattagtctgacaccaatgtctaaaaacaatcaggctgaaggacttggaaagaaatgaagtaaacttcatgttttctttgctttggtttcatagaagttcacagttgggcaagagtggcttagagctgtgttactcaaagtgaagtttaaaaagcaaaacaaaagaaaaaaactggttcttcaccacaaatagttttgagaagtactgacttatttagttagtgtgacagtgtgaaaaataacctaagtcttttgattatgagattaataatacctgcctcagagtactgttttggggattatttgatggtaaataatattttgagtacttaagattggcctactgctatgcactgtatgtgtattatttaatcttctccacaattctgtagtaagttttctgaaactttggataggttataggacttgccagaggtcaaaggtgtggtaagtaagcaagtaggtagaatttgaatgggagttatgtggcatgttctgtgtaaggagcctgttccacatgagggctcccttgtcactgtactttctctgtatcactaatggtaaagatctgctttctttttctatcactgaccctaacttactttgttaccttgggcaagtccctttctctgagacttaatttttcttatttaccctcaaggatatgccacatgacctaggtttttattccctagatcatgcagcatatcctaggaaccagggactttattcatctctggttccacagcacctagctagataggcctggcatatcctaggaaccagggactttattcatctctggttccacagcacctagctagataggcctggcatataatgagtattcagtactgaggccattggttactctagaggatctgtaaggctccttttactctctactttctctgaacatcctacatactttattctctgccttccccacccttcctcaacatcatattttctacctagttcataggacagcatgaccttatttccttatgtctgcctgtcataagcagtcttgatcctgcatactttcagacagcccacatgatacctatgtttttatttgtctgtgaaatgtgactaggataaaccaccagggataacacaaattaaggggtagaaggggcctgctcacaaaatcagaagaacactcttattccattcctacccagttgggcctgggcctatggcagccctgccaggcctgagtaatggccatagcctggagcagggttttccttgagctccatcggggtttccagtaattggaacatggcaccttccaacttgtaatggatggcaaaacaagaggggcatttgtcactgcctgacttccctgtgggaaagaggctcataagtcacagctgacaaaccctttgatgacttttaaacttcatttacagaacagaatagctataatcaaccaacagcaagcagtgactaatcttgccacattatcagtgtgaggagccaactcttaaggcataggaatggggcgggggccatccccaaagctcacagcaagtgctgattggctcttggacttgagagtatgccttcagctaggccctgtgagtttatgctcaaaggatcagtgttaggaggtagaggaagaaactgacctccaggcagatacagggcatgcccagttttgaagccattctgggccaagattatgagaccagctctggtctcgcacatattcatcctacctctgtcatttcctggcttgagcaagaccagacaccaagctttggtttcatcgtatgtgaaatggtcacaacatgtatcatcactatctcatagcagaaggcttagtgcagttcctgggatgtaagtactccacaagtattgatgatggttatcatgatcacatgtttgggcctggagtaccttttgtggtcacatggtttaaaacctaggtcatatggcatgtcagcaaagccaagaccattcttcctgtggatgggggctcagtgggagcaatctagtggaatgggaataacacaggctttagaatcagacaagcccttgggtctttcggtccaaagcatgcaacttaatgtgactgtagacaaattaagctgtttctgagtctcagttgtatctgtagagtgcagatgatactacatatctcattagattgtgatcaggattacaagagattatgcctgtaaagctttcaactcagtgcctggtataaagttctacatattaaattgtatgttccctttttgttctccctcaaggcaagaataagtatgcatctatccagggaagcaggagacagcagtgaagacattcttgtatttcaaacttctatttccagctctatgtacaggaggaagaggagaataaggggatcaaagaggagaaagggatacattttgtatattgttcctccctcctgccaggcctcttctggtgtcactacccaatgggaattcctcttaaacactctcccttttggtagagccttccgtgctgctcctaccccttctctgatctctcagactactttgcttggggagtagaccatctcagggcacgtgtgccttgtggccatggtagatgtcgcctgctggattgggatttgcttgaggtcccagaccaaccgctggataaataaataaataaatgattggttagttagttatttgataatacctggcccataattagctccgtgtttggatatttataattacaatcagatggataagtctgtgtttggatgacttatttggcaaaaaataaagaggttgacaatcatttgtaggtcttcaattctaactcagtatcggggattataggcataagttacctacccatccctccttaacttgtccccttcctggaactatgaaggggagcttgtcgcagatggtaagcctcagcctaaggccacagacaagagtagagttagtgttcaagatgcagggagggtgggattatatacccagagcatgctatggggagataactgaggcctgccttctgtttctgctttggggtatcctctcagggcccattagatatggataccaatgtcagtagtataggaccgcgcagtacagttgaggggtgagaatgactcagcaaagctggaacccctcttggctggtggttccgtcctctcccagccccattcagtagtggtttgacaggaatggggcagggacacctttgtgaagtttctaggtttggttgcagatactaggacaagggagagcatgcataggctccctactccctacccccaactcccttactctcaggcaaagtgtgatgcacagggagatgacatagtaaagaacataccatcttagggctgggatgtggaggagctagagtgccaggctaggttcatctgttttcatagagcatttgggttatccagtttcttaatacctgctagtcccacccattatactagcactttactcatattatctccagttcttatcctaattctgggaggttggtataatttccgttttgcagttgaggactctgaggcccagcaagtgaaaggatatggccacagttacagtttcaagtgataggtctcggattggaactcagtcctgtcggactctagggcctgagctatttttgctatttcatgtgcatttgtcctttgttactaagaaatcgtttttaaaaaacaggttcccagagagggggcttcttgaaaagcaagtagagcagaagactggtgagcacggtgtttcccagcatctccacagtgccagcacagaggaggacactcaagaaatgtttgttaagtgagtgaaggagataggaagtgggtaataatagaaattggcataatccatattctttgatagtacattacagatgcaacagagcgctttcacatcaattagcctatttgattcttgtatcagacctgaaaggtaatcagggaagagattatttctgttttcggattaaagacaagaaggcctagggaagttaaatgacttgttgcaggtcacatgactaagaacagcagagccaaggccaagccttctggacctgtagcctgcactgcttacacttcacccatccaggagcttttgctgtttgacatgcagggagctgactcatgagagtgggaatggtcaggaactaaagagcattccttgggaaattagtcctgtctggccagtaacaatcatttgggcactgctaatgaaccagggcttggccagtttaatgagattaatagatgttctgtcatccctggccgcctggtaaaagcaggagcctctggaccaaggaggccctggacactgatgagtctaattgcttgactttctccagaaatagtcttcccatcactagtagctgttttccttctgaaccacccggatgtccccagggttatctaagggcagagagctggccacaggctgctgtgaccctcatccccatgcaggagaataaggccagaggggtccagcaggactgaaccaagacagagactataaatagcattgggggcatcaagacctaaagcagcagctcctcccttgaaatgagtatttcaggaggaagagatttagtgctggggaggatttacagagttctctgagtgcctgagactagacttgatctgataggatttggagcacatgaggggtgacatggcagagttttagagtgttaagacagccattgagacagtggaatggagagtgtcgagtaagaagccttgattcaggacccctagctacactcccctcaccagctggttgaccttaagtaagtcacttatctttgctgatcctctttttttttttttttttttcatttataaaatggggcgggatgggtgcagtggcttatgcctgtaatcccagcagtttgggaagcaaaggagggtggatcaggagttcgagaccagcctgactagcatggtgaaaccccgtctctactaaaaatacaaaaattagctggctgtggtggcgggcacctgtagtaccagctactcaggaggctgaggcagaagaattgcttgaacccgggaagcggaggttgcagtgagccaagatcgtgccattgtactccagcctgggcaacagatgtctggtgagagccctcttacagtttcatggacaaccatcttttcactgtgttcgcacatgatagaagacacaaagtagctctctgggcctcttatttgtttattttgtagagatggggtctcatgatgtagcctaggctggtctccaactccaggcctcaaaggatcctcccatcttggcttcccaaagtgctgggattacttgcgtgagccacttcctggcctggggctctttttttttttaaaggtattaaactcattcttgaggtctttcccttccctttgggacctcatcactcccaaagccccacttcctaataccatcacattagggattaggtttcaacacacagatttggtggaggaggcacattcataccataagagatataaactggctttgttcactaaaattctgtacaactgtgaggaattgtagtagaaaagggaaagggtgaggaccaaggagagcgtgtgtggctgactcaaggtaacataatcttgccagggaagtcagaacccaaggcatccctgtgccatgtgcaatcttgcccctgcaggtgcctgtttttgaggtcctgattccagttctggctttgctctattaaccagttaccttgcttctctgaacctatctcagtttccctatgtcaaacacctcctcacagggctgttgtgagggttaaatactgtaatactgtgcagcattcagtaattagtggccgtccttttctttttttctttttttgacggaaagtctcgctctgtcgcctaggctggagtgcagtggcggtgatcaaacagttctcctgcctcagcctcccaagtagctgggattacagacatctgccaccatgcccggctaatttttttttttttaaagtagagacggggtttcaccatgttagctaggctggtcctgaactcctaacctcaagtgatccacctgccttggcctcccaaagtgctgggattatgggcgtgagccactgtgcccagccagtggctgttgttactgtgacggctctctgggtgtctcatttacccaaagatcagaggtaccttttagggcttttctacctttgcaaacccctgccacttttctccatgttcaggcttgttttttgttgaatttgtttttgccacatttcttctactcttactagcctggagaagcaggcccatccctttgagccgtaaattgcatttcaaagcctgtttcactagtggattttaattagcttaaaaggcccagcttttatgcagcaattgtttctcctgcaggtaaaggtgaaggcacttattggggagccagtccccagttttctcaaacgtagcttttttcttttttcttttttttttttttttgagacactgtgctctctcccagctcctcagtgtcctgggggcctgtctcttaccagccccaaatgaaaaatggaatataaggaccctagacttagcgtcagaagacccatggggtaatcttgtctctgctactcactagctgtagcatcctggccaagtttttactgtgggtaaaacttctcttctgttcttccgagtaagagcatttataagctccatgtgcacacaggtctctgctcatctgacattgcagaagtctctaggaataaatttgcttctctcctttcccccagccaccaagaacaatccttctacccacctctcctcagctcattgctaaacctaggacccctgggggctgcagacaccttgctctcaattacacagctaatctgtgaggcagagcttggcccagggcaggaaatagcttaccaagtgaagtagctcctgctgaatggatgtcaatattttctagggctgccactctaagctagggggtaccttgaaaagcataggaagaattgggtgggagggattgagttggtctgtggaagtgggtgtttggttgaaagattagaaaatggtatctgggacctctgccctagtggtcctaaccacttaaggcagcccacagctagaccttctgaccacctcctgggacatatgtttaaccactccctccctaacattgattgaacacttactgtgccccgagttttgtcaggcctgccctataacatttgcagggcagagtaataagagtacaaatagagacccatgtaccatatgtttaaacatttgaaggttctgaatgaagctaataaattgtgatgttcccaacaacctggaataccatgtcttaatttagaattcttggactcattaggattctgtacttgaacctggcagttcagggagacctagcctggctctacctccttttcattccctttcccacctctatccctcacttagaggagcctcatcaacatgtgtgtggtcactcaagcctttgcacacccccacagatacctgtctccttgggctgagggagtccacacaactgtagcacatcccactttccaaaggagtgtacagggcatgaaagtggatagggggctgtttagacgaggagctcaagaggttgggtacctagcgcatgccataggtgagcatttctccttttaactgcagatttctcacccagagcagcatttgcaaccacatacatacacttcccaagtctctcctctacagatcagaaaactgatcttcatatgccatggcttctggctgcccctccttggcattatacagaatgtgttccactgtgacctttaccctcatctagaatggggttcgcagatggcagtattggaataaagaggtgcaagccagtgtaattacaagatcttgtgaagggctttagggtttgcaaagtccttttatgtacatcattccaaaccccaaggaatgagagaaaagactggcagggccaaaccttaaaaacttggctcaccagtcaaggtgagtcctgatctcgtcacaataccacgaacagctgttcagcaaatgcttcctgctcagtggtgcttgtggctcccagtagaggtcactctttgtatctctatccacaccccaggcttggttgactccctctagccaaagcaggtggcttctccctaggccaaaactatagcactttgagctgaaccacctaggagagaatcatctgatgcccacacaggggccctattaacttcttgtatacccgtggatagacaaggaattaacccttgaatggcttgtcatccatgtaggagagggactgtcagcgagaactgtgaggaatggcaagcccatgggaaaaacatgtattgagcatttcctgcctcgtatgcacagtgtgttactacctttgtgtccctcactgcctgataagtgtagatgagtggaaccaaaggcaaactgagtaacaagagtctgtctctttccaagtcagttccaaagctggcaccagccccttcatcagtagcagtgatgggaccctctcagcccctttcctttatctgagataatgcactgctgactctagtatatccattgggttcactttaagcctaaccctgggagcagtttcttcccaagttgggctcacgtccagcctatgattcccttgtaaacagtaccacctgctggtcagaacgtgccagcttccaggctgggaggatttaagagaaaaagagtctcttatcccctagtgggataagagatacagatgtatcttttccagttcactgaaaagaagtccccccaaaatattaggtaaataggttggcagactgatgaaagtttttatatatgctatttggagtcttttatcacctgaaatggccttaaggttaggttactgagataggagggttccaaaagggagtggcatcaacctgtaccaatgagcagaagactgggccgggaactgccaaggcttaacttgaggcttttcctactgaaattgagcttctctcctttcccctttcctcttggagcctatgcccagccgtaaactgtacgggaaaaatttgtacagccctttggggtaaaagacctggccagaatatagagagcaaagggtaggtgcagtctcatctctaagccaaacagaacaaaatttgaacgagttagtattaatatgggtaactaaaaaataaatttattaaaaataattctcaggtgaatgtgctgactttctgtggtatctaaattggctttagctctgggaagcaaaatgataaagttgaaagaaatagactttagtgacagactgacctgtgttcgaatgctcattactagtaagttaatgaacttgtcaatcagtttctggtaaaatatgagtaatcatgacattaacttgtgggatcttgggattattcagtattgtataccacccttagccacagcgagtgcctggtgaggctttgtgttagtccattcttgcactgttataaagaaatacctgagactgggtaatttataatgaaaagtttaattggttcacagttctgcaggccgtacaggcttctgcttcttgggaggcctcaggaaatttacaatcatagtggaaggcgacggggaagtagacacgtcttcatatggccagggcaggaggaaaagagacagtgggaggtgctacacacgtctaaacaccagatctcacgagcagtcactcactatcatgagagcagcaccaagggggaaatgcatgatttcagtcaccatgatccagtcacctcccaccaggccccacctccagcactggggattacaattagacatgagatttgggcggggacacaaattcaaaccattatcgggcttagctagcatacccttttcaaaatggttggtagcaattcagacaggtctgtgtctggatcagactaagcagttttcttttcttttcttttttttttttagacagagtctggctctgtcgcccaggctggagtgcagtggcttactgcaacctccacctcctgggttcaagcaattttcctgcctcagcctcccgagtagctgggattacaggtacccgccaccacgcctggctaattttttgtatttttagtagagacggggtttcgccatgttggccaggctggtttcgaactcctgaccttaggtgatgcacccgtctcggcctccaaagtgctgggattacagttgtgagccaccatgcccggcccctgcaattttcatcatatggtggtggtctagagtaaacatcacttgcaaataccatgtgaccatggttctacattgaagatcttcaaatttagatcctgaatgggataacatttgagatgagcattaaaggagtagactcaaaagaattagagtcaagcagatcagggggtcagatcccagccctgccattcactaacattgtggtctctctgaatgtgagatttctcccttgtaaaatgttgtggttctgcatatcatgtgagtaacaaatgagggaatgtatgtaaagcacctggcatgaggtcagcagccaatatgtggcaactcttggtaatatgacaagaaaacaagatgcaggaacaggtaggctggatgctataagggttaaggaaggtaagaggcaattcatttatccaggatatgggccgtgggcagtccttgagcccagcccagggacccagcttcaccgaggctctttttcttcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctgggtaagcctctcttcactatattctcctagtattctctagaatagctgctatcactatccagttctcaacccccttctctctttctctcaccgctaccactgctctgagattttataaatttataagctatgtttaagttttaaatagttataaaattaatccctatagggaagaattttagaagcctctggaaaacacttctgacctgtctctgctttctcagagcttcttagtgacaggctttacagttccagttaaaatgcagattctccagagaaagagaacagagtggcctagaacagcctgttacaccgggtacagatgacttaggttagaaccctttctgagagcgagcaggagggcctgagagcacaaggacagtgtgaatacgcttggttttggtgtcatgtccatgtgatatgactatgctagtggtctctcttgaagtatgtacagtgttcatgcatgtgcatttactcctgtgtatatgtgtatgtttgaaaaggggtatctgtatgtgttttttcctgaacaagaagtatatggattgactgaacatgtggagatatgtggacacaacccttgtatgtatagatgtagtgtgtgtgtgtgtgtgtgtgtgtgtgtgtgagagagagaacatatttgaatgtgtcagcagatatacatatattcatttaccaggtatttattgagaccttttcatgtagtaaggactattctaggcatgaaggtgtttggtagaacatccatgtgaatgtgcattggctcatttgcatgtgggtagttgtctatactgagtgtacttgagaatacacgttacctgtgtgtgagtttcttacctggatatgtgaatgtatgtgtgagtgtggctctgtgtatgcgttcccatgtacctgatgtgttacgcatttacatgagtgtatttgagaatgcatataggaatattcgacgtgtgtgtgtggtggggcgggggggaggacatgtttatgagcatgcctggatggatctgaaagtgtatggacatataaacaggcatatccatgtgatacctggatatgaatctaatgtttgaagattagatgtatgaagacctttgttggcaccatcagtgagcagaatccatgtgtataccgtgtaagcacatgaattgctgtgcgtgtgcatgaggttgatgtgtgtgggcacactgtcatgttagcattccaactctgccttctccctccacacagacatcaacatggctggagagcctaagcctgacagacccaaggggctaaagagagcagcatctgccatatacaggtggggctgtctgactgtctgtctgtctggtgggatgactctctctttccacagagggagtaaatgctggtgtgacagtgtgctgaatctagaacttggggaggtgtctggagatgagggcctgtggaaagtgggctgagtggccgtccctaagctccagccctctcccctttgtttccccagtggctacatctttgactatgattactaccgggacgacttctacgacaggtgagcaggggaggggcgtgcccaggcatgaaacagccaagctggaagggtcttgagagattgttggtgcagcccactgagttctccaaatgagaaccaaaacccagaggtttgcctggggttgctccaccagtcggtagcagagctgagactggggtcctgtgctgcaggtgctcaggccagagctcctaccaccatacaacactgtctgccatgctaactgccctttttccttcttgtccttgggtgaggctcaaggagaccgtacagccaagagctatgtaagtgtggctagttggaatacacaacagggtacagcgctggttgcagggagtttgagcccttccctctgtgaggtgcccaagcagctggtaggagccccagagctcagtctaagcttcttgggtttatatttagagacaagaggccagcagccatttggaagtctaattagtccctggcgggctgtggtctaccctgcactcccaagccctacccagactccagcccagaggctgtgggctcccactacaacagcactagccacattcttgagtagaaatcatggtagatactaactcaaatctctcctcctccctgcttctctccctctgtccagcttagcccaccccaggcagcccaagaagaacagtgcctctctgagcatgagtcgtccgcccccatccccaccccgcccctgtgagtcgtttcaggagacagtgtggtgtagtggaaagtgtcttagcctgggggtcagaagatttagatgctaatctcagctctgccactgaatggattatgtgatcttgggcaaattcccttcccagtttgtgaaatgggcttgcaccaagtgatctctccaggctcctccagctctgggattctgtggttcagtgattctgaccaaggccagagccgttccctccccttgggggcagaaatgcagggtctgggatcggatccattcccagagactctccatctgcagccatcaccacctccaggaaggggctccctgaacaaaggagccccaaggaatggggcttttgcccagtgatggcaggtttcctggccgttgtcaggaaaattgacccaaagtttaccccctgggctgcgattccctgaaaaaggtggcagcaacagatgtcagagagaccacttctcagcctactgagtttctgcctggtcagctggaaaggaagccctcctagagagggcttggagatgactttggttgggggcagtgcacagcctgggagccctgggggggtctgattgagctgcccaaccttgatactctaccaagcccctggcctttgtctctggaatggagcacgaaggatgtggtgattaaggaggtcaagtaaggaaagggcttagagttcagtcttatgcctctgaggtcatgggttcgtgaattgagggtctcagtaccctgacctttcatctattacacgttctaaagtgtgtttttaaccgaattctttcatgctgtgcccttgggtggacactgaatgtggatagccatcctcatttggcatatggggaaactgaggctcaggtaggctcagttgacccccactcccatacctctctattcctagctggggatttgtgctgctttgagatttgcaaactctgagcagaggttggggtggcagttgaccaagcagaagccaggtcatgtaatagagcaggcctgggtgccaggggacctagggatgtctcctcttttgaatggggtataactgctaccacctgatgccttgcctgcccttactgggcctggatggttggagaggttgtagtgaggtagtgaggatcccaacagccatcagggtccggcaagcccttcctcttcactccagggcttgctaggagccagcagaggtgtgtagtgcaggcctcccagcccctcaccagccacacacgtttgtagccggagctgcaataccgccctggtggccacaagccatgctgcagcctctggcccatctgccctcacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagtgtgagtgactgtatcatattcctaagtaatttgcatttttatcattagcaaaataatagaatcacattttttacattggaacatagataaaacaacaagtcttccacagttctgctgctctaacacagccaagtattttcatgcatttctaagaggaaacagctgatgttttaggaggaggggttgtgttgggcacagagagtccagtgctggatatggtgcccagtgaagaaatggtgccatctttcctctagtaaggataaggacaggtctacccaggcccattactccacattcactctggtacacacatgctgcttaactaatcacccaggaattcagattccaaaagacacatgttcttgctcaggtgcacacagaagagcacaccacacatacacacctgtgctcctgtctgtctttggtccctttcagagttgagagatcaggagaaaagatagccaggttcagaagtgtgtgctgtcactgtagggatggacgccaggtagtctaaggaggagacctttttcctaagcagggaaaaaacaaaacaaaacaaaaaataactgctttcctggttgaaagaacagggctgaggttttgtgctagtgtcaagcctccagccccctaggtgacagccctgtcccccctccactcccagtaaagagcagtgagctgcaggccatcaagacggagctgacacagatcaagtccaatatcgatgccctgctgagccgcttggagcagatcgctgcggagcaaaaggccaatccaggtcagcctctgaggattctcacccacctccatgaccagggcacagggcagagcatggggaaatagtacatgggagagaggagctagggtggccctgcagatcctggaccacctgcactcaccatgctgaggccagcttccgctaaggtgctgccctagacagctaccccaggctgagttttattctcccctcctccaccccttcccctcaagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggtgagggcctggccaggggcacgactgggactcgactgtgctcctactctcaggaggccaacaggggaatgggcagcctgagctggttgcccccactgtgaacttcctgttctctccttcccaggggttctggtcctgggggaaagagggaagaatgagcagggggcacttgcctatctcagacaccatcagaagtcccactgaggcctagggcagacctcccccaaatgcgggcacattctggcctccggtttccacatgagttggagaatgggagattcggacataagggagcacacacggcctgcagagcttcagagcagggctggggtggcttgtggaggccacagccaggaggtgggtttttctaaaagccattgctgcttaagcatgaagcaaaagctgtctcataagggggtgagctccccgcctgttactagaactattcaggctgaggccggcaggccatttgacaaggagcttatgttgagtgggagggtggaccaaactctgagtctgtgggatatgggttgtacacttgctgctcatttacttaatgagcgctcattgagcaccaagacccagatcatactctctaacttcacataaccttaacaagagccctgtactatgcagagtattctgttcccacattttaccctgtgaggaaatcgaggctcagaaaggctgagtggcatgctcagggcatcagctcgtagggactgagccagggttggagtccagactgacttgctggatctgcagctttctccttttcagcactgctgggttctatcgtgagaacagatgggctcatggccatgacggttaggaggtctgccttatgctagctcatctctcctttgagcgtagcctgatccttcatcttattttctcaggcatagcagtgtccataaaggccctaacaaagacttggatgcccccagagatggggagctcaccagtctataaggctttcagccttctccagtgcaggctctctgcacagaaatggggctcctgccactcccagaacacccttcactggcctgtgtggggtcctcagaccacccttccaagttcccaagccagctttgttggctggtcccatagtcattccccttggctgttcctgcgtcttctgactgtgtcctctagatgccctctggaccatgaagtttttctggacaaatggctcagggcaggactcagagctggcaatgagtgatgtgtggtctctcttacctcctccctatcaggaacacagccaggacacagacgcggatgatggggccttgcagtaagcaggtacaggggtcctgtcctgatgggcagagggtggggaatcagtgaagtggaggttgtgccttttccctggattgggcaggaagtgtcacgaagcatacctggccaagtagcactgactatacccaagaatgaagtcccctccatatctagccatcccgtcacaccccttcatgcttggggcttgccatgctgaggaagcaggtgccgtagatgggccaggcgggcccacctagcaagggttccttccctcagcacactcagccatgttgcctgtctctgcccttgaggagctcctagtctggtagaggaagacataagccattaccacctagtgtgagcaggataacaatagagcgaggccaggtcatggaagagatgatgtgtagctgagcctgctagtgattgagggagcaatgttccacaccaggggaatggccttagccatacagagctgtgacagtccttggtatgtggtgaggccaagagcctcctgtggctgcagtgcccccctagttggtagaggactctgcttattgtcagagggtgatgattgtgaagggccgtatgtgtcaggcttaggggctgggatttgattctttcatggggaggaaatgccctgtgtgacaggagctgcacctgctttctctgagttcatcttcaatcccacaagctgatgattgtaccaatataatagatgtggaaacagacactaaagggtgcagggagataaggtagtagttggtggagcctggatttcagcccagtggtgtgtggcttcaaagcccactctctggccactgtttaccatctactctgccctaccttaaaggaaagccaggccacacctggctgtgcctactactctctgacccattcccttggggtggcttgggtggaggaaggtctcaaacactagtgtttccagggaggtgtctggatagatgacacatttatgctgtagtaagatatcccaccagcaaaggcttccagaagagctttagaaaattgtacatatgcagtcttcttttggaacttcttggtttgttttgcctgggatgcaaacaaacctccatatccagccatcctgctacacccctttgtgcctggtgctttccaaagcttgttaaaatagttcacaggtgagttatatgggctcaggtgaggaaatggaggttcagagagcgggtgagacttgcccaaggttacatggccaggaaattatgaggccacagccagagtgcaagaatctctctgtctccagacatcattccaccctttcttccctaccccttttatcagcaacagggtctcttcctctcagccttagtctcttctttctctctctctctttctcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctgagatgggatggtttgtgttttctcatgaagatatcccggcccctctgccaaccaaaaagctggtctagggtgcctaatactgatccatctggaccttagtgtcctcagtggtgattaaaatggccagtggggccactggggagggttggatatgctggcccatgagcatcttgctggctgaagtgtcaagcagttgtgacccacttggtttaccccatagtaggtcaagaccttatctctttccccagcttctaagtctggtctttcccagctcttaaaaggattctagagtctgccagtctctaccttctctcttctggcttaggacactataattttttcatttggacgttgtcctcccaccagcctcccagtcttctgcctctgccctgtaccatctcccagcagccacgcagtctttctgaaacgtatcccttccctgcctaaaatccctttactgactcttcatcatcaggacaaaaccctacctcctgaatgtagggtgtaagatcctgcttactccagcctctcctgtttcttgtcaccacccctttcctgcccctgacacaaaccctacatctcagtctcacaaaacacacaagttcttcacactccgggcaggtttggtagcaaggaatagagcgtactccagtgacagcaatcagtaggaagtttgcatccggagacacgcagcctgtctgcccctgtcttgggccacccgtctagacatttgttctctaacaatcagccgggttccttcaaacgtgtgctgcttatacatgctcattgtgtactgctaatgtcacctacttcccccttcattccccacaatgaatggatccattttccccatgttcaagttcccaagagagaatcgactgccactgtaattttttttcctaatcactcataggttacaagtacctaccctggtccagtgaactgcgggattcatatgtggccacttaggctggtctcgttggtatggagctgtgggagggcagcacccagaaataggctttgttccaggcctggcacgtactcctcctgctcctactttctctacctgggaaatagccgctcaggacgaagctgctgctgtggtgtcgccacctctgagaagtctcccagaccctccgactgctctttaattgcctgttctctcctctggaagccttcccccaacacagaaaaattcaatcccatcatcaaaaagggctttaggttttccctccatctttacgtgttgatcaaagtttgcagatctgctggaatccttattgaaaactccccatttcaaaccaacccggtctacagcctccagggaagcttcctcctgggctttggctccatgttttggtagagggtggaggctttgggcagtgctcaaactccaccgggaagtctctctcactgagcagccctcctgcctgtcatcctgggcaggcgagcactctgaggccccagtgtagctctgtgctttgatattcccaagctctgctggggcctgactaggccagccccaaggtggccagagttctggcttcatacctgagccaaaagccccaatccatgcttggccattgcctgagtattagctgccccagggggatcacggtccccatatatttgcttgccatggaccctgggcagcagggagagagtagagatttgtcaagagcccatggtggaggctgaggccctgaggccatgagatgcaggcatggggtgagaaacaggccccttggaattgggctgggccttggcccagcttagtcaaatcaaaaggcttctatttggagagctgaagagggtgtacagaggaaggggctaggtctgcaaggagtgcctcatctccctgaagagctctcagtggaacatacttcacccatccatgtacccacatctttccttgcccagaaggcgagagccagctataacagacccatttcaataccctggcaagtcattactgcccttagctcttggtgtccccatctgtgaaacatgggggacagctgctagcctggattggaacttgggcaaagtccaaagaatgggatttagagctgaatgaacctcacactgagggcacaatagcactaggcactgcccccagagcctagtgctatatgcctgctgcaggtcctacccaagcatgctttactgaggaactcaacgtttcagagcttgagggtcaggttgatcatgggcttgtgaccataggcttccttagtatgccaggcttggagaaccgtgagaaaagcagggaagataccttcaagggtagcaggcatcagctctactcaccttggcccataaggctttgcctggtcatgctggcaccgggtcatatgctggacagggagaacgagagtcccatcctggaactccagaaaagcccctggatgctccagcccctgggaaagcacacagccaggcccttgggtgggaggttggcttctaacagtgcatacacatgcccttcctctgagtcggggcagcaaaaacatccattccgctgcgcaacagttgtcatttttctaacatctgaaaactccagaaggagatggtgataaatgtggtaccggattctgcctaaaggatcagtctttagatgttttcagattgaaagcctcatttgtgatcctcacagccatcttgaaagaatagagcagccagtgggtatactggattgtgagctaagaggcctgggactttccccctgttgctgccagccaggttgatgaccctgggcaagtctttttccttaccaggtctcagtttcctcagctgtaaaatgagaggttgatctggatcagggatagtaaatgggcctttgttcagttactgactgttgtataacaaaccacccccaaatttagtagccttaataaacatttattagctcctgagtgagtggcttggcagtttgggctgtgttcagtgtggtggttcttatctcatctgggccctcgtgtggctgaagtgagctggcagatcagctggggactggctggtctcagatggcctcgcccgcctgtcaggtggttggctgggcaactgggccacacgttccagcatctagcaggctgacccaggattctagacatcatggctgagttccaaaaaccgcaagagaagacaagcccagtatgcgagtgctcttgaggatattgctatgacgtatcttttggccaaagtaagtcacatggctaagcccaaattcttcttaacaggaggagcttcaaaatatggccatatttaaaaaatctacctcaggactcatttcacttgccaactcagaacttttagtagcagctgcctggagtgccttttgaggatctgcagcaattttcagactgtttggaaatactgacatgatagtttggcagtttctcttatgagcatggaattcaagtgtgggcacgtgagcgtcaggtatttgccatccctggccaggttgacccgtaaggtcataacctgccccataggatgttatatgcagtaggcctgtctgacaagaccacagaaatagagaaggcaaagcagagcaaaagattctgagccaggcatccttggttttcatcccaaccagatcattgattgattgaggttttaggcaaatcaaaatccctccaccagtagccagattcttcataataaacttcctccataacagtaaaccatttcctgaacacctgctgttaaaaagcacattttacatttacttaatctccacaaccaccctcagtaggtgtagtaaggacttctggttacaagttacagaaactgaattcagtcctgcttagtgggaggaagtttattggctcacaaattgtaaagtccagggatcttcagacatggggacttgggttcaaaagctgccatcgagaatccggttagccaggcatggtgacacgtgcctgtagtccccgctacttgggggactacagtgggagatcatttgcacctaggaggttaatgctgcggtgagccatgatcctgccgctgcactccagcctgggtgacaaagcgagaccccaactcaaggggaaaaaatctggttttcgggcaggttccaagaagtggtagagcatggccatagggcctgtgagaatagagggacagaggggagaatccccaaaaggagagcaaggcttggctaacaaaaacaggcatccactgtgtggttatgtctattctatagattttgtagatgaggtttaaaagcatggccccaagtaaaggtggcatctctatcctatcctcgcctttatctaaactctgtgaccgatcaatagcatatgatggtggtggtgctctgccagtctcccagtcccagactgaagcactagcagcttccacttattatctcttgggactctagctcttgggacccaaccaccatgctgtgaagcagcccaggccacacagagaggccacgtgtacatgttcagctgacagcagtatcaaatgtcagacatgagagaggaaggcttcaagatgactccagcccagccaccgtctgagaacaaagtaagaactgcctcactgatgccattcaaagcccagcaccatgagagataataaaacgttgtttgaagatgctaacttttggagtgatttgttgtatcagtagataaccaggacacaggcccacagaggttcagtagcttgctgtgcttctcagggggctaggttaagagtataggttttgttgctgggcgcggtggctcacgcctgtaatcccaacactttgggaggccaaggcgggcagatcacgaggtcaggagaccgagaccatcctggctaacacggcgaaaccccgtctctactaaaaatacaaaaaaattagccgggtgtggtggcgggcgcttgtagtcccagctacttgggaggctgaggcaggagaatggtgtgaagctgggaggtggagcttgcagtgagccaagatcgcgccactgcactccagcctgggcgacagagcaagactccgtctcttgctgactcttacccatatgcctgcatctgtctaccctcttttctatgtacttgctccctggatgacttcatccgtggcttcagactccactcatggctccataatcttcacctctaactcattttcctcccaagaacaccaggggagtaggtacagatgcccatctaataactgtacttcgatgtccacaaggacctgtccagcccccacttgcccgtgtcaacctcctccactgctccattaatttttccctctgtgttaatttttccctggttatcttaggtcctttctgtgtcttaattggacttttgcagtaacctctaactaggctccctgctgctcttcctactcggctatccgttttatcaccatcccattgggtaagatccacaccccttagcatgacatcctaagatgtccaagatatgactgaccccttctcaacacctcccctcccgtaatctgcctcctccatgtctcaagccacgtggaataaattgtggaaagacctgtgctgtctggcttgtgcctttacacatgctgttatctctacctcaaatgctgtcttcccccactggctaacccttgttatcctttataacagctcagaagttgcctgctcaaagacactttcttggcctgaattagaactgccctctcacgtgctacttccatcacagatcttaccatctattatattattacatacacacacacacacacacacacacataaaatgtattttgagatcagggtctcacccaggttggaatgcagtggcacaatctctcggctcactgcaacctctgtctcccaggctcaagcagtcctcccaccccagcctcctgagtagctgagacaacaggcatgtgccaccatacctgcctaatttttttgtatttttggtacagatggggtttcaccatgttgcccaggctggtcttgaattcctgagctcaggaaattctgatcctgaaattccagcccaataaaaggaaaatagttctatgtgccaggcaggcctgggttaaacatactatcttaccattacctctttaaagtggacattttcccactttacagctgagaatacaggataataatcagtggcatttggggactgccaatgtggactgttcaaagaccatgctcagcattatcaagaatgagcaagcacttgccattagggtactgacttaacaaactatggcataatgtggatggactcttaagtagtcttttaaaattatgaagcctgtaataacttggaaaaatggtctggatactaaaaagttatatggtggtaggattatgggaatttaacattttaaattataatctcatcttcccaattaaaaaagaccacctcacctgctacaaagcccagcttctaagaacacattgcaaaatttaacgttctgttcaattgcgaagcctcagtattgtcagggcaaagatccggaaggggagcccaggtgcggagctgggacctcacataccacagcagcacttcttccagactgtctggcccagcactttttctgcagaacctatcctatgtttgtcaggtggggggagaggtgtgcaaaattctgcatattttatactccctttaaagaaacacattcaaatacgtatcacctacaactttctaggcattgcctgctgtcagtattggggatacatgagtgaacaaaagtgtctgccctcaacacttaacattatggtgtgctggagaaaccatctttatagtgggcagggacccaaggaagtgtgggagtgagccaggtagacacctcgggaaaagcttttcaaactttcctgtaggtgggagtgaggggcatggaatcaaggttttctaaaaagtagagctgcaactgcatgtcttctatatgctgatgaaaatgcacagcactggccaggcacggtggctcacgcctgtaatcccagcactttgagaagccaaggcgggcagattgcttgaggtcaggagtttgagaccagcccggccaacatggtgaaaccccgtctccattaaaaaacacaaaaaattagctggtaaggtggcgggtgcctgtaatcttggctattcgggaggctgaggcaggagaatcacttgaacccaggaggcggaggttgcagtgacccgagatcttgccactgcactccagcctgggtgacaaagtgagactccatctcaaaaaacaaaagaaaatgcacatcaccatattaaagacttgtcaggcagttatgaaacccacttacttactcttgactttttttttctttgagacagacttgttctgttgcccaggctggagtgcagtggcagggtctcgcctcactgcaacctccgcctcctgggttcaagcaattctcccgcctcagcctcccaagtagctgagattataggcgccagccaccatgcccaactaatttttttttttttttttttagtagagacagggtttcaccatgttggccaggctggtcgtgaactgctgaccttgtgatccgcccacctcggcctccccaccacgcccagcctactctgacttttctttaccatggaacccccctccttttccttttcataattaggaagggtcctcaacgttgtttcctaagacactttggaaatgatgatctggttcccttccaaaactagaaaggggctcttgattgcctttgctttgtcaccacattgcaaggttccttcagctgagctgtgtttggtgagagacagtagagacagaagaggttgatgctactgtgtctgagtaacatagggcaacccattatttttcatgggttttcaatccaatttagtcagttatctcaactggactcttacaggggctgcatcagtcctgagaatctgcttcaagaatgaagttaaaaacgggttgaaatcaccagtctatttgtcaacctgtcaccaaactgaagagtatcattccttctcctaaagggtcccgctaagtaaagaataacccaaacacacatacatacacaaaagcaatggagcgttaattacataagaggcactgatccttgctttattcatgtagaaatatccaacattgggaatcgtgtgggtgtagatacaaaaaaaggaaaatgggggcataaacagcagttgggttcatcgtggcagttggtggcagtttcagccagtgtgtgggttgagggccctctactgctttacccatcaccctccactgttttagccaaggtgtttgacaacacttggcctgtactttaagggtcacagtgattaaaaacaacacagtcaagacatttgggtctgagtgactgctcctgagctgcttagtacgaagtcgggcaacaagaaagcgaggagcagcgtgtatgcccttatcctcagcaagtgagaacaaggcagatcacagcaccgacacagaagatggccttctcccatgtgccagcggagaatccccttccagccaaatcctcaggaagcagagcaccacacaagcagcatttcttggtttctcatggtcatattcaaaagcgacttttaaatcagaaaatagaaaaagcatttgtggtgggtctttttcaaacccagaacacaagttggctaggaaaacggaaagcttcctctggcatccctgtttggactcctcctcctcttggaggagtttcctgaaccgcacacacatcgcttcctcaccaagagagatgctcaactaggatcttttttagtgtgccagttacaagacacatttacaggctatgtttctaagacctcttagtggccaacgaggaaggagggtacctagcaccttgtattccctcatgtggtaacagctgggggaggacttggcggtgaggtagtagcaaccatccccacatacggaaaagaattcaaatctatggagtcattccctggacactgaaaacaggcaatcctcctaagtctcaaggtcccaccacactcgcgtgggaggccgtgtctactttaactatgtatctcaagagaagcagagaagaaaaatggctgcccagatgaagcgcctgccattgttcagtttctcagtcagagcccggcacacactgttttatatggttggtttcttgctgatttcaccaagcacatttatagaaaagaaaactgaaggacaaaccaaattgaaagaatcactgttataataactttaatttatcttgcattttacagaagtctatgaacgattttaaaaaagcacctccttaccccatatcacgtttctctgacaggtgttaaagtaggcaatgagtatgtcaacagcttgagcatcagcgtcttgcaaggacttcagaccaaccactcgccaaaaatcttggcagcttttttatcttgtttttaatacaacggtatatccactctgatggcaaacctgtccagccacatctccacaacaagctttgcaaaatcagtgattagcaaattagttagctttggcacggagctgtgctcgcttgcccgtgacagcctggaagccggttttgatactggcaacagaacatctagaatgacaagtttcgcactgtaggaaatagagtcgtgtgtccttctgcaggattgtgtccggtgatcggcatgtgtgacaagtgacatattcctctgcaaataaagcaacacacagaattacctggtggctgcagtgaggtagagaagtttctgccttcttaaatacatctacaaagaactccacaagcccaggctgagaatttagctgggcacccagaccagggaagcgcagctattcgaggggtaagaaaacacaagctgtctgctgtggcgcttccggcactaaacatgggctgatactcaatgccccaggatgcaaggaagcctgccagcttgcttattctcgtttctgtctagaggagagccactcaaacatgttgacagacatgccaattttaaataactaggaacaaaagggggccaaggccaggcctgaatcacaggcaagtttctctgacttggccttcagccctacaatcaaccagcagcttcaatcagctgggctttctttaaaaatccaaatccttttctatctatacccctagttagtaggcaagagccacctccctttcactatcattttgtctctgatctttttaaggccagcttttcccagctcactgcaatcaaatggctcttcctctaacactgcagcctcatgagaacatttcagggtgatctaatgaaatgaattatacacttactgatatatcttctcaagacattttctatctgtttctgttggaatcttcctttgattacaagttggttattaccatctatagaaccactatgaaagaaaacaaaaatatctccattattattgttttttcctaaaggaaccaaattccagcacctttaaacttaatgaacttaaaatatattcagtagcataggataaactctaggactggtgctatactacttggtttcccaaaatttatttatttatgagacagggtctcacactctgtcgcccagactggagtgcagtggcgtgatcatggctcactgcaccttcaatctcccaggctcaagcaatcctcccacctaagcctagcaagtagctaggactacaggcactccccactgtgccctgctaattttttttttttggtagagatggaggggtctccctatgttgcccaggctggtctcaaactactggactcaagtgatcctcccactatggcctcccaaactgctgggattacaggtgtaggccaccacacccagcctcaaaatttatttttaattaaatagtttgcgtctaatgatgtacccatactaacatcaaatccaattaaatctccagtgataacaatcagatttataattgattttaagtctaaaacaaactgattccttcattgtatgtgacagtccatccaacaaaggaaaaaatcttttactgcatcataccatgtacaaagcaaggcaaaggagagacctagaaatataaaaacaggaaaggggctacgtttgttttttaaaattctaagcaccaaatattttgattcaggcatggttagaagtatagttgataaaaatatactaaaattgattgtggtagcagttatacatattaagtttaatatgtgatcatactaaaaaccattggggccaggtgtggtggctcacgcctgtaatcccagcactttgggaggctgaggcgagttgatcacctgaggtcaggtgttcgagaccagcctgaccaatatggtggaaccccgtctctactacaaatacaaaaaaattagccaggcgtggtggtgggcgcctatagtcccagctactggggaggctgagacaggagaattgcttgaacctgggaggcagaggttgcagtgagccaagatccacgccactgcactccagcctgggcgacagagcacaactccatctcaaaaaaaaaaaaaaaccccattggattgtatatattatttatatatatttatttttttggggggggggggtccaagggtggaggtttaataggcaaaagagaaagaatagctctgtcttgcgagagagacggacgtccgagtgggactctcctggattatacactttaaatttgtaagctgttatctcaataaagctgtttgaagaaaaaaaaaggatagttgaatcacaagccacaaactgtcaatggtacttaatgataaactgataggaaactgttgacaggcacttttgagaaagcaaagctctaggctagatattatcattcattcaaaattataaatcataaagtgaaacaacaaaattcagtcaagcagggttaaatttcctcctccacagattgtaacccttaatctccaggctacagtgattgcaatgcttgatgtagaaattctttttcattcactgtcaaaataaatggaattttctcgaaaacccatttaacccattgaccataagtttactggccacaacttgttataatagtttatcccacctctaacaaaacctctagattattctaacaatagaaaaaacaatgctagcttttgctccctcattagtttgtgcaagttacaaataacgatggtaacaaatttatatttaaaacatgctgggtgcggtggctcacgcctgtaatcccagcactttgggagaccaaggcaggcggatcacaaggtcaggaaatcgagaccatcctggctaacacggtgaaacctcgtctactaaaaatacaaaaaattagctgggcgtggtggcgggcgcctgtagtcccagctactcaggaggctgaggcaggagaatggcatgaacccgggaagcaggcttgcagtgagccgagactgtgccactgcactccagcctgggtgacagagcgagactccatctcaaaaaaacaaaacaaaacaacaaaacccacaattcttctacaacagagcctacgtatccaccacggtcaagtaaattaccccttaaccccacaccaagtgtagcaaatcccaacagtttaaagagagtaggaagagaacaccttaattatctctgtactgccagtgacgcacaggtgtcaagcctgttaggtgatcaagctgcagggacagatagacctgattgtatctatcttgactgtgccactaactagctatgtgaccaactacaacttcactttactgaacctgtttccgaacgtgaagataggaatattactttctacttcatagaactattgtgaagattaattgagatggcacccaaaaaagcacttggcacaaaagaggtgctcaatatgcattagtcatcattatcatgacctactctacattacttatttttaaagggacattaggcttccagatagtagtcaaactcattggcatggggtccatgagatcttggccttcctgaatgggaatgacttgctcagtgccttcaaaaggtgagccctgaagacaggtaagtacctatttcatcacagatcctggtttcaatggtttctccagtgccactcatcaacttactagctgtatttcttcaacagcctgttaccaatttaggaaaaaaaagtctgactttaagaaaaccaattcctctaaaaatctaatatttgctccataaaaagactcaagagtttcagttagtaacaggaaagtctaaacatggcagttctgtggtcctctggttggtacaccagcaggcctgttcagatgtcaactctgtgccctattcctaagcagccaagctctcccacagaaatgaagtgatttcactcctccactggcctaaaagtttctctaataatcaggtgaacattttctctaagtgtgttacatatccttttcaagaaaggttcttatgaaatgtccagcagtactgtatgtaaatgtatacagtttcttaccttgtacccaattcagccaacaaaaatgcaaggagatgtttgggctgacgatgtaatctaaaaagaaaatcaaaatatataaaccttatctctcatggaaatctcaccaaacttctaaaaaatctgttcattgttttgatctgtgattatttagctattaagtgaatttcactgcaccatttatttaaactttgaaataaagatacagtatatgacaccactttttttattgttaagagacagggtcttgttttattgcccaggctggagtgcagtgatgatcatagctcactgtaacctcaaactcctgagctcaagccatcctcccatctcagcctcccaagtagctaggactacaggtgtgtgccaccatgcctgtctaattctttagtttttgtgtagagatggggtctcactatgttgcccagactggtatggaactcatggtctcaaatgatcctcctgtctcagcttcccaaagtgccaggattacagatgtgaactgagccagatagcacttgtttacacttcaatgcccataagaccatattacattttatgactacatacatgtgcgtaagcatctagaaacaaggatggaaaacatcaacaccgacttcagagaataacaacttcctctgggaaggaaaaaggggccaggaaaagatacaaaggtggccttaattataactataaaaccacctttttcttttgtttttgagactatcataaaatagcataaaaccttctttttaaagaagtaaaaaaatctgaagcaaatgtgtcaaaagttcaacatataccaaacctaggtgatggatacttggatgttatcaaacaggctaataaatatatatgttaatccatatatatttcatgtgtaaaattttcattaaaagaaagtgtatgtctagaagggttccatggtagcacaacagaaaaatggaaacatcttaaatattcaccaactagaggagtggttaaataaatccattcaagggtgtattctacttttagaaatatctcaatatacaaaaaaaaaaaaatgtacatacacatataaaataaaaaacacaaatatagagcaatgccattcaatattttcatttcattttttaaatctatactgtggcactgaacttgttccaacaagcaggtgctaactacaacaatttttaagcttttttccccaaaatgcaataggtgagaactggtaaaaatataataaaataggtaagctcctacattgctagcgggagtatgaactggcacgaccttgctagaaagcaatgtgctaatgtttgccataaaaatatccattccttttaactcagcaatttcatcttgccttaagattctattctgagctactggaaagatacatgtataaagatgttcggtgaagttttgcctctgataataaaaacctgggagcagccacgtccaacttatggaactgttaaaatatgttgtgtagctatttaaaacacttactcagactaatgacatgagtaaaactttcacaatatattgagaaaataggttaaaaaccagtatgatagcaatttatttttaaaatatgtacataaaactggctaaacagaaaaatattaaactatgataagttagctacctcttttttttttttttttttttgacagagtctcacactattgcccaggctgtagtgtgcaatggcacaatctcagctcactgcaacctctgcctcccaggttcaagtgattctcctgcctcagcctcccgagtagcgggattacaggcacgtgccaccacgcctgacttattttttgtattttttagtagagccggggtttcactatgttggccagcctggtctcgaactcctgaccttgtgatccgcccacctcggcctcccaaagtggtgggattacaggcgtgagctactgcgcccagcagttatctacctcttaatggtggactttgcagatgattttccattttctttagcatgtctttatcttctaatttttctacaatgagtatatactactattgtcattagccaaaaaaatctaaactatttaaatatatgtaagtaatgacaacaagtggttatctctgggtggtaaaattttgagtgaatattatctcttttgtgtttaccatattttctacaacaagcatgtagcacttaggaaattaaagaacaaagagtggataaactcagtggtcctaaggaaactgccagaaaacatgcagctgaggagctcagagaaaagccattcccagacagtaacccagggctgactctggcatagaatgtgatggtaattaagaaagatacaatctcatcaattgtgtcctggcaatgatcatccaaggaagaggcacccaaattcaggcactttccctgagctcactgcttgcttggcaggcctatcctagagcaactgatgagcctttccactccctgggctcccaaggctcctgagaactacattgagcctcctcactcttcactacatctagttaggatccatcctcagtgggtcagcatgagttgatttctctcacctctgaatgcactaataaaacaagccctcctgggcaacacagcaagacccacgtttctacaaaaaaaaaaaaaaatttttttaaattggtcgggcatggtggtgtgcacctgtagtctcagctacttaggaggctgaagcaggagaactgctgaagcccaggagattgaggctgcagtgagccatgaccactccactgcattccagcctgggcgacaaagcaagaccgttatctttaataaaataaaacagccctgagacttatgaattgaagaaaatgacaggcttgaacggtgaactccctcaacccctacacctgtgtgttctttccatctataataaagtcgacaataaggacatttaacattcttaaaactgcaatgagaatctggcatttgggatgaaggtactccattaaccaacttacagtttacagatatctgtaaagttgacaaaagaagttttcttggttcctactcggacgacttgtggaggtttcatgacaaatttccttttctccccagcaaccatatctggattcttttccctcatgatgttgaacactcgattcagcagctataaaaataaagtggtattcatgaatacgcttagtaactgcaggggtataaagttcccctttgagtcatgttgcttaacagcaaatacttcacttctgattaaatatacacatgcattactacaagtctgggagctccttgagggcagaggttcatccccaaccagcatttggttcattatagatgctcagcaactccttgtccaaagtgaaatgaatgaacaaccactcattctgttgtttctatggcaaagtacatgatacatggaaaagtaagattcaggaaagcccaaactagcaaactccagactaccctggccctaaattagctaattcaccactgccctcctaattcctagagggctgcatgccctcagcagtccacaaattcaggtggggacagtgagtagtactacaatgactgctgcactctgggcaggctgccccacgggtgcgcaccaggaattgctgtgcactggctgtgtgacctctctgcatctgttccaccatcagtcattacttcaacggccgttccaataagatttatcttgctcttctttgagcactagtgaatagcttagccccttttcacaacagattttgtcttacctcctcgtatgtgtagtctctttctgagcctgcccaagcagggcctgtctgattactgaatgagataccatcatcttttttgttgtcttcatcttctagagctacagataaaaaagattttaagaatgaggggtgggccctactacaatacaaaagtggggtgggtctagagaaatgaagagtttcaaagacatctgtcttcccttccacagctgcattcacaacagccttaagcataaagaaaccaaagctcacaacccttttccttagaaacagggatgttatgactttcaaaaaaggcccttaatagagacctctctaattaggagttgataacatactgaaatgtttcttaatttaacaaatcaaagataaaataatgcattggaataattagaggaaaaagtccaactgttttgagcacttaagaaacatcaacatccataaaactcatctactgacaaaagttctctaaagaccctatagcatttagaaactaataaaactgtaaacacgagtttaaaaaatttttttaattaaaaaatcggggccgggcgctgtggctcacacctgtaatcccagcactttgggaggccgaggcggacggatcacctgaggttgggagttcgagacctgcctgaccaacatggagaaactcccatctctactaaaaatacaaaattagccgagagtggtggcgaatgcctgtaatcccagctactcgggaggctgaggcgggagaatcgcttgaacccggtaggcagagattgtggtgagccaagatcgtgtcattgcacttcagcctgggcgacaagagtgagactccgtctcaaaaaaaaaaaaaaaatccggttatagtaattttcccaagcctgaatcagtatgtttttaatgtaatcacagttaacaaattctttaactgccattatcaagccaaacactgtttcctttcgcttccattatcagtcagtagaaataaggggcaagaaaaaaattttaaaagcaccctccacccccatcaaggagaccagggccaaaggcttgagtaacctctaaatgtgctgctgagtcctcagcattaccttcatctttctctagtatttcatcctcatctgggaacttaacattcttctttttcttctttttattgccaagcataatgtcaaggtcatcctctggttcagttggttcttgaacatcactttcaatcttaagatcctaagaaagtgagatgagtctgaacatttgatactgggactattcttttttatttattttattacattttctgttgagatgaggaggtcttgctttgttgctcaggctagtctcaaactcctggcctcaagagatcctcccgccctggcctcccaaaatgctgggattacaggcatgagccaccacacccagcctgttcttttttaaaaatgacgtgggctgacattattttggcagggaaaaaaatcacatattcaaaattgaagttacagataagaaacgcctgtcagaaatggaccaaactggctcacagagactctgccatttgaactgtgaattcttcaagacacttgtgggatctttccccctcattcatctctttattcttcagccttaggatcttataattattgtccttatttccaaaccaggctactgtcagaatcacggcagaggccaggcgtcttggctcacacctgtaatcccagcactttgggacgtcgaggcaggtggatccctgaggtcaggagttcaagaccagcctggccaacatggtaaaaccccacacctactaaagatacaaaaattagctggatgtggtggcaggcacctgtaatcccagctacttgagaggaatcgcttgaacccaggaagcagaggttgcagtgagttgagatcgtgccaccgcactccagcctgggcaacaagagggaaactctgtctcaaagaaaaaaaaaaaaaagaatcacttgagaaaatttaaaagtttaaatcggattgatgatcttcagcaggaacagggttcaggagtactttaaagaagtttctaagtgattttgatatagtcattgggaaagatttttccgggtgacaccaaatatgtgtttttccacaccaaccctccaatgccagttaggtgtcctccagtttatttcagacacacactatccagagttatcatcagatttcacaggtttaagggctcagttcctcaagactgccttcacttcagatgccagtcaccacgtattgggttcccatgctgcctgcttctgtccaacatggctataaactcggaagttcccacattcgccatcaagagtcaataatttgccaaaacgactcatagaactcaggaaagtacttactactgccaatttattataaaggatacaactcacaaacagccaaacataagcaatgcataggacaagttatgggggtgggagctgaggggtggcaaggagggcaggcgtggagctgccacaccagggacatcaccctcctagcaccttgctgtgctcaccagcatgttagctctccgaacccatgtctaggggtttcattacaaaggtatgaccaattgattacattatttacttcttattattattattttgagactgagtatcactctgtaactcaggctggagtgcagtggcatgatctcggctcactgcaacctccgcctctcgggttcaagtggttcttctacctcagcctcctgagtagctgggactagaggcgcacgccaccacacctagctaatttttgtatttttggtagaaacggggttttaccatattggccaggctggtctcaaactcctgacctcaggtgatccaccggcccgggcctcccaaagtgctgggattataggtgtgagccactgcacctggccaactgattacattattaaccactggtgactgagctcaatctccacaccttccctctctggaggtggcagggggaccactgaaagttccaaccctctaaaatcatagctttgtccttctggtgaccagcccccatcctaaagctatctagagatccccagataagggatcccttactcattaattagtatctattttgtgtgtgcctacatcctgaactgggacaatggctacagtcatttcagaaatctcattagcgtaccaaagaccctgttatcacttcggagattccaaggattttagcagttgtgagccaagaacgtaaagaacaaatatttattttttattatatgacagtcagcctggcaccagtctgtggcgtggtctttgggcatcactccaatagatgacattatcaaagagggaaaggcagaagccatggggaattaggatcaagtgatggaatggaatggaaacaaagtaaagcttgaccccaagattagttgccagaggcatggatgtaaacagggcatattaaaacctagaaatgagtcataaacatcccagaagagcagaaaaggccagtctcagtttccagctttctgatttctccttccttctaccagcttatccagctccctatcctgaactgtgctgtcaaccttactcattcattaatatctattttgtgtgtgcctacatcctgacctgggacaatggctacagtcatttcagaaatcttaccagcagaaaagttggaatagctgggagtaaataaagctcagattcgggatcccaaatccagttgtgtagtcttagtgccacatgtggctatcaagaccaatctgccagccaggcgcagtggctcacacctgtcatcccagcactttgggaggccaaggcaggcggatcacctaaggtcaagagtttgagaccagcctggccaacatggtgaaacccctctctaccaaaaatacaaaaatagcccagcgtggtggcgggtgcctgtaaacccagctattcaggaagctgagggacgcttgagcccaggagacggaggttgcagtgaaccgagattgcgccactgcactccagcctgggcgacagagtgagactttgtctcaaataaataagtaaataaataaatctgcccatggtattagctacataccatacaaacaggacaccagatactcacctagtctctaagtcaataaataagaacttagaaatgctgaatataagttagcatacactagccaacttctagtgctatactattattattttatcccagtaagatctacttccatattgacaccaagacacagcagaaggtggagaacagcaaaaagtatttttctttttttttttttttttgagacagagtctcgctctgttgcccaggctggagtgcagtggcgctatctcagcttactgcaacctctacctgctgggttcaagcgattctcctgccacagcctcctaagtagctgggactacaggtgtgcaccaccacacccagctaatttttgtatttttagtagagatggggtttcaccatgttggccagattggtcttgaactcctgacctcaggtgatctgcccacctcggcctcccaaagtgctgggattacaggcatgagacagcacgtccagtctgcaaaaagcatttttcaaggcttttcaaaagccctcggatggtctggaaattcaggtgggagagtagcccaagacctcaaaaacccttcaagtgaatgtccgtgccttgcctgatgaccaggatacctctaacatcctcttatgttatgccttcaaaaatagtattcaagcacttatttagaactaatcttccaataaaagctactggaggaatcaaccaacaaagccttgttaaccaaaactttctgtagcacatctctacatgtcgccctgttacccaggatatttaaatcccatttctgattataatctgagcatttttctcaatttccctatagtagaaggaaaagagaatccccaaacagggagagaacaagatgaatccagataaaaccagcttgttctcaaggattctaaattatccttgaaccaaaatatctctgcaaacaggaaaaatatcttactcatttcagtactctagcaattaccacacaatacttcaaaagcttgacttgctgtaatcactcatacttatttactgaattaactgtcataaaattatgacattatttctaaaacccaatgaattactgtatacatttcctgctacatgtgggatgtactttattcacttgagtttgagcaaataaactacttatcaaagaaaattttgagtagagggcacaagatatttggtgtatgtttgctgttgtgtgtgtgcgcgctctatgtgagtgagtgtgtgtactgctattatcttgggttttataaatagacatgtggattctgctaaagtgattcctaggcagggtctttaaaatggtaactctagggaggaaaacagatcttcagctccttcccctttcatccatccacctaccctccctcctattcaccttcctgcccacctgttacttactccctgtccaaaagaattttgagatatttgtattagaaatcaattcagtaataagactcacagggtctcaagtatccacaagatcagagaactccataaaactagcctgagtgctctggtttgcctacaggccacattgtcatcagctaccaaccaccactgtggttcattctttgctgcttagaggtacacatatcaatttgtatatattcaatatgttaccaaaagtttaagaaaccaaaggaatatttgctcagaaggatttctcactcatagaaatagttctccacagccaaaaatctcagtatagttaaggacaagggacatttgtgatcatcttaatggcacacaatacaatatgtaagacctaaatttaaattccttgaaccacaatccctttaagatacctagtcagacacactcccaagaaaatgacgctaccagtggcaattaagtgctaataacaaaagcaaagctagtaagagatgagtcaaagagagggaaacatcagccattagcaaccttgcaagaggtcaaattttaccttcaacaagaaagcaatactacctttacaccttcttcagcttcatcaatatcaaatatctttttagtttttttcttctttttcttttgattaaagaagttcaagtcatctagatcatcagaagcatctaaaaagaccaaggcataattattaacaactaaaaggcaaagcatcaaattatgagttacacaaacatagttcagcaattaatcaagtcaccagaaaagactgactattaattagtccctccacaatcacaaaacttatggttcttttttttttttttgagatggagtcttgctctgtcgccaaggctggagggcagtggcgcaatctcagctcactgcaacctctgcctcctgggttcaagcggttctcctgcctcagcctcctgagtagctaggactacatgcatgtgccaccatgcccagcaaattttttgtatttttttaagtagagacagggtttcaccacgttagccaggatggtctcgctctcctgacttcatgatccgcctgcctcagcctcccaaagtgctgggattacaggcgtgagccaccgcgcccggccacaaaagttatggttctgaaaaacaaaatggtaggtcatctcaaagatctataggaaaaatctggttaggggaccatgttgagaatatttatttagtaatctgaccatatcactcttcactgttcccaagacaaagtcagagctctaacacaatttccaactctccaactttaaatcttccacttctgcttcttgccttcctcacttcaatccctggttctaaccctactgaactactttcagttcctactgcaatatacgtgcggtctctcaccaacaaaccttcccgtgggccctcttacctccatctcacaggatcttggttaaattacttccaccaaagccttctctaagcttatccatctttccccacaactgggttaggtatccccagagtgattggatagtatcttctgcttactccaactgaggtacttattaccagcttgcttatctatctccctactcaatactaagagtatatgccttgttcacctaaattctactgtctagctcaacattttattgaatcaactaatcatcaaaaggcctaacaaattatttcacattcattaaaatacagctgtgcagtaaatacaagttatcagtgaaattttacctaccattaatgagtaataataggttctgttcaacaagttttccatttgacctgccatgttataaactagaaatattttaggatccttctgctacaaagtttttcaagaaactatttacaaatccattttatcttattacaacaggaatgagttactttccaaatttgttttaaacatgtagaagacacttagcacagggcagatgctcagtgaatgtcagttgtctctatcctggcacagtgttatattcaacagacacatacaatgtttatagaaacatttctctctaacagtcaaattatgtctatgttacagcacaggggtaagtaactaaagctggtgtctaaccccaaatactttaggctataattttaatctctcatatacattttcagacttgctaagacacaaaactgcctatcttagtaccatttctttctgcccacactcaaatacaactaccattaaaaagtcagagaagagacctgatgggttcaactggaaaaccagctctggaacagcaaggtttcatctttgcaacttgtgaattaaatggaaacatccctgcaacaagcctatcagaaatctaaaaaggtccactgcatacagactactgatggccttgacttcactggaacagccttgtcaggctgagaggtcgctgcatatccaaaagccaaaacgctcatagaaccagggcttctatgacaacagtaactctctcacatcaaccacgcaccttttttcctagtgtcctcttcatcagcttccaaatccttgtcctcagttggctctggctccacttcttttgtttctgaaggctgggtttcctctgtttgggtatccccttcctcatctaacataaaaggcttcttcttcttctttttcttcttgctcatagtaggatcaaaaatcatctgtttaaaagacaaaaaacaaaaagggaccaaatgattgtttttaatgatgctcacattccaaatatgctttatcctcaaaaggcatactcttaaaagagtatgtgatacattaaaacaccaaaggggagtttaccaaaaaataaaataaattgtccacccaaccttcttgttactattaaacatcaggtgaactgaaacatgtacacatctttcaatttgtaaagtatcacagatacttcactttcactttcatgagcaaatttggacatttgaatgaatcatggaatttagggaagggactttggcaacaacctatgctatgcccctcactttacagatataggaaaacaatacctaagcggggtgtaaatttttttgtattgttttttctttgaaacagggtctcactgttgcccaggatggagtgcagtggcatgatcacagctcactgcaacctcaacctcctggactcaagtgatcctaccatcttagctccccaagtagctgggaccacaagcatgtgctaccatgcccagctaatttttttattttgtagagacggggtctccctctgttgtcccaggtggtcacaaactgccaggcacaaacaatcctcccacctcggccacacaaagcaatggaattacaggtgtaagccaccgcacctggccaggggtatcaatgttttattcaaggctggtaacttggggctgttacacagagacttgagagacttttgacctgattaaaaaaacaaaattttttttaactacaaatcttcaaggaaatccatcagcaactcttcatatagcaaatctctgagtaagagaaacctctatacaacatttcactctgctttttgtttaacattaaaggttcttttttttttttttttttaaatgaaacagggtctggctctgctgcccaggttggagtgcagtggcatgatctcagctgaatccaaccttgacctcccagactcacaccatcctcccacctcaatttcctgagtagctggaattacaggagtgcaccaccacacccagctattttttgtatttttagtattgatggggtttcaccatgctccccaagctggtcttgaactcctgggctcaaatgatccaccagcttcagcctcccagtgttaggattacaggtgtgaggaccatgccttgccccaaaattctcttattcttatctaaatgtccactatagagtaggtgaaaaactaatttataatttgtagactatctgcttgcactgatcacttgaagaaagaaaagttatctagacataatagtttaaacaacatacagggcagacacctgatagagtagaaagcgcaggaggctgggtgcggtggctcacgcctgtaatcccagtactttgggaggccgaggcgggcggatcatgaggtcaggagatcaagaccatcctggctaacatggtaaaaccccgtctctactaaaaatacaaaaaattagcagaaggtggcgggtgcctgtagtcctagctactcgggaggctgaggcaggagaatggtgtgaacatgggcagtggagcttgcagtgagccgagatcgtgccactgccctccagcctgggtgacagagcaagactcggtctcgaaaaaaaaaaagaaagtgcagggtctttgaagtcaaatagaacctgattcaaatcccaagtatttttttcctgaaccccttaccaatctctctccatattctattaataccatgcttaaattcagcattttgcccagtgatctgctgtggacagcgttaatagtaaagtgtttaaaagcacaagtctggagcccatctgactagatttaaattctgactctggcttgtacctgtgttattccacggctcatgtgtaaaatggagacaagtagcagaatgacaacaaaccacacaaggttactgggagggttaaagaagtatgtaaatgtaaaacacttgccatagtgcctggtacgtaagtactcgataaatattagcaattgtaatttatataatactttaccattcataaagcatggttttctcttgattcctatcactgaaatttcatcaattcaggtgctctaatttcccaaacatataaaactctcaaaagcttcccaaaattgattataacataaacttatttatgtcccaagatcattaatggaactagactgaaaccaagctacagtctgtaataaggtaatacagttactgtccttgcccagtagagaagtatggtatttgcatagcattttcaaagttagtcttttctcccttaacaaggatccaactgtataaataattaaatctgaaatgcagtcagtctgaagaacattatctggccaacttaaagaagtgtccctaccaagatagaagagcaaagaggaaagagtcccccactgcaaggagtactgcaataatacagggaagtagctacatttcatcttcattctagaaatagggagacttggcaaaaggacagacaaaactctagacactataaatttggttctggaagggattaccatccatttattgcattttttcaagcatcaagttccctagaatattaattgccttttaaccattattcatcaagacagactgaagatggcaaggatcctgatatcaccagaagacagcctcacaagtgccttcttatcccctgaaaaaccttatggtctacagctaaacagtttggttgtagccttgtaaaggataataaacatccaggaatcataaactgaaataattaacatctctctcaattactgtctggatacttaacatacatactcattgccttattttattcataccatcctgcgaagtacagtttacaaataaggaccagggatcccgaagcagcacccaaagcagacctccccaaaaatgaggccatgttagtcttgactaaaatggctttttaagactttcatgtctagcttccaaattataagctgactacactccaaattggttttcttttatgaaactagtttggatttgaaaagcaaatagctgttgacagtgcacatatggaaaactacagatcacttgagttatattttaggttcacaacaaagccttcaaaagcataaattttctattttcaacttctcacgtttgattggagagggcaaagaaaaggtataccagctaaaattaccctgatgctcatcaaattagaagcttcctctcatagatcataccttacccaagaaatcaactttatagtcatactatacccagaagcaggtgtgagtcacaaaagaacccacagagaagcaagacattgatctaaaagttccttccaaaggtgaccagaacaaatgctaagtgttgccatctctgtgtgataggattgtgggatttttttttttttttttagggacgggagtctcactatgttgcccaggctgaaatgtagtgactactctcaattgtaattatagcgcactgcagcctcgaactcctggcctcagcctcctgagtagctgagattacatgtgaatgccaccatgcctggcttagattctgctgtttttctttgtattcttttgtgtttcattaacttcacacaacacacatcccattttgaatcaaatacttttttttttaatttaaagcttctttttgcaaaaacaccttaccatattttatgaaaacccaatgttctgactccttgtgaatgggacctagtagcaagtaggcaagtattaaatattgatgctgcttttaacaaatagtctgaaaattactgaatgcctattgagtaggggatttttcttttcccttaccaggtagcagccatatttctaggattctgctttttaaagatcatggttccatgttgggaggctgaggcaggaagactgtttgaggccaggagttcaagacaagcttgggcaacaaagcaagacctcatttctacaaaaattaaaaaattagcgggtgcaagagcatgcacgtgtagtcccagctacttgcgaggctgaggcaggaggatcccctgagcccaggtgacagaggccacagtgagctatgattgtgccaccgcactccagcctgggaaacaagagcgagaccctgtctctaaaaaaacaaaacaacaaaaacaaacaaaaaaaatcatagttctactaggttgaaaatcgttatgttttggcaagtttctggcttaattaccaggtttaaaaataaatgtgtgcagtttatttcaattatacatcaagaaaaaaaaaaaacaaaaacagaaggctgggcatggtggttcacgcctgtaatcccagcacttcaggaggctgaggcaggcgaatcagaaggtcaggagttcaagaccaacatagtgagaccccgtctctactaaaaatacaaaaaaaaaattagctgggcatggtggcaggcgcctgtaatcccagctactcaggagaggctgaggcaggagaattgcttgaacccaggaggcggttgcggtgagccgagatcacgccactgcactccagtccagcgacagtgcgaaattccatctcaaaaaaaaaaaaaaaaaaacagaaatatgaataaaacagaaaattactttttaatagcagcctctttaattgtctagcctgaccaccaggcaggattacttccactctgggaaagtccttggcagtttataaatcattttcaagtacagagttttatctgatcctcacaagtctgtacagtagccagatgttaaaggaatggcctaaaaatacttacctagtcaacagcactacaggaaccaggccctataccctattcttcatacccctctctactcctaacttctacctggcagaatggaagccaaagaccagggttcttgtcctactaactttctgcatgatcttggacaagttaatctccctcggccctggtttcctgtaaaatacagttggaccggcacccctaagtggccaaactaatactttattggcttccaaagtcctatgccgaaatgctggttctgccatctttgcttcacaaaattctgttcatccagcagtaatgcattcatattccacttctttcaaagcctaatcccactgatccctctagccctccaagtcactacgttgatggtcctatttctaccttgtgtgtcatctagttgacccatacacagaataacaccccatggaatcttgcacacgtaagtactgtatttgccaaaggttatgagaagtttgaaaaatgagtagaaacaaaacaagtgtgaaacactgccactctcagaacttttgaaatacagcagcctagagcaatgtctataaccgccaaggaccatatacaaactttcagtttctctaacccattaagatcctagtcaatctggaattctactggtttagccacttagtatttgatcatgggcattatacaactctgtaacactcaaatttttcatctctaaaatgggcacaacaatagacctattttacaggactgttgtgagaaccaagtaagagactggaatcccgtccagaatatattccaaattccttaacttcgtcttcacagccctccatgaactagtcattacctgcttggcaagtgttcaccccttaactctaatcaaactggagattattctacttcctgtgagcacatttactggcctttctcgaccattcctttgcccttgtgatcaaggcttcctattgcctgaggaaattctcaacaacttacggggcctcccccaatgttaagcaatacctactgggagtacttaacatcaacttcattttaagtcgttagacgttatatcaactaggataaatctgagggaaagggatttgaggaaattcactgagatccaagtaccacggtaaaaaaagatccagccagtttcacagcccgcacttcccgctcacgtcgccggtagccctctgttaagggaagctcaggggctcgcccggaaactttccgggaaggtcagtcacttcctgaggctgcagaatctttttctctcgttctaaccccatcaccccctcgtctttttaaaaaacaatgctaggaaggcaaacaagggcgggataccggccccgacaagatagcctagaaagttttaacgagggcgttataccaagccaagagaggctcctcgcggcacccctggcacccccggcacccagtgaggcgagctggggcggcagtgcccagcagaaaggaatgcagggatcgccagccccagtctcgttcggggttattaaccgggcattcgagccccttccgggaggacgactcaacgtgtgctctccattccggaaacgccaaccacggcaggaggtccgcctcagcgctgccgccctgaggaaagcgggctgcggccaagcctgcggctccggagtcctcgccggctctgccgctccgggccgcctaggcgcggctgcctcacatggcggcggccggctgctaggccgcaggcccgttctcccacactggagtgggttaggcttctcgcctcaatccttagcccttacgccgggctcagatcctcacctcgtccccagacatggctgcggctcgagtgggctcggcacggacgggaagtcagacgggtcagccccaggccccggcggcagcgctgcccctgccgatacctctcccaccaccgcactaggctcttgcatcagcgaaaggaaacgacaccccgccctctcctccaagcgttggaaatgcgcctgcgcagagctcgccaaggcgcaggcgcgcagaagagccaacctagcgcgcttcgtgtggcgcgagttaccaggcgacgccgcgtcgccaggcatgccgggacttgtagtccatttataagagggttgcgcttgcgctgtagccgcccagcgacctgtgcgcggcgtctgagcgagctgcagccggaagaacattcggttgttgatattgcctcagccttttggagcattcttttgcgctgcttgtagagtgaattggggtcccttcctcctgggttagggtagtgggttagacactgagtcatatgaacccgctggagctttagtttcccacatgacccccgggcgtcatggtgtttgagaaattctgagttggagctagaggcgcccacctccctaagggtttttacttcgtaagaaatttgacggctggttttctgcttgggaggtcagaaaccaaagtatcttcccggtcttcccccgggagagataacatctcctgaggagaaacaaccacgcaagaggcagctgtcggggagcctcagaatacttgtttatgaaatctgattgaatgggtgcgccacgcaatttcccttgagacctaacaacagcagcgaccctttagggagctctcactgcggctgtgctctccagccaaagaccatcgagaacactcctgtagctggacaaagtggagtttatggtcttgcaagtagggcagtacgccgtgggaaacaccgggacgtctttggaagagggtgttggaaagaatttacagggtttgggcagggtttaaggaagcagagcttctctctggattagatgcagtcaggaggtgggggtaattctatgattgggtaatttaataattcttttttttttttttttttttttttgagactcgctctgttgcccaggctggagtgcagtggcgcgatctcggttcactgcaggctctgcctcctgaattcaagcgattctcctgcctcagcctcccgagtagccggaattacaggcgtgagccagctcgcctggcctataattcttacatgataagaaagtagaactggccgggcgtggtggctcacgcctgtaatcccagcactttgggaggccaaggcgggcgaatcacctgaggtcaggagttcaagaccaacctggccaacatggcgaaacattgtcccgactaaaaatacagaaatttgccgcgtgtggtggtaggcgcccataatcccagctactctggagactgaggcagagaatcgcttgaattcgggaggcagaggtttcagtgaaccgagtttgcgccactgcactccagcctgggtgacagagtgagactccgtctcaaaaagaagagaaagaaagaaagaaagcaggagggagggagggaaggaaggaaggagggaaggtagaaccaagtgaggctaaagctgcaattggttaaaaaaaaaaaaaaaaaaaaaaagctctgcctcccgaattcaagcgattctcctgcctcagcctcccgagtagctggaattacaggcgtgagccactgttcccagcctataattgttacataataggaaagtagaactggctgggcgcggtggctcacgcctgtaatcccagcactttgagaagccaaggcgggcgaatcactaggtcaagagatcgagaccatcctcgccaacatggcgaacgcccatctctactaaaaatacaaaaattagctaggcgtggtggtgcgcgcctgtagtcccagctactcaggaggctgaggcagcagagttgcttgaacccgggaggcggaggtggcagtgagccaagatcaagccactgcactccagcctggcgacagagctagactccatctcaaaataatggtagtaataaaaaaggccaggcacggtggctcacacctgtaatcccagcactttgggaggcgaggtgggcggatcacgagatcaggagttcgagaccagcctgaccaacatggtgaaaccccatctgtactaaaaatacaaaaattagcggggcatggtggcgtgctcctgtaatcccagctactcaggtggctgagacaggagaatcacttgaactcgggaggcagagattgcagtgagccgagatcgcaccactgcactccagccgacagagctctgggcgacagagcgagactccgtctcaaaaaaaaaaaaaaggatagagataggagataggagcatatctgttttttttgttttgttttgttttgttttttgagacggaatttcgctcttgttgcccaggctggagtacaatggcacgatctcgactcaccgcaacctcacttcctgggttcaagcgattctcctgcctcagtctcccaagtagctgggattacaggcatgcaccaccatgcccagctaattttgtgtttttagttgagacggggtttctccatgttgatcaggctggtctcgaactcccgacctcaggtgatccgcccaccttggcctcccaaagtgctgggattacaggcgtgatccaccgtgcccggccttatatctggtcatttttttgtggttggcacaatgtttatttttgtttgtttatattcagacatcattgtggagtggttttgtttttgtttggacccgccgtgctcacagaatggccttgtctgatgttggtgttctgaaattgttagtgttcaacagggcagcacatcctagttaatagtgccagccggcttcctgctatcacgggctgcatctcttttcactgtgttccacattacttaatcatatttgctgctttaggtctcaacacaactgtgtgagataatccacagacacctagtactctctactggatattagtccctaatctaagcatggcagttccttgcctccaaggagcttacatcttagtgagatggatggtttattagcccctttttccagatgaggaaactgcttttgtggcactgaataattagtcagaagccatatacagccagcaaaacaggtaacctgggaatccaagtccagacaatctgatgccagtggctgcccctttaccaccttgagaatctgaatccctaaggagcctggactagtgccatcaaacctcagtcattttcagctactgatatttgtgcataccagagttactcaatggcagcattattgacatattggcagacaattctttgtcaggccagataattctttgttgtgggatgttgttctgtgcattgtaagatgtttagcagcatcccagcctctatataataaatgccagtggcaccctccccctagttgtgacaaccaaaaatgtctccagacactcccaaatatcccctgggagagacagaatcacccctgtttgagaaccactggtgtacatcattttttggatctttgagagagaaacatttggtacatgacagtccccaaatcattttaagtgggatgccttgaagagaagagagggaaacagtgtggcctaagttttggaaaagcctgttcaactacaaaaatgacagataaaggaaaaataaatgaaatggaaaaatgaaagaagacaagtggaaaaggagcttatgaaatgatctgtgggccagacatggtagctcacacctgtaatcccagcactttgggacgccgaggtgggaggatcgctcgagctcaggagtttgggactagcctgggcaacatagatccatctctacaaaaaaaaaaattttttttaattaaaaaataagttactcagatcacaccaaagaagttagttcacactaacttaagttactcagatcacaccaaggaagttagcttgttagttcacactaacgaagacactaagagaactaagaaagtctttttttttttttcttgagacggagtattgctctgtcgcccaggctggagtgcagtggctcgatctcggctcactgcaagctccacccactgggttcacgccattctcctgcctcagcctcctgagtaggtggaactacaggcgcctgacaccacgcccggctaattgtttttgtatttttagtagagatggggtttcactgtgttagccaggacgggtctcgatctcctgacctcgtgatctgccggcctcagcctcacaaagtgctgggattataggcgtgagccaccacacccagccaagaaagtcttaatgagacctcgttgtaccttcactccctgtttgggaaatgctgctgtgtttagcaaatactcttgaccacttttatgaaaaaatttattttcccttacagcatggtaccaggtgtaatctccctgaactggctatgtgcaagaagacttccttcagagatttcaggcttcctccaaggtagcaatttcttttctaggaaaagccaagattccctggcaaaagtcacaaagcaacgatagctaaacttttcctggttttccaagagattgatcctactaacaacacaaataatttatattttcataacttctttcctccaggaatctgcaatgcatatagacacttatggattttcttctcaatacctgtgagagaaatactgtaattttgttttataaatacagaagccaagttatggaatacacacacacacacacacaccaagcagagatacagaaacaagactattggacttttcattctgggccatgctcaataccaccccagatctccaactgcccaacagtaagctaatgatgatagtacttcaattgtatgcttaattatatgttttcattggctttgaactattccacagtctccacttgacccataaaatagcaggcctgtagagaatgtgacttaaagttaaatagtgacagaacttgaactagaacccagatctcatgattcttagtgcaatactctttttatttagtaagcaaggtcacacatcctcatgggtaatatttaacttacagaaaacatgattaagataaaaattataatccacgtagaaattggtattttctgtgtggattatagccagattttctgtggaaatgcaagattttccacatagaaaatctgggtattttccacagcaagtcatcctcatctcagttaagagtactgctctttacccagttgcttaagtcaaaacccaggagttagccttgattccttcctttccctcacttcttcattcaattcactattgtcttgttgattcaatgtccaaaatagatctcaaatacaatctcttctctcgccactgccactaacctggtccaggtgattgtcatcagttttgggatactgcagcttttctcttgttccttcataacactcaccacaatttgtttaatttgtctgttgtatacttgtagttttcttaatctcacttcactactagaatgtatgcaaatttcttgaacataatacaaaaatctgtcttgttaactctgatattcccagcacctagcagagtgcctgactcatcatagtcacttaataaatatttggtggctgggtgccgtggcttatgcctgtaatcccagcactttgggaggccgaggtgggcggatcacctgagttcaggagttcgtgaccagcctggccaacatggtgaaaccctgtctctactaaaaatacaaaaattagctgggcatggtggtgggcacctgtaatcccagctccttgggaggctgaggcaggagaattgcttaaatccgggaggtggaggttgcagtgagcagagatccagccactgcactccagcctgggcaacagagcgagactccgtctcaaaaaaataataaataaatatttgataaatatttactgaattaatggttgaaaacccattagtccccaaaattacattgcttacaatgaaatagttgaggttggagcctttatttcatcatatatactaaaaatgaccaaagctaacgtaattaatctcagttgtattataatatatctgaaagaatatgttagaattgaaatggtttacttggaacccagaaggagaagaataagccaggatggcttattccattcagcagtgttcaggatagagaaattatgaatccaaagaacatggttaaaagctagtcattagagaggtatacttgttctagagcgaagataagctcaggccttacctgtgacctgaatgaaatgggtcttaataccatctcttttttcaaatgatcagaagatcatttgccaaataacattttcattagtgacttaaaatccttggttcctttgcactgggaaggaaatgctctagacagcaaacaaatattttactcactggaaacatacattctatgttatattccacagagactgtaactgtgaggataggaaattgttaatgacagctgtgtccctagttccttagaataatgcttcgcacaaagtaggttctttacaactatttgatgaatgaatgaatgtacattagtaaattaggattatcctttataccacaatctcttatgaatttggttattgtgaatcaatcctcaagtatctgttccatgatacatgctttaggaaaatcagatttctggttttggaggccaaatacgtgagttcctcagctctggtgctctactccaggagtctttgaatggctgggcgtggtggctcatgcctgtaatcccagcactttgggaggctgaggcaggaggatcacttgaactcaggagtttgagagcagcctgggcaatatagtgagaccctgtctctgtaacaaataaaaagctctgggtatttttcacaacaagtcatcctcaatgactgctgtggaacaaaacaagggtctttgagatcttatttggttagtccctgacctccttctcccatatctttttcttggttctcttgtaactccagttcatcctccatctagcccatcgagtttcctggggccgggaaaaaaacactaatcaagctgctcccttgcctaaaaatcagttaattctctgttaccttcagaagaatagatttccacagtctgcctccaagcccctctcaccatgctactgtctacccttcttaccattctccattgtgtatgctgtttcagtcatactaaatcatttaatatttcataaacatgctgtgccatttcattttttccatgctgttccctctctagaacgtccttccctcctgttcccggaatctgatgaactcctgtcatcctttaagatccagatctagactttacttttttaaagaagcctttgatttctgtacaagggaaaaaaatgattcctttctctctacttgtcttttttctattacagctcttatattatgttgtagctgtctttgagatcctggagggtgggatctgtaccttactcatatttctttgctttcccaaaacctagcacatgtttgtgaatgcaggcacccgtatggggcgataggtataagtgctaattactaacttgcaccagtcttcacttcttgaatgtcgcctccttcccaagagaggatgggaaaacctcccagctgtattctgtttggaataattggatgtgagcataggaaataaatatgttttacatactccttttatgattcactataaaaggaggtgatcagtttttgttttcacttttttgagacagggtctcactttgtcacctaggctggagtgcagtggcatgatcatggctcactgcagcctcaaacttctgggctcaggcaatcctcctgccttatcctctcaagtagctaggactacaggcaagtacctccacacccagctaattaaaaaaaaaaattgtagagatgggggtctcactgtgttgccccagctggtctcaaagtcctggcctcgagtgattctcccacctcggcctcccagtgtgctgggattacaggcgtgagccataaaagcacctgatagtcttcttgaaagattagcagactttcagtaagaagtaattaagtgtaccttgtatacactcagcaccttggtcactattcattgcccatctttctcccttgctcttaagagacttataaccccagtacccagcacagtgcatagcacctattaggagctcagtaaacatttgttgaggctgggtgcagtggctcatgtctgtaatcccaacactttgggaggccacagtaggaggattgcttgaggccagtagtttgagaccagcctggacagcatagtgagaccctgtctctacaaaaaagtaattaaaaaaaaattagccgggcatggtggcatgtgccagtggccccaactaatcaagaggctgaggcaagagaatctcttgggctcaggagttcgaggctgcagtgagttatgatcacaccactgcactccaccctgggtgacagcaagaccctgttctcttttaaaaaatcaattaaaaaaaaaagaatatgaatgttttttgatgatgttatccaaggttacttagtatcttgccatctgtacagaagacttcaaaactcttaagaaaaccacaatgagatactaccttacacccagtagaattgctattaattaaaaaaaaaacctccagaaaatgacacatattatcaagatgtggaaaaactggaacgcttgtgtatgttggcaggactgtaaaatggtgcagccctatggaaaagagtatggtggttcctcaaacatttttaaacagaattaccatataatctaacaattcaattactacgtatatttaaaaaataaaaataaaaaaacaaaaaaaaaacctgaaagggctgggcatggtagctcacacctgtaatcccagcactttgggaggctgacgtgggcggatcacctgaggtcaggagtttgagaccagccatggtcaacatggtaaaaccccatctctactaaaaatacaaaaaattagccagacatggtggccggcgcctgtaatcccagctactcaggaggctgaggcaggagaaacacttgagcccaggaggcagaggttgcagtgagctgagatcgtgccatcacactccagcctgggcaacaagagcgaagctctgtctcagaaaaaaaaaaaaaacaaaacaaaactgaaagcagtgtctcaaagagatatttttatgtccatgttcacaacagcattattcatacctgagaagcaccccgggtgtccatcagtggatgaatgggtaatcaaaatatggtgtgtacatacaatagaatatcattcagccttaaaaaggaaggaaattctgatacatgccacaatatggatgaacctcaagaacattatgcttagtgaaataagctagccacaaaaagacgaatactgtgttatcccatttatttgaggtacctagaatagtcaaattcatagaaagagaaagtagaatggcggttgctaggggctagggagagaggggggaagagagagttgttgtctaataggtacagagttccagttttgcaagatggaaagagttctggaaattggttgtacagcaatgtgaatatacttaaaaatagttgaaaagataaattttatggtatttgtattttaccatattttttaaaaagagagcactaaactgggagacaaaagaccaaggttggagttcttggttgttttccacagatagatcagtctcaaggaatttgagacttccttgaaactcaaggaagtactcaaggaagttgagtaaaggaagcttctttactcattgtttctgttaattcatctttaaacaggataaaaaagactgtggagtctagatttgtatgaggatcaaataaaaaccaaaaaaaacaaacgtttaaaataattttttgagttgtagttgttctcaatattccagagcctctgatctcttgatatttgttacaagtttcacatcttatttcataatgaaatgctaaagatgcctcagcaatagccagttgacttcaaaggtcttgtatgaggaatccttttaatttgggctattcaccttataatttggtcctgggaaaacagcaaataaataaacttttatgaggactatttatgatctaagatgctaattatcaatgtagtttagcatgaactaatgaaatacaagctcaggattttcatgttagtataaaaaagctcttcttcaacaaatccccaaatggcggatgacgcctgtgcagggggcggcagggcgtggggtgcggaggtcgggtggaggccgggcggaggccgggcggaggcccccgcaagccctgggagggatggggaaccgcggtggcttccgcggaggtttcggcggtggcatccggggccagggtcatggccgtggactgggccggagccgaggccatggagctcgcagaggcaaggccgaggataaggagtagatgcccgtcaccaagctgggccacctggtcaaggacatgaagatcaagtacctggaggatgtctcttctccctgcccatcaaggaatctgagaccattgacttttttctggggtcctctctcaaggaagagggtttgaagattatgccggtgcagaagcagacccgcgcgggccagcgcaccaggttcaaggcgtttgttgccaccggggactacaatggccacgtcggtctgtgcgttaagtgctccaaggaggtggctactgccatccgcgggtccgtcatcctgaccaagcactccattgtccccgtgcgcagaggctacgggggaacaagatggacaagcccacaccgtcccttgcaaggtgacaggccgctgcggctctgtgctggtgcacctcatccctgcacccaggggcactggcatcgtctccgcacctgtgcccaagaagctcctcatgatggctggtattgatgactgccacacctcagccaggggctgcactgccaccctggcaacttcgccaaggccacctttgacaccatctctaagacctacagctacctgaccctcgacctctggaaggagactatattcaccaagtctccctatcaggaattcactgaccacctcgtcaagacccacaccagagtctccatgcagaggacccaggctccagctgtggctacagcatagggtttttatacaagaaaaacaaactgaattaagcctgaaaaaaaaaaaaaaagctggtctcaaattaggggccaacatggaagaattaatatctgttgagtacttactaagtgtcaggccctatagatgttacatgcattatctcatttaatactcaacaacagccttgtcaggttaaaagtattatacccattttataaacaggttaatgaaggctcagagagtgtcagtcacttacccaacataacccagtgagtaacagagatggaatttgagcccaagtctgtgtgaatctgaagcccatattatttctactatgttacagtgcctctgaaaatatatttaactgtgcctacttctaatagagtttatgataaatgatatatatttgatgtttatatatttatatcaattattttacttcatcattacaagtaagatagactatctagggatgattatcaccactttacagatgaggaaacagatggtcagaaaatttaacttacctagcttcagaccagtaaatgataataacagggcttggacacatgtaccgcaactctcagactcctactttttccacattggcctatgagagtagaattttatctatattttacctatgaattttctttttttttttttttttttttttggagacggagtcttactctgtcgcccaggctggagtgcagtggtgcaatcttgactcactgcaacctctgtcccccagcttcaagcgattcttctgcctcagcctcccaagtagctgggagggattacagtcgcctgccactgtgcctggctaatttttgtatttttagtagaaatggggttatatcatcttggccaggctgatcttgaactcctgacctcatgatctactcgccttggcctcccaaagtgctggattacaggcgtgagccacctcgcccagccatatctatgaattttctggttctaactttttttaataggagcaaagagtggacatcttgacagtcttgcacttctgtttatgcttggacagattaaacacatatgtttatccctgttcactccccaaatcactgaagtgacagtgagttaacatttttaggtttaccagtctacagacaaagagaataagaaagaaatcaatagcagattaaggatatcaacaaatttttggaagatggaaaaccatagctgagctgagaaaacaattctaaatgtttgctgagggttatactaacaagggacaaacagattcgtactgcagaacactagaatgtcaggactgggacagagcagatcagaggtgatgtgagaggcagaagagagagggtttggctgaaagcctttataggaagtgaaactgccaggtctttttctccatcctactcacttagacaactaccctttcatctccctagcagcccctgggacaaaattgaggtagagaagttccagacactgagataccaggcacagctaaagatataatagcagggaggctaaggtaggaggatttcagactgaaaacagagattagatgaattgtctacatgctgaatggtgaagcgcactcagtcctcctgctgaaatttattccaggaatgctgacagcaaggcttgtattctccaggcaagatatcagggaattaattttaattaattaaccccagaggaaagatctatacatactgatatttgaggtcccccaacaaaacacctaggtacccactttatcatcctacagataaacttcctgttaacacagagcttccaaatacttagtgactcactcttaaatatgaagagacaacaaagggtcaccagatatttaagataaacctccaccaggaaagacagcatcaaatagagaaaaaagaaactcaaagggaacagaaactgaagagaacagaaaaatatttttaaaaaacaataagcagtctatgagagataatagaaaatactgcatccataaagcaaagataaaatgctctaaaaaaaatagagtaagtaacagctctggggaattaaaaatataatagaaaaattggctgggcattatggctcatgcctgtaatcccagcactttgagaagccaaggtagaaggattgtttaaagccaggagttcaagaccaaccagggcaatattagatagacctcttctctgctaaacattcttttaaaaagagaaattaggcttggttcagtggctcacgcctgtaatcccagcactttgggaggccgaggcgggcggatcacgaggtcaggagatcgagaccatcctggctaacatggtgaaaccccatctgtactaaaaatacaaaaaattagccgggcatgatggcgaacacgtgtagtcccagctactagggaggctgaggcggaagaatgacatgaacccaggaggcagagcttgcagtgagccgagatcacactactgcactccagcctgggcaacagagcgagactccatctcaaaaaaataataaataaataaataaataaataaataataaaaaaagaaaaaaaattagccagctgtggtggctcatgcatgtggtcccagctacttaggaggctgagtcaggagggctgctcaagcccaggagatggaggctgcagtgagctatgatcatgccactgcactccagcctgggcaatacagcaagacctgttctcaaataataataatagaaaaataaataatttatataagtcttaatatataaagttgaggaaatctctcagaaagtagaacagaaatacaaatggaaaaataaaagagaaaagataattagaggatgaatccataaggtcgaccattagattaacaggagttctggaaatacagaagaaatggaagaaaattatcaaagaaactgagtttccagagtggcagagcctgctgagtgcccagcataatgaaagaaaacaaaacaaaggaaaaacattatggcacatcatcatgaaattttttaacacaaaggataaagagaaaatcaaaaatcttggtgataggaggtgaggagggggcagggaaagggcaacaggttacttatgaaagagcaggtaataggaatagcatttttgtccatagtaacattagtggctagaagacgatatagggaggctttcaaaattctgagagaaaatacgttttcaatctagaactcctatactaagccatattatcagtcaagtatgaggaataaataagtatatttttaggcatgcaaggatcagaaatttacccctcatccccacataacttttcttaggaaagcactggaggatttgctctagtaaaacaagaaagacagaaaaaaaatcctaaaatttgtatggaacaaaaagtccaaatagtcaaagcaatcctaagcaaaaagaacaaagctagaggcatcacaccacctgaatttaaaatatactgcaaggctctaataaccaaaacagcatggtattgatataaaaacacagaccaagggaacaaaaagagaacccagaaataaatccacgtacagccaattgatttttgacaaaggtaccaagcacatacattggggaaaaatgttgttgggaaaactggatatccatatccagaagaatgaaactaaactcctgtctctcaccatacgcaaaaaatcaactcaaaatgtatagggaaaagaaagagcgatcagactgttactgtgtctatctagaaaaagtaagacaaaagaaactccattttgatctgtactaagaaaaattgttctgctttgagatgctgttaatctgtaactcttgtcccaaccctgtgctcacaaaaacatgtgctgtattgactcaagttttaagggatttagggctgtgcaggatgtgctttgttaaaaatgtttttgcagccaggcgcagtggctcatgcctgtaatcccagcactttgggaggccgaggcgggcagatcatgaggtcaggagatcgagatcatcttggctaatatggtgaaaccctgtctgtactaaaaatacaaaagattagccaggcgtggtggcgggcccctgtagtcccagctactcgggaggctgaggcaggagaatggcatgaacctgggaggcggagcttgcagttagccgagattgagccactgcactccagcctgggtgacagagcaagactccgtctcaaaaaaaaaaaaaaaaaaaaaatcacacctgtaatcccagcactttgggaggctgaggcgggcagatcacgaggtctggagatcaagaccatcctggctaacacggtgaaatcccgtctctactaaaaatacaacaaattagctgggcgtggtggtaggcgcctgtagtcccagctactcgggaggctgaggcaggagaatggcatgaacccaggaggcagagcttgcagtgagccgagatcgtgccactgcactccagcctgggcgacagcgcaacactccttctcaaaaaaaaaaaaaaatgtgtttgcaggcagtatgctttgtgaaagtcatcgccattctccattctctattaatcagggacacaatgcactgtggaaggccgcagggacccctgcccaagaaagcctgggtattgtccaggtttccccggactgagacagcctgagatatggcctcgtggggagggaaagaccttacagccccccagcccgacacccgtaaagggtctgtgctaaggagattagtgaaataggaaggcctctatgcggtagagataagagtgtggcatctgtctcctgcacgtccctgggaatggaatgtctcggtgtaaaacccgaccatacattctatttactgagataggagaaaacctccttatggctggagatgagacatcatggcggcaatactgctctgttactctttactgcactgaggtgtttatgtaagcttaaacataaatctagcgattgtgcacatccaggcacagcaccttttcttaaacttattcatgacacagagtctttgctcacatggtcttctgctgatcctctccccaccttcaccctatagccccgccacattccccttgctgagatagtaaagatagtgatcaataaatactgagggaactcagagaccagcgctggtgcaggtcctcacttgctgagcgccggtccctgggcccatttttcttccgctatactttgtctctatgtcttatttccttttctcagtctctcgtctccaccttgcgagaaatacccacaggtgtgcaggggcaggccctcttcatctggtgcccaatgtgggttcctttctctacggtgaagatacgctagagtgtgatcattgaagacaaatcgacgagagattcccgaagacttccatgatcagccttgtggtaagcttgtgcactcagagaaacccagggtaagaatgggtcaaactgaaagcaaatatgcctcttatctcagctttattaaagttattttaagaagagggggagttagagcctccacagaaatctaatcatgctatttcaaacaatagaacaattctgcctatggtttccagaatagggaacgttagatctaaaagactgggaaaaaattggcaaagaattaaaacaagcaaatagggaggataaaatcatcccacttacagtatggaatgattgggccattattaaaataggtttagaatcatttcaaacagaagaagatagcgtttcagtttctgatgcccctgaaagctgtgtaatagattgtgaggaagaggcagggacagaattcaagaaagtaacgcaaggttcacagtataaaaaggtagatgagtctggctgggcgcagtggctcacacctgtaatcccagcactgtgggaggccgaggcggatggatcacaaggtcaggagatcgagaccgtcctggctaacacagtgaaaccctgtctttactaaaaaaatacaaaaacttagccaggcgtcgtggcaggtgtctgtagtcccagctactcgggaggctgaggcaggagaatggcgtgaacctgggaggcggagcttgcagtgagccgagatggcaccactgcactccagcctgggcaacagagcgagactccgtctcgaaaaaaaaaaaaagaaaaaaagggtagaagagtgtaatggctcagtcaacggaaaatgttgactacaaccaattacaggaggtaatatattatgaaccatcaaaattggggggaaaaggtctagaactattggggccatcagagtctaacccacgatggccaactcctcctcccacagttcagatgcccgtaacattacaacctcaaatgcaggttagacaagtacaaaccccaagagaatatcagatagaaaaggatagtctctatcacagcaatgccaatccagatacagtattcacaatatcagctggtagaaagtaagacccaaccgccagtaccctatcaatactgaccgccagccgaacttcagtatcagccgccccccagaaaatcagtatggacagccaggaacgtttccagcaccacagggcacgcacggcgatatagcctcagctgcccactatgagacttaatcctacaccaccacctagtggacaggatggtgcattacatgaaattattgagaaggcaagaaaacaaggagagatactgaggcgttttaatttcaagtaatattagagcccatactacctggagaagggccctccccaagctgatgccagatatgagtccttttctataaaaatgctaaaagacatgaaagagggagtaaaacagtatggacccaattctccttatatgagaacattattagattccattgctcatggaaatagacttattccttatgactgggaaattttggccaaatcatcactctcaccttctcaatttttacaatttaagacctggtggattgatggggtacaacaacagatccgcaaaaatagggccgccaatcccagttaacatagatgcaggtaaaaaatagaaaaattaaaccacaaaaaatagaaataagaaaagacacattaaaaacattaaatgactttcaaaaattgctaggagatattaattggatttggccaattttaggcattcctacttatgccatgtcaaatttgttctctatcttaagaggggacccggacttaaatagtaaaagaatattgaccccagaggcagcaaaagaaattgaattagttgaagaaaaaatttggtcagcacaagtaaatagaatagatcccttggtcccactccaacttttgatttttgctactgcacattctctgacaggcatcattgttcaaaatactgatcttgtggagtggtcattccttcctcacagtacaattaagacttttacattgcatcaaatagctacattaattggtcaggcaaggttatgaataataaaattgtgtggaagtgacccagacaaaatcattgttcctttaaacaaggaacaggttagacaagcctttatcaattcttgtacatggcagactggtcttgctgattttgtgggaattattgacaatcattacccaaaaacaaaaaccttccagtttttaaaattgactacttggattttacctaaaattaccagacatgaacctttagaaaatgctctgacggtgtttactaatggttccagcaatgaaaaagcagcttacattgggccaaaagaacaagtcatcgaaactcaatatcactgggctcaaagagcagagttggttacagtcattacagtgttacaagattttaatcagcctattaatattgtatcagattctgcatatgtagtacaggctacaagggatgttgagacagccctaatcaaatatagtattgatgatcagttaaaccagctgttcaacttattacaacaaactgtgagaaaaagaaatttcccattttgtattactcacattgaagcacacactaatttaccagggtctttaactaaagcaaatgaacaagctgacttactggtatcatctgcattcataaaagcacaagaacttcatgctttgactcatgtaaatgcagcaggattaaaaataaatttgatatctcatggaaacaggcaaaaaatattgtacaacattgcacccagagtcaagtcctacacctgcccactcaagaggcgggagttaatcccagaggtctatgtcctaatgcgttatggcaaacggatgtcacacatgtatcttcatttggaaaattatcatttgtccatgtgacagttgatacttattcacatttcgtatgggcaacttgcgagacaggagaaagtacttcccatgttaaaagacatttattatattgttttgctctcatgggagttctggaaaaaattaaaactgacaatgggccaggatactgtagtaaaacattccaaaaattcttaaatcagtggaaaattacacatacaacaggaattccctataattcccaaggataggccatagttgaaagaactaatagaacactcaaaactcaattggttaaacaaaaaagaactctccctttccctctccctctccccctccctctccatctctgtctccatctccctctccccacggtctccttctccctgtctttccacggtctccctctgatgccgagccgaagctggactgtactgctgccatctcggctcactgcaacctccctgcctgattctcctgcctcagcctgctgagtgcctgggattgcaggcacgcgccgccacgcctaactggttttcgtatttttttggtggagacggggtttcgctgggttggccgggctggtctccagctcctaaccgcgagtgatctgctagcctcagcctcccgaggtgccgggattgcagacggagtctcgttcactcagtgctcaatgttgcccaggctggagtgcagtggcgtgatctcggctagctacaacctccacctcccagccgcctgccttagcctcccaaagtgcggagattgcagcctctgcccggccgccaccccgtctgggaagtgaggagcgtctctgcctggccgtccatcgtctgggatgtgaggagcccctctgcccggctgcccagtctgggaagtgaggagcgcctcttcccggccgccatcccatctaggaagtgaggagcgtctctgcccggccgcccatcgtctgagatgtggggagcgtctctgccccgctgccccgtctgggatgtgaggagcacctctgcccggccgccaccccatctgggaggtgaggagcgtctctgcccggctgccccgtctgagaagtgaggagcccctccgcccggcaggtgccccatctgagaagtgaggagcccctccacccggcaggcgccccttctgggaagtgaggagcgcctccgcccggcagctgccccgtccgggagggaggtggggggccctccgggagggaggtgggggtcagcccccgccaggccagccgccccgtccaggagggaggtgggggggtcggccccccgcccggccagtcgccccatccgggaggtgaggggtgcctctgcctggctgccccaactgggaagtgaggagcccctctgcccggccagccgccccatccgggagggaggtgggggggtcagtcccccgcccggccagccgccccgtccgggagggaggtgggggggtcagccccccgcacggccagctgccccgtccgggtggtgaggggcacctctgcccggccgcccctactgggaagtgaggagcccctctgcccggccagccgccccgtccgggagggaggtgagggggtcagccccctgcccggccagccgccccgtccgggaggtgagggacgcctctgcccggccgcccctgctgggaggtggggagcccctctgcctggccaccaccccgtctgagaggtgtgcccaacagctcattgagagcgggccgggatgacaatggcggctttgtgcaatagaaaggggggaagggtggggaaaagattgagaaatcggatggttgcggtgtctgtgtagaaagaggtagacatgggagacttttcattttgttctgtactaagaaaaattattctgccttgggatcctgttgatctgtgaccttacccccaaccctgtgctctctgaaacatgtgctgcgtccactcatggttaaatggattaagggtggtgcaagatgtgctttgttaaacagatgcttgaaggcagcatgctcgttaagaatcatcaccactccctaatctcaagtacccagggacacaaacactgcggaaggccgctgcctaggagaaccagagacctttgttcacttgtttatctgctgaccttccctccactattgtcctatgaccctgccaaatccccctctgtgagaaacacccaagaatgatcaataaaaattaaaaaaaaaaacaaaaaaaaaaaaacaaaaaaaaaaagaaaaagctgacacagttctctgaaaaaagcctagagaacacaagggtgacacaaactccagagagtatgctgcttgcagctttgatgattgtatcaacagtggtaagtcaccccatgtctgcaggagcagctgcagctaattatacctactgggcctatgtgcctttcccacccttaattcgggcagtcacatggatggataatcctattgaagtatatgttaataatagtgcatgggtacctggccccatagaggatcgttgccctgcccaactcgaggaagaaggaatgatgatgaatatttcaattgagtatcgttatactcctatttgcctagggagggcacaaggatgcttaatgcctgaaacccaaaattggttggtagaagtacctactgtcagtaccaccagtagatttacttatcacatggtgagtggaatgtcactcaggccacaggtaaattatttacaggacccttcttattaaagatcattataatctaagtctaaggggaagccttggcccaaggaaattcccaaaggatcaaaaagcccagaagttttagtttgggaagaatgtgtggctgatagtgcggtgatactacaaaacaatgaattcagaactattatagattgggcatctcgaggtcaattctaccgcagttgcacaggacaaactcaatcttgttccagtgcacatgtgagtccggctgtgaacagtgacttcagagaaggtttagataaaaataagtacaaaaggttagaatctccctacccttgggaatgggcagaaaaaggaatctctgctacaagaccaaagataataagtcctgtcattggtcctgaacatctagaattatggaggcttatgtggcctcgcaccacattggaatttggtctggaaatcaagttataggaacaaaagaccgtaagccatcttatactattgacctaaattccagtctgacaattcctttgcaaagttgtgtaaaacccccttatatgctaattgtaggaaacatagttattaaaccagattcccaaactataacctatgaaaattgtagattgtttactagcattgattcgacttttaattggcagcaccgtattctactagtgagagcaagagagggcgtgtggattcctgtgtccatggaccgaccgtgggaggcttcgccatctgtccatattttgactgaagtattaaaaggagttctaaatagattcaaaagattcatttttactttgatgcagtgattatgggattaattgcagtcacagctacggctgctgcggcagaagttgcattgcactcttctgttcagacagtacgctttgttaacaattggcaaaaaaattctatgagattgtggaattcacaatctggtattgatcaaaaattgtcgaacccaattaatgatcttagacaaactgtcatttggatgggagataagctcatgagcttggaaatcgttttcagttacactgtgactggaatacatcagatttttgtattacaccccgagcctataatgagtctgagcatcactgggacatggttagacgccatctacagggaagagaagataatcttactttagacatttcaaaattaaaagagcaaattttcaaagtatcaaaagcccatttacatttcgtaccaggaacttaggcaatcgcaggagctgctgatggcttcacaaatcttaaccctgtcacttgggttaaaaccctcagaagttccactattgtaaatttcatattaatccttgtgtgcctattctgtctgttgttagtctacaggtgtaaccagcagctccgaagagacagtaaccatcaagaacaggccataatgaagatggcggttttgtcaaaagaaaagggggaagtgtgaggaaaagaaaaagagatcagattgttactgtgtctatctaggaaaaggaagacaaaagaaactccattttgatctgtactaagaaaaattgttctgctttgagatgctgttaatctgtaactcttgtcccaaccctgtgctcgcaaaaacatgtgctgtattgactcaaggtttaagggagggctgtgcaggatgtgctttgttaaaaatgtgtttgcaggcagtatattggtgaaagtcatcgccattctccattctctgttaaccagggacacaatgcactgtggaagtctgcagggacccctgcccaagaaagcctgggtattgtccaggtttcccccgactgagacagcctgagatatggcctcatgggaagggaaagaacttacagccccccagccctacacccgtaaagggtctgtgctaaggaggattagtgaaagaggaaggcctctatgcggttgagataagagcgtggcatctgtctcctgcacgtccctgggattggatgtctcagcataaaaccgaccatatattctattctgagacaggagaaaaccaccttatggctggaggtgagacatcatggcggcaatactgctctgttactctttactgcactgagttgtttatgtaagcttaaacataaatctagcgattgtgcacatccaggcacagcaccttttcttaaacttatttatgacagagtctttgctcacatgttcctctgctgaccctctccccaccttcaccctatagccccgccacactcccctcgcagagatagtaaagatagtgatcaataaatatggagggaaccagagaccagtgccagtgcaggtcctcacttgctgagtgccggtcccctgggcccacttttcttcctctatactttgtctccgtgtcttatttcttttctcagtcgctcgtctccatcttgcgagaaatacccacaggtgtggaggggcagcctcccttcaaaaatgcattaaagacttaaatgtactccaaactgtagaactactagaagaaaacatggggaaacactctaggatatgggtctaggcaaagactttatgactaagacctcaaaagcacaggctacaaaaacaaaaatagacaaatgggactattttaaactaaaaagtttctgcacagcaaaggaaacaacagaatgaagaaacaacctgttgaatggtacaaaatatttgcaaaccattcatctaacaagggattaatatccagaatatacatggaactcaaacaactcaacagcaaaaacaattccatttttaaaagcgggcaaaggatctgaacagacatttctcaaaagaagacgtacaaaggccatcaagtatatgaaaaaatgctcaatattactaatcatcatagaaatgcaaatcaaggccaggcttggtggctcatgcctgtaatcccagcactttgggaggccaagatgggcctgaggtcaggagttcaagaccagcctggccaacatagtgaaaccccgtctctattaaaaacacaaaattagccagcgtggtggtacacgcctatactcccagctactcaggaggctgaggcaggaaagtcgcttgaacccaggaagcagaggttgcagtgagctgagatcgtgccattgtactcattgtactccagcctgggcaacaagagagaaactctgtctaaaaaaaaaagaggggggggaatcaaaaccactatgagatattgtctcaccccagttagaatggctactatgaaaaagattaaaaaaaaaaaaaaaaaaaaacagttgctggtcaggatgcagagaagaggaaacttacacaccgttggtgggaatgtaaattagtacagccattatggaaaacagtatggagatttctcaaaaaaactaaaagtagaactaccatgcgaggtagcagtctcactactgagtatttatccaaaggaaaggacatcagtatatcaagggatagctccacccatatgtttattgcagcactattcacaatagcaaagatattgaatcaactttgtgtccatcagtggatgactgagaaagaaaatgtgatatatatacataatggaatattatgtggcagtaaaaaagactgaaagctgggcatgttggctcatgcctgtaatcccagcactttaggagatcaaggtgggaggactgtttgaggccaggagttcgagaccagcctgggcaacacagtgagaccacgtctctacaaaaaataaaataaaaaattagctgagcatggcagcttgtgcctttagtcccagctactcaggagacagagtcaggaggaccacttgagcctagaatttcaaggctgccgtgtgccatgactgcaccactgcactccagcctgggcaacagagcaacagcccgttcaaaaaaaaggtggggagacagggcgcagtggctcacgcctgtaatcccggcactttgggaggccgaggtgggcggatcacgaggtcaggagatcgagaccatcttggctaacatggtgaaaccccgtctctactaaaaatacaaaaaattagccgggcatggtggcgggcacctgtagtcccagctacttgggaggctgaggcaggagaatggcatgggaaccagggaggcggagcttgcaggagccgagatcgcgccactgcactccagcctgggcaacagagtgagactccgtctcaaaaaaaaaaaaaaaaaaatgcagggtgcgaagaatgaattaggctgggcatggtggctcatgcctgcaatcccagcactttggcaggccaaggtgggtggatcacttgagctcaggagttcgagaccagcctgggcaacatggcaaaaccccatctctacaaaaaaattcaaaaattagctgggcatggtggagtgcctgtagtccaagctacttggaaggctgaaatgggaggatcgcttgagcctgggaggtcaaggctgcagtgagctatgatcacgccactgcactccagcctgggtgacagagtgagaccctgtctcaaaaataaataaataaataaataaattatgtaatttgtagcaacatggatggaattggaggtcattatgttaagtgaaataagctagacacagaaaggcgaatatgacatattctcactcatgtgggagcctaaaaaaagttgatctcatgaaagtagagagtaaaatgttagttaccagaggctaaaaggggtgtgggtgtgtgagtggggaggaagagagtttggttaataggtacaaacatacagttagatagaaagaatatgttctgatttttaatagcagagtaaagtgactatagttaaacaacagtatattatgtattccaaaatagctagaagagacaacttgaaatgttctgaacacacagaaatgataaatgctgaagatgatggatatcctaaatagcctgaattggtcattatacattctatgtacgtaaaaaactatcatatgtactccataaatatgtaccaatattatgtatcaataaaaaagaaagacaaagggaataggttttaggaagtgggatcaacctaggaaggaagcagaaggaagtcccaagaggacagctgtatgcagacttagagagactggagaaagaagtgctctaggggttgtttccagtgaacctgatagagtatctgacatgtttgactatgttgaaaataatgtaggcatttttacatttatgttggaaattctggaagaattagtgataatgacagaaaatttggcaaacaaaaactgaggcaattgttaattccaagaaaaaccaaaaatcgtgtaagaaaggaaatgtagctgggcacggtggcatgcacctgtaaccccagctgctcaggaggctgaggtaggaggatcacttgagttcaggagttccagaccagcctgaatgagagagatcccattgaaagaaaaagagagaaagaggagagaaaaagagagaaagaaagagggggagagagagagaaagagagagaaaggaaatgtgatcataatatgtctaattgatccagaagtaaaccacattagtataggagagtcataataaggttaacatgaaatattgatttaataaaatatattgtgatataacagtattgggaaagatagaaaataaaaggtgtaaattatcatatttcctgtaagatactgatattgtctggatatttgtccctggccaaatcttacattgaattgtaatccccagtgctggaggtggggcctggtgggaggtgtttgggtcatggggttggatctctcatggtttggtgctgtcttcacaatagcacaacatccggtcatttaaaaatgtgtggcgccggctggccgtggtggctcatgcctgtaatcccagcactttaggagaccgaggtgggcggatcatgaggtcaagagttcgagaccagcctgaccaacatggtgaaacccgtctctactaaaaatataaaaattagctgggtgtggcagcacgcacctgtaatctcagctactggggaggctgaggcaggagaattgcttgaacccaggaggtggacgttgcagtgagccgagattgcgccactgcactccagcctgggtgacagagtgagactccgtctcaggaagaaaaaaaaaaaaaaaaacattgtgtggtaacttctgtctctctcccctccttttgccacgtgatgtgcctgctattacaattgttagttttctgcctttgtgatgtggctaataatatcaaacgtgtgttgaagtcccctactattattgtgtgtctaagttttttcttaggtctagaagtaattattctataaagttggctgctccaatgttgggtgcatatatatttagaatagttaggtcttcttgttgaattgaacccttcatcattatgtgatgccttctttgtctttttttactgttgttcatttaaagtctattctatctgatacaagaatagcgatccttatgctttttttgttatttccattcggacgatagatctttctctgtctctttactttgagcctataggtgtcattatatgtgagatggatctcttaaagacagaagaaatggatggatcttgttttttttaatccaacttgccagtttatatctttttttttttttttttttttttctgagacagagcttcgctcttgttgcccaggctggagttcaatggcacgatctcagctcagtgcaacctccgcctcccgggttcaagtgattttcctgcctcagcctcctgagtagctgggactataggtgcgtgccaccacaccttgctaatttttgtatttttagtagagacggggtttcaccatgttagccaggatggtctcgatctcctgacctcataatccgcccacattggcctcccaaagtgctgggattacaggtatcagccactgcacctggctgccactctatgtcttttaagtggagtgcttagaccatttacttcaaggttaatattgatatgttaagttttgttgccattgtagtgttgttatctaattgctttataatcttgattgtgtaattgctttacagagtctgtgggctatgtgcttttgtggtagcaagcatcattctttagtttctgcagttagaactcccttaagcatctcttgtaggactggtctcgtggtgacaaattctcatagcaattatttgtctgggaaagaccttatttctccttcatttatgaagaggattgcttgaggccaggagttcaaaactagtctgggcaacaaagcgagaccctgtctctacaaagagttaaaaaagattagccaggcattgtggcatgcacctgtcatcccagcaactaaggaagctgacgtaggaggatcacttgagcctaggagtttgaggctgcagtgagctatgattgcacaactgtattctagcctgggcaacagagcaagatcctgtctctacctgaaaaaaaaaaaaatcctaaaaatgggcccccagtctctttttgtttgtaagtctttgctgagaaattcatttttagtctaatatgatgcttttctctagttgcctttaagattttttctttcacattaaccctggatactctgatgactatggaccttgaggatggtcatcttgcatactatctcacaggaattctctagatttcttgtatctgcatattgaactctctagccagattgggaaaattttcctgaattatatccttgaatatatttttcaagttgcttacttgtgcttctctctcagaaattccagtaagtcataaatttggtcactttatataatcccatatttattgatggctttgttcatttttttttaaatttttttatctttatttttgtctgactgggttgattcaaaggaccagtctttgagctctgaaattctttcttctacttagtatagtgtgttgttaaggcttctagctatattttgaaattctgttagtgaatttttaattcgagaaattgcttcattcattcttaatacagctgtgttatctttcaaatctttgatagttcttctgacttccctgtgttggatttcaactttctctttgatcttattgagtttctttgccattcatattctaaattctatatctgttaggatccattgcttgagacacaatggggtcctttggctaaacactttggctttttgttttcctggagttcttgccctggttccttctcatctgaaggaactgacacttcctttttttgaatttgctatcatttggatggggcttcttgattattattattatttattattatttttttgagacagagttttgctctttcacccaggttggaatgaagtggtgtgatctcggctcactgcaacctctgcccccctcccccacccccccagttcaagcaattctcctgcctcagcctcccgagtagctgggattacaggcacctgccaccatgcccggttaatttttgtatttttagtagagatggggcttcgccatgttggtcaggctggtctcaaactcctgacctcaggtgatccacctgcctcgacctcccaaagtgctaggatggattacaggcatgagccactgcacctggtggcttcttgattttttattctttttttcccttgttggcatgactgtggtgtatgttgtctatgattgattggctttatttctgggtgttttcagggtgccaaggttctgtacaggttccttggttgtagataagttcatgcagtggctttctgaaacattatttgttgtagtgatgcatgcacttttgttcagtggtataattcagttgccgtccagtagatggtgtttaagagtaagagccatcagggaggtgtgcgggtggaagcaatggagagtcaatcacaaaaagcactttccttcagggtattcaccttcagtgaaggtgaagctgccggagaagcccaagaagtggtttctgtaagcccatgctccccagccctgttgggaacagccactgtcaagtccacaacagtgcactgaggacaagggtaaggggagagagatgaccttctctctatgtctatttatgggctttggtggtactgccttcagcaactggtgctgagcttgcatttcctgtgacccaaggggggctttggcaggccatgttccccctcccatagggatggactgcaccaagggttagatctccaggggcgtagggtctgcccctctcttctgcttcttggagctggtgggacactataccccaactgaccaagggagcaggttagggcactaagcaatgacacatgcagactggttccaggtcacaaagctgtccctagctgcaagtctcaccactggtgagaaacttcagcttcagcaactctcctctcactccagtcctatgatgggagacagcctaattcagtgtttatggctggggcactcttcacactcagtgaccaattctggctgtgggcccttcccccattccagagcaagcactctaatctctagcgtgagactaaaatgcctgctgtggctgccactgccaggttgccaaacaatgtctggctttgtatgagcctggattaaaaatggcatcctctaatcccagcactttgggaggccgaggcgggcggatcacgaggtcaggagatcgagaccatcctggctaacacggtgaaaccccgtctctactaaaaaaaaaatacaaaaaattagccgggcgtggtggcgggcccctgtagttccagctactcgggaggctgaggcaggagaatggcgtgaacccaggaggcggagcttgcagtgagccgagatagtgccactgcactccagcctgggcaacagagcgagactccgtctcaaaaaataaaaataaaaataaaaatggcatcctcctcttggccccagatctgggaaactgtctgcacttttcccagtatctttccctttctctgtctcccagggcttgggagaaacgagtgtttttccgtggcctgggttgcacagatccgtagaggaaaggtgagtcatagagggagaccgactgcccctgtcatatactggagcttcactcacatttatcagccaaacaccaccacggaggctgcttgtccaccttctcctccccagggtctgggttattgtttaccatttcagtgaattcctgtcttccttcttgaattaaagctctcatagttggtctttatgtgctgttttgttgtttccaagtggctaatgcatgctgaaagcttttaatctgccatcttgaagaaaaaagcacctagtatttttaaatagaaatttatattttctggttacgaaggaaataatggctaaaaaaaaaatgaaacattccagaaacaaaaaatgaaagtcctccacaatttttattatgcatgtttaataaaagaccatgaactctgcagaggaaaaaggagaactttattttctaaaaccaatctgctggccaggcgctgtggctcacacctgtaatcccagcactgggaggccaaggcaggtagatcacctgaggtcgggagttcgagaccagcctggccaatatggtgaaaccccatcactactaaaagtataaaacttagccaggcctggtggcacacacctgtaatcccagctttcatgcgcgtccgtgtgaagagaccaccaaacaggctttgtgtgagcaacatggctgtttatttcacctgggtgcaggcgggctgagtccgaaaagagagtcagcaaagggagataggggtgaggccgttttatagcatttgggaaggtaatggaaaattacagtcaaagggggtttttctctggtgggcaggggtggatctcacaaagtacattctcaagggtggggagaattacaaagaaccttcttaagggtgggggagattacaaagtacattgatcagttagggtggggcaggaacaaatcacaatggtggaatgtcatcagttaaggctgtttttacttcttttgtggatcttcagttactttaggccatctggatatatacgtgcaagtcacaggggatgcgatggcctggcctgggctcagaggcctgacaccagctactcgggagcctgaggcaggagaatcgcttgaacccgggaggcggaggttgcagtgagctgagatcacgccattgcactccagcctgggcaacagagcgggactcagtctccaatcaatcaatcaatctatcaaagcaatctgcagactaaggagatgtagccttccatgcaaactgaaaatgtgctctgaagttttggggtgggtgaagagttagagattatatacacaaaacctgcatggtaggtgagggtaatcaggagaatgaggaacagagtcttgattggatggcctttaagcccaaaatcaccagtctctcttaataggcttgtttcaggtggttagttggttggcaccaggtggtctcttgggggtcagttgggaaattcccagctatagttgtttccaggcattgttctttgacttggttgcagaaaaccaggttttgcggtgctttctaaggtcacagagaacatgagcactcccttgccctgccatggcctcttgggtctgcttttacttttgaaccacaaggagtccatcttgtctgttaactgggggcataattcaacatttcctccttttagttgaaacctgttgtaggcagcactgatgaccaacttatgctatgtcccttattgttgctagggtgggtccatctagtccctcagtgggactcacgtggctgagagacttatggccagtttaaacaatttggaccaagcagggtgagaaggacaagcaggcacctgttagatccttatcagtgtctcttattgacgtttggtagtactggttaagtctatggataagatctggaagcaggctgagtgtggtggctcatgcccgtaatcctagcactttgggagactgaggctggaggatcacttgagcctaggagtttgaaaccagcctgggcagtatagtgagtcccatctctgaaaaacaaaaacaaaaacctagacgtgtcatgtgatcaaaatctgggttagagaactggtaaaacatttgttaatgcagacaagaataactataaagaggagctaggtacttaggcctattataagaaggatttaagacaatgtgagccaggtacagtgcttcacgcctgtaatcccagcactttggtaggccaaagtagggggatcgcttgagctcaggagttcgagaccagcctaagcaacatagtgagacctcatctctactaaaattttttttaaaaattagctggctatagtggtgcacacctgtagtcccagccactcaggggactgaggcaggatgattgtatgagcccaggaggtcaagactgcagtgagagtgagtcctgatcatgccatgaaaccctgtttcaaaaaaaaagacaataactgtggactacaaaaacttagggtagccataattaaagatgcaattggcaaagaaatttggttatttgtgtggcataaaacaatttaatataataaccataattatgactgtgataatatatactaagacatgtcagaatttagaaatatgatatgatttggaaacacattaatattaacatatataatgtgttattaatattaatttaatattaataatacatttatataaatacaactcaaagttaaacaccattttaaaatgtgacaatgcttcctgtgtgattttagcataccaaataagcctaatatgtctttctcagaccttaggggttcctgttatgtctacgtctgggtaaaaaataattgattttaaaatttgagccaggcgcggtggctcatgcctgtaatcccagcactttaggaggccgaggcgggcggatcacgaggtcaggagttcaggaccagcctggccaacatggtgaaaccctgtcttttaaaaaaaaaatacaaaaactagctgggcgcagtggtgcgtgcctgtagtcccagctactcgggaggctgaggcaggagaatcgcttgaacccaggagcagaggttgcagtgagccgagattgcgccactgcactccagcctgggccacagagtgagactccatcgccaaaaaataaaaattaaaaaaaaaattgaaatttaattttgagtagcttgtcaaatatcaaaggtttaaaacgcttgatcaaaatgaggccacaggtcactatgaaatgaaaccaaagtgacaaaagatcttaaaggcacaaagcacagaaattgatgaaacacaaaatggaatctctatttcctaggccagttactaggaaggtaaagaaaaacgttttacaatttttgttttgctttgttttgtttttaattgagacagtctcactctgtcacccaggctggagtgcagtagcatgatctcggctcactgcaagcttcacctcctgggttcatgacattctcctgcctcagcctcccaagtagctgggactacaggcacccaccaccacgcctggctaattttttgtatttttttttagtagagatggcgtttcacagtgttagccaggatggtctcaatctcctgacctcgtgatccgcctgcctcggcctcccaaagtgctgggattacaggcatgagccaccgcgcctggccctacaatttttcttaaagagcaaatcaatgttcaagaacgccctgttgcttcaaatagggaccccaactctggccttgtgtcagtgtgcttttgaattagtgttcaatttttactaaaatttacaaataattttcttttaattttagctaacttgatcacacacaaaatttctttcatcagactaatctttcccaaaccatttacaacttgtctaaaccttcagttttgtacatttcttttgtggggtgggagtattctagcttagggcaaaaatttactttctttcttcttcatcattttgaccacacacggtattttgtcatgtgaaagaaaaaattactctatctctttttaaaatttttatttgtttatttttctttttgggatggagtcttgctctgttgcccaggctggagtgcagtggcacaaccttgctcactgcaacctccacctcctgggttcaagcgagtctcttgcttcagcctctcgagtagctgggattacaggcacgcaccaccacacgcagctaatttttctatttttagtagagatgggtttcaccatgttgcccaggctggtctcaaactcctgacctcaggtgacccacccacctcggctttccaaagtgctgggattataggcgtgaggcactgcacccagcctctttttaactttttttaaaataagaaacacatccttctttctttatatgctgtctatatagaattgtttcttttatatctagcagttttcattacatatattaactataattttaactcttagtaaccctaatttctggtgaaaaacctgggaagtaagtaattttgaactgttgtatactagtatttgtagatgaaaaacattttgtaatttttagccttaaatttttgtttattaacatctaaatatattagttatttccataccatataaaagtcaaagtatataaacttaaacttatgtttaataattaatgtttcagtattttaacttacctagaaatgactcagatgttttatgattatgtattacttaatttaacagagcatgactttgagattttaaattatggaaaagaattttgaaactatgatacggataccttttctaatgtcttttccagttatcctgggttgcaagtacccaggataaaaatataaataaataaaaaagaaagaaagattggagtggctagtagtgctagtagtgatggtggcattttataattttctttttttttttttttttttttttttgagacggagtctcgctctgtcgcccaggctggagtgcggtggcgcgatcttggctcagtgcaacctccacctcccaggttcaagaaattctcctgcctcagcctcccgagtagctggaattacagacgcccaccaccatgcccagctaatttttatacttttttttagtagagacggggttttgccacgttggccaggctggtctcgaactcctgaccttgtgaaccgcctgccttggcctcccaaagtgctgggattacaggtgtgagccactgtgcctggccacattttataatttttaagagcttatgtttggcagggctttttctgtgaattttgtgtgatctgggttggggctatgtctttccagagagattgagtatttgctcttgtcaaatacctcaacgtaggactaattttttactttaattttttggcttgaaggttctaaaaacatgtggttagtgtaaatatgatcctcaaatccacctgagggtgggcctatggttatacattcttaaggaagcctttttaaaaattttttatgcagaacaaggcatacttcctcattatttctctatgatggtggaaaaactagttcattttttgactaaggtccaagttttccctggacttttgagttctaatatcctgcttcattttctattactgtgtgtctgtcagaataccaggtccttgatttctgagataagcaatcttctccactcccttatctataggattaggatcaatttgtgtttatcttccagttttagcgcctttttttttttttcttaagatggagtctctctccgtcccccaggctgtagtgcaatggcaatggcgtgatctcagctcactgtaacctctgcctcctgggttaaagtgattctcctgcctcagcttcctgagtagctgggactacaggtgtactctaccacgcctggctaatttttgtatctttagtagagatggggtttcaccatgttggccagactggtctcaaattcctgacctcaggtgatccacccaccttggcctcccaaagtgctgggattacaggcatgagccaccgtgcctggcctagatccctctttatttttagtctctggaaagagagagagagacaaagagagaggaagagagagagatcaatcctagacttttactttcttcggagagcaatatgcatttaaaataatgtttacgatattttagtcctcaattttaggcatcttgtggctgagggttttcagaaaatctagactgaaatattgctggaaacagaatggcgttaaactattccttctctcaactcctcagagtcccttgggataaaatatgcaataaacatgtgagggcctctccagtcatcactgatttattggagtctgaaaagtaaaaacaggatagtgtaatgttcctcattaggattctgcttaatacttaactattttgttaatatttggttttgcttaattttacccacatcacttttctcggaaatggacgttatgggggttctaatggcttcttgaacatcaaatagctcttaaaagtaaaaccgtgacggacagagggaattaatcaaacagggattaaatttcccttgaaacacatgtgggtttaatacacatgaaatacatacttcccttgaattacatatgagtttatgaagagcaggaaagttcttcataatttaaaaaatgtgggataatatttgagatgcttgagaaatgcaaaatgttgctgaacaaatagtcccgaccaggagatgaaaacatctcacactgtttcagacacacagtacacacttaaggaattttggcacaatctcaatttttcaaatgtttcaaacacccttaagcttatttctgtggaagaaacttctttcccacctacgtgcaatcgaatgttcagggtatgccgcaaagaaaaggaggggttagtacattctacctgaaggaatctaaaaaggcaggacagatggtgctagagctgagtcctaaaagaagagctgtttgcctggtagactatgatgggcagagggagcagcatgtgtaaagactcagaggcaggaaaacaggttggaatttttagggaactgcaattaatttgctatgccaaactatattataggaaagggacacagtgagagatggggcagcaggaccagttagaagtccaactaaagagggattcgactttatcctgaaagatcagtattatgattattatcacaatatctcagccctctatttatttagagacagagcctggctctgtcactcaggctggcatgcagtggcacaatctcagctcactgcaacctctgcctcctgggccgaagccatcctcccacctcagcctcccaagtagctgagattacaggcatgcatcaccacacccggctaatttttgaaattttaatagagacaggatttcaccatgttgcccaggctggtctcaaactcctggcctcaagtcatcctcccgcctcagcctcccaaagtgttggcattacaggtgtgagccacagcacctggcctcagcactcacttatataaatatgttttaaaattacctttatcaaggataatctatatacaataaaatgcaccaatttcaagtgtgtcttggtgacttttgacaaatttatacatctaggtaaccaacaacaatttatagaattttttctttttctttttactttttctttgatatctaataattgtacatatttatgggatcaatctttagaattccttccttccttccttccttcctttccttccttccttccttccttccttccttccttccttccttccttctttccttctttctttctttcttctttctttctttctttcttgcttttagaggcagagtcttgctctgtcatccaggctggagttcagtggtgcaatgatagctcacttcagcctcaatctcttgcactcaggcaatcctccttccttggcctcccacagcactggagttataggcatgagccaccatgcctggcctagaattttatattgagaagtgaagccagctggacttcctgggtcaagtggggttgagtggggacttggagaacttttttgtctagctaaaggtttgtaaacacaccaatcagcactctgtaaaaacgcaccaatcagcactctgtgtctagctaaagatttgtaaacacaccaatcagcacactgtaaaaatgtaccaatcagtgctctgtgtctagctaaaggtttgtaaatgcataagtcagcgctctgtaaaaacggaccaatcagcactctgtaaaatggactaatcagcgctctgtaaaatggaccaatcggcaggatgtgggtggggccaaataagggaataaaagctggccacccgagccagcagcggcaacccgcttgggtccccttccacagtgtgacttttgacaaatttatacatctaggtaaccaacaacaatttatagaattttttctttttctctttaattttctttttctttttaattaactcgaacaaagtgtgggagctttgttctttcactcttcacaataaatcttgctgctgctcactctttggggctgcactaactttatgagctgtaacactcaccatgagggtctgtggcttcattcctgaagtcagcaagaccatgaacccaatgggaggaacaaacaactctggacgtgccacctttaagagctgtaacactcgctgtgaaggccttcggcttcacttctgaagtcagcgagaccacaaacccaccggaaggaagaaactctggacacatctgaacatctgaacaaactccggacacaccatctttaagaactataacactcagcacgagggtctgcagcttcattcttgaagtcagcaagaccaagaacccaccagaaggaaccaattccggacacattttgacaacccagatgggacacattttggtgactccaccaggacagtcaccaagcagtgagtacctttggacccctttcacttgctattctgtcctatttttccttagaatttgggggttaaatactgggcacctgtcaaccagttaaaagcgactagtgcggccaccagactaaagacatgggtgtcaggctttctgggaaagcactctctaacaacccccaactcttcatagttgggagcgttggtttgcctggaaccagctgccgctttccctgtacttccgggctgagctgagggttgacagaatggaaagccattcagctctggggtcccaacaacaagtcggttgacactgcagccatgagtggaactctcaaagtcatgtcacccaagcgagactcgcccatctatcatatctatcctgacccttgcctcctgggtcctaatgcttgtcagacaaacttcctctcacctctcttctccaaggctagtcccacttctaaaaaccactccttgtctctggtgcttttctagtttctcctataagaatgatctctagtataaactacaggactctattcccttctttaggcacccaggctcactaatcagaaagacacaatttttgcccaaagccccgttgggggcgggggactatcttatctggaattttagtatccctcctcagactagcaggcctaacaaaagctattcctgaagctaggatatggggagcctcagaaatgatatccttcctgttcaagtgaggacaaaaggcatcagtcttccaaccctggagatcccttccctccctcagagtatggccctccacttcatttttggggcataacatctttataggatggggtaaagtcccaatactaacaggagaacacttaggactctaacaggtttttgagaatgcgtcagtaagggccactaaatccaatttttcttggtcctttttgtggtctaggagaacaggcaagggcgcaggtttttaagaatgcattggtaagggccagtaaatccgactttccttggtcctccttgtggtctaggaggaaaactagtgtttgtgctgctgcgtcggtgagcgcaactattctgatcagcagggtccagggaccgttgtgggttcttcggcagggggagaaacaaacaaaccaaaaccatgggtggttttgtctttcagatgggaaacactcaggcatcaacaggctcacccttgaaatgcatcctaagccattgggaccaattcgacctgcaaatcctgaaaaagaggtggctcaattttttctgcactatggcttggccccaatattctatctctgatggggaaaaatggccacctgagggaagtataaattacaatactatcctgcagcttgaccttttctgtaggagggaaagcaaatggagtgaaataccttatgtccaagctttcttttcactgaaggagaatacacaactatgcaaagcttgcaatttacatcccacaggaagacctctcagcttacccccgtatcctagcctccctataactccccttcctattaatgataatcctcctctaatctcccccaccaagaaggaaacaatcaaagaaatctcccagggaccacaaaaacctccaggctatcagttatgtccccttcaagctgtagggggaggggaatttggcccaacctgggtacatgtccccttctccctctctgatttaaagcagatcaaggcagagctggggaagttttcagatgatcctgataggtatatagatgtcctacagggtctagggcaaaccttcgatctcacttggagagatgtcatgctattgttagatcaaaccctggcctttaatgaaaagaatgtggctttagctgcagcctgagagtttggagatacctggtatcttagtcaagtaaatgatagaatgacagctgaagaaagggacaaattccctaccggtcagcaagctgtcccctgtatggatccccactgggacctcaactcagatcatggggactggagttgtaaacatctgttgacctgtgttctagaaggattaaggagaattaggaaaaagcccatgaattattcaatgatgtccaccataactcagggaaactaagaaaatccttctgccttcctcaagcggctatgagaggccttaagaaaatatactcccctgtcgcctgactcactcgagggccaattgatcctaaaagataagtttattacccaatcagccacagatatcaagagaaaactccaaaagtgagccctgggccctgaacaaaatctggaggcattattaaacctggcaacctcagcgttctataatagagaccaagaggaacaggccaaaaaggaaaagcgagatcagagaaaggctgcagccttagtcatggccctcagacaaacaaaccttggtggttcagaaaggagagaaaatggagcaggtcaatcacccagtagggcttgttatcagtggtgtgcaaggacaccttaaaaaagattgtccaacaagaaacaagctgccccctcacccatgtccactatgccgaggcaatcactggaaggcacgctgccccagaggacaaaggttctctgggcgagaagcccccaaccagatgatccagcaacaggactgagggtgcctggggcaagcgccagctcatgtcatcaccctcactgagccccaggtatgtttaaccattaagggccaggaaattgacttcttcctggacactggcgcagctttctcagtgttaatctcctgtcccggacagctgtcctcaaggtctgttaccatctgaggaatcctgggacagcatgtaaccaggtatttctcccacctcttcagttgtaattgggagacttttctacagatagtaagtatacttatctaatcctacatgcctatgctgcaatatggaaaaaagggaatttctaacctctggggaaacccccattaaatatcacaaggaaaccatggagttattgcacacagtgcaaaaccccaaagaggtggcagatggagttactgcacgcagtgcaaaaccccaaagaggtggcagtcttacactgccgaagggaagtgagaggggagaacaaaagggaaggagaaggggagaacaacagcataagtggctggcaggggcagggaaagaccaacagagagttaaagagagagacagagagagacagagacagaaagtgagagagagagatgaagtgataaagacaaagagggagtcagaaagaaaaggggtgggggaagacagaaagagagaaggaaatagaggaagaggcaaaggagtcaaagagagagaaagagatagaagtagtaaagaaaaaacagtgtaccctattcctttaaaagccagggtaaagttaaaacctataattgataattgaaggccttctctgtaaccctataacactccaataccatcttgttgttagtgtaaacaagggtatagcccgaaagcactgaggccactgacaagccatagccttcctatcaaaaatccttaacccagcaagtttcctaacaggggatctaaatcttaattaattaccatacaaaggtctgaccagaccaaggaggaattcccttcaggacaggagatagatgtttcctcccaggcgattaagggaaaaagacacaatgggtattcagtaagtgataaggaaactcttgtagaagcagaattaggaaaattgcctaataattggtctgctcaaatatgtgagctgtttgcactcagccaaaccttaaagtacttacagaatcaggaaggagccatctataccaattctgagttaatatgaactgaacaaggttttattaatagcaaagaaaaattaaaatcccaaacttacaaggttttcaactaaagtaaagtttgctaaaagttaacagtgtaacatgtattatcctactaccacacactgtcaaaggatttctcagacagtttgcaagaaaaaacgaaatctatccttactctacaatcccaaatagactctttgatagcattgactctccaaaaccactgaggcctagacctcctcactgctgagaaaggaggactctgcaccttcttaggggaagagtgttgtttttacactaaccagtcagggatagtacaagatgccacccagcgtttacaggaaaaggtttctgaaatcagacaatggctttcaaactcttacaccaacctctggagttcagcaacgtggcttctcccctttctaggtcctgtggcagccatcttgctattacttgccttcaggccctgtatttttaacctccttgtcaaatttgtttcctctaggatcgaggccatcaagctacagatggtcttacaaatggaatcccgaatgagctcaactaacaacttctaccaaggacccctggaccaatctgcgggccctttcactggcctaaagagttcccctctggaggacactacaactgcagggccccttcttcacccctatccagcaggaagtagctagagtggtcattgcccaattcccaacagcagttgggttgtcctgtttagagggggtattgagaggtgaagccagctggacttcctccatcaagtgaggacttggagaacttttctgtctagctaaaggtttgtaaacgcaccagtcagcactctgtaaaatgaaccaatgagcgctctgtaaaatggaccaatcagcaggacatgggcagggccaaataagggaataaaagctggccacctgagccatcagtggcaacccgttcgggtccccttccacagtgtggaagctttgttctttcactcttcacaataaatcttgctgctgctcactctttgggttagcactacctttatgagctgtaacactcaccacgagggtctgtggttccattccagaagtcagcaagaccacaaacccactgggaagaacaaacaactccagacgtgccacctttaacagctgtaacactgactgcgaaggtctgtggcttcacttctgaagtcagcaagaccacgaacccaccagaaggaagaaactctggacacatctgaacatctgaacaaactccagacacaacatctttaagaactgtaacactcaccacgagggtccgcagcttcattcttgaaagtcagcgagaccaagaacccaccggaaggaaccaattccagacacaatattacctcagaaactccgcttgtgcctcttctcagtcaatcccataccccccgcccccagtgcacacacacatatcaaggcaattgttatggatttctgtcactataaattagatttgtctttcctaaagtttcaattaaatggaataatatactatatactcttgtgtctggcttctttccctcagcatgatgtttttgaggtttacccatgttgttgtacattagttcattctgttttttgctaaggtttaattagacttatataacaaatactgggcatggtggcattacagtaactcaggaggctaaggtgggaggatcaatttgagggcaggagagttttgaaagcagtctgggcaacatagcgagaccctgtctctacaaaaaaacaaaacaaaacaaaacattagccgggtgtggtggcttctgcctgtattcccagctgcttggtgtggggaaaagaaagatcagatcgttactgtgtctatgtagaaaaaggaagacataaagaaactccattttgatctgtactaagaaaaattgttctgctttgagatgctgttaatctgtaactcttgtcccaaccctgtgctcacaaaaacgtgtgctgtattcaatcaaggtttaatggatctagggctgtgcagggtgtgccttggtaaaaatgcgtttgcaggcagtatacttggtgaaagtcatcgccattctccattctctattaaccagagacacaatgcactgcggaaggctgcagggacccctgcccaagaaagcctgggtattgttcaggtttcccctcactaagacagcctgagatatggcctcgtgggaagggaaagaccttacagccccccagcctgacacccgtaaagggtctatgctgtagaggattagtgaaagaggaaggcctctgtgcagttaagaggaaggcatctgtctcctgcacatgcctgggaatggaatgacttggtataaaaccgaccacacattctattctgagataggagaaaacctccttatggctggaggtgagacatcatggcggcaatactgctgttactctttactgccctgaggtgtttatgtaaagttaaacataaatctagcctacgtgcacatccaggcacagcacctttccttaaacttatttatgacacagagtcttttgctcacatgtttttctgctgaccctctccccaccattaccctatagttatgccacattccccggccgagatagtaaagatagtgatcaataaatactgagggaactcagagaccagtgctggtgcaagtcctcacctgctgagcgctggtcccctgggcccacttttcttgctctatactttgtctccgtgtcttatttcttttctcagtctcttgtctccaccttgggagacaggagtaggcccccttcagcttgggaggctggggcaggaagatcacttgaccccaggagttcgaggccgcactaagctatgatcatggcactgcactctagcctgggtgtcagagcaagactaaatctccaaaaaaattaaaaaataaaaaagtaatttgaaaaattaatgtaaaaagatttatataccatactttgtttatctagtcaactttcgatggacatttgggtcatttccagtttctagctatacaaggctgctgtgaacatttgtatacaagtctttgtcagcactcactttaacgtatggtatagctaataaatttgtctaggaagatgctactaccccatcaccactagccaaagtatatgtatgtgtggccaggagtagaggggagggcagcatgaagaatttgtctcaggcccggacaatcatagttcctcattcccctggcaacagtaattggtccaaggagcaggcatatgacccagaaaggttagttagagtcttttcccaaaagaaagaaaaaaaaaatttcttcttgggttgctaaaatgggacaatgtgtacttgaggttatacaggctggccttgaactcctgaccacaattttctgcactggttgtatagaggcagcccttctacagcaggagaaaatcagaacaatgagtaagggaaaatggggtgggggagacagaaagaatccctgcctcctccataaattagacttatgccagacaggaacactcatgtttagacaaaattgggagtctgaaataaacctaataaagaagaaactagaggttagaagagaatggacatagtagatacggctgaaattaaaatacaaaattaaaaaatgcaaaaattggccaggcgcagtggctcatgcctgtaatcctagcagtttgggaggccgaggtgggtggatcacctgaggtcaggagttcaacaccagcctgaccaacatggtgaaaccccatctctactaaaaatataaataattagctgggcgtggtcgtgggcacctgtaaccccagctattcaggaggctcaggcaggagaattgcttgaacccaggaggtagaggttgcagtgagctgagatcacgccactgcactccagcctgggcaacaagagcaaaactctgtctcaaaaacaaaaaacaaaaaaataaaaaaaaattagccgggtgtggtggtgcacacctgtaatcccagctactcgggaggctgaggcacaagaatcacttgaacctgggaggctgaggttacagtgagccgagatcacaccactgcactccagcctgggtgacaaagcaagactctgtctcaaaaaaaaaaaaaaaaaaagaaagaaaagaagaagtttgcattttatgttgtagacattgggaaattgtatcagtctgttagggctaccataacaaagtactgcagactgggtgacttaaacaacagaaatctattttctcatagttctgaaagctagaagtctgagatcaaggtgttggcaggtttggtttcttctgaggcctctctcttctctccttggtttgcccacggccgtgttctccctgtatctgtgtcttcacctggtcttccttctttatgtgtctgtggccaaatttcctcttcttataaagatgcaagtcatattggattagggccttttttttctttgagactgggtctcactctctttcccaggctgaagtgcagtgaggcaatcatagcccaccgcagccttggacttagtggcttaagtgatcctcctatgccagcctcccaagtagctaggactacaagtgtgcaccaccatgccctgctaatttttctaattttttttggagatggggtctcactatgatgcccaaagtggtctcaaattcctggcttcaagcaatcctccagccttggcctttcaaatttctggaattacaggcatgagccaccatacctggccatggcctcatctttaattacctctttaaagaccatgtctccaaatgcaggcacattctaaggtactagggcatagaacttcaacaaacttcaacatatgaattttttttttttttttggagacagagtctcactgtcacccaggttggagtgcaatggcatgatttcaactcactgcaacctctgcctcctgggttcaagcaattctcctgcctcagcctcccaagtggctgggattacaggtgtgtgccaccgcgcccggctaatttgtctttttagcagagacagggtttcaccatgttgtccaggctggtcttgaactccttttttttttttttgagatggagttttgctgttgttgcccaggctggagtgcagtggtgtgatctcggctcactgcaacctccaccttctgatttcaagcaattctcctgcctcagcctcccaagtagctgggattacaggcacccaccaccacacccagctaatttttttgtgtttttagtagagatggggtttcaccatgttggccaggctagtctcaaactcctgacctcgtgatccgcccacatccccctcccaaagtgctgagattacaggtgtgagccaccatgcccggccagtcttgaactcctaacatcaagtgatccacctgccttggcctcccaaaatgctgggattacagggatgaacaaccatgccaggcctcaacatatggatttttatgggaaaacaattcagcccgtaagaggagccatcaaagactttctttccactacttcatatgttttattttgttgtatattcttctagaaccaggttcattttttcagttttgtagaaaaatagatgttccagccaccatttacataattgtctagttttttaagaccaatcagatatgttccctggaaagatgaatagaagaattttttttttttttttgagatggggtctcgctctgtctcccaggctggagtgcagtggcacaatcttggctcactgcaacctccacctcccgggttcaagcgattatcctgccttagcctcctgagtagctgggattataggcacgtgccaccacgcctggctaatttttgtatttttagtagagatggggttccaccatgttggccaggctggtctcgaactcctgacctcgtgatctgcccactttggcttcccaaagtgctgggattacaggcatgagccactgcacccggccgaatagaagacttaaaaaaaaattttttttgtagggatggagtctcactgtgttgcccaggctggtcttgaactcctgggctcaagcaattctcccactttggcctcccaaagcactgagattacaggcatgagccactgtggctagttcacatggaagacttttttttttttttttttttttttaatacagagtcttgctctcccccaggctggagtgcagtagtgcaatctcggcttagaaaaaccaccacctgccaggttcaagcaattctcctgcctcagcctcccaggcagctgggattacaggcaaccaccaccatgcccggctaattttgttgcatttttagtagagatgggcttttgccatgttggtcaggctagtctcgaacccctgacttcaggtaatccactcaccgcagcctcccaaattgctgggattacaggtgtgagccatcgtgcccagcctgaagacttttaagtagagaagggcaagaacagatctatacttgaaaacattactggtaacagtgtggagaatggactgcaggaggaaaagagaagaggtatgaaggcttgttagagtcttttggaatttcccaggcaaataaatgataaaagcctgaattagcctactctctgacacctgattagaatataaatcacctatagatagagtggcttatgagcggttgatgacttcccactaggatgaattatttcatacaggatgtttatgcacatttgctttgaagagggagaaaggcttttcctattgtcacagctgccagcattcacccaggcaagcttccagcttgcttatgtctgcagcttgattttatagtctgcgttttgttggaaaataaattatttgggggctgctttttattaaaagggaaaccttaccgaggacttcctcacccttactatctgcctaaataatttctttttaactcctatatcaaaaaatccacaaaacatggaattgggccctacttggattctacgttctggaattactgggtgaataaccttgggaaagtcattttatctctctgaacttccattttatgatatgtaaaatggagatgataatttctaccatgcaagtttgtcaaaataattaaatgagatcaggcaggcagggtggctcacacctgttatcccagcaagttgggaggccaaggtgggtggatcacctgaggtcaggagctcaagaacagcctggccaacatggcgaaaccccgtctctactaaaaatacaaaaattagccgggtgtggtggtgcacgcctgtaattccagctacttgggaggctgaggcaggagaattgcctggacccaggaggcagaggttgcagtgagctgagattgcgccactgcactccagcctgggcaacaagagcaaaactccgtctcaaaaaaaaaaaaaagaaagaaaaaaaaacagaattaaatgacatcatgaatgaaaactacttttattttttatttttatttatttatttttttgagacaggatcttgctggagtgcagtggcgtgatcatggctctctgcagcctcaacttcccaggctcaagtgatcctcccacctcagcctcctgagtagctggaacttcaagtgctcaccaccacacctagctaattttttgtagagacggaatctcattatgttgcccaggctggtctcgaactcctgggctcaagcgatcctcccacctcggcctcccaaagtgctgggataacaggcatgagccaccgtgcctggcctgatctcatttaattatgttaacaaacttgcatggtagaaattatcatctccactttacatatcataaaatggaagttcagagagataaaatgagccacctcacccagcccatgaaaagtattttaaatatctgtacacatgttatttattgcacttggtatccctaaaagatacttttatgtctgtaggtgggagtgggaagcagatatttgttacagagaacaatagtggctatgatttactgagttgcctgctatgagtcctggatgtgagccttagagtacctctttcttctagaagggatccctaggtcacaggagctggttgggtagtagttgtatcaacatctgagaaaaacatgactcttctgtgggctatttggatctgattaccagaaaagaaaaaaatttggtttgatttcaataaatgctagaatttgtaggggcagatttagtatcactaagacaaaggaaagagagcacattgacaaaagaaggaaaaaaaaaagagaaagagagcctcagaaggaacatgaaaataaaaagcaaaaactagaaaagacactagaaaaggaaaaacagactttcccaagtgtctcctatttcagactttgtattcatgtttcatttctcattgttgtctcttgaggaagaactattctgtttaatataatttatgcatagtgaatgtcaacatattgttagtaatactgttgttacaacaaatgattccagaaaattttggcttgagtttgttattacatataataattagcatttctataaattccatacctcactcaaatccttcagatgtgggattgctgaggaaatgactttgaaactgaaacctgaaggataagtaagatttagttctgagaagaatgggggaagaatagtccaggcagaggaaatgccatgtttatagccctgagacaggaaagagttcatcgtggagttcatcaaagcaggctcatgtggcagatctcgggagtctatgcaggcaaaacttggtaaaaaaaaaaaaaaaaaaaaattcttcttttgtgtctcaagtgcttagagttgacactaattgttaagtgtcttgggtgtccaggctcaaacaactgttaacagttgaaacagctacccctgaggccaggactagttctgccccagtgaggacaaagagatttgaggagaggagaaaaatcgaacttaaggatccagcatatttattcagtatgtcctcattcatagctctccctttttttgtttttgtttttgtttttgtttttgagacacagtcttgctctgttgcccaggctggagtgcagtggcacagccacggatcactgcagtcttgacctcccaggctcaagcgatcctcccgcctcagcctccccggtatttgagactacaagggtgtgccaccctgcccagctaatttttttttatagagacagggtctcactatgttgaccaggctggtctcaaactcctgggctcaagggatcctctcactttagcttcccaaagttctgggattacaggcttgagccaccacacccagctagtatgccctcataggtagagtgtttaaagtttaattgtttttattttcttaacactctactatagttttttatggtgttaatttttctggtgatttggtgaccggtctagttccagcatcccctgtttctgtgattgccactcctgctgccatcatcacctctgtggctgtttactaggccaggcactttatttcttattttttttccgagacggagtcttgctgtgtcgcccacgctggagtgcagtggtgcgatcttggctcactgcaacctccacctcccaggttcaagcaattcccctgcctcagcctcctgggtagctgggattacaggcaaacactaccacgcctggctaatttttgtatttttagtagagacagggtttcaccacgttggccaggctggtctcgaactccagacctcatgatccacctacctcagcctcccaaagtgctgggattacaggcgtgagccaccacacttggccagccaggcactttaaagccacctttgactcttctgtcctttataagaacaatagatttcacctctgtgttgtctctctgatgagttacctctggtctattcttatggccacggactgtgttaggttctttacttagtttcctgactccagcctcatccagcttaatctgtccttcgggttcctgccatcatttgtcctctttgaatactgttctaattctgcccctttcttagctctgaccgttttctctgtccacaaattcccacaaagctgtctcacctgtaggcctcaaaaatgcatcatccttgggccaggcgtggtggcttactcctttaatcccagcactttgggaggccaacgcaggaggatccctccaggccaggatttcaaagctgccttgagccatgatcatgccattgcactccagcctgggcaacagagcaagaccctgtctctaaaagcaatacaaacaaaacagaaggtatcattcttcattctttttgttttgttttgtttgagatgggtcttgccctgttgcccaggctggcgtgcagtggtgcaatctcagctcactgcaacctccacctcccaggttcaagcgattctcctacctcagcctcccaagattacaggcaccatgtccggctaatttttttgtatttttagtggagatgggggtttcgccatattggccaggctggtctcgaactcctgacctcaagtaatctgcctgcctctgcctaccagagtgctgggattacacgcttgagccatcgtgcctggcccagaatgtatcgtccttaagattacgtcagactttgcccttgttctgcctttctagtatacttcttttcctatccccaactcactctctggccatcccaattttatagtcttccaggcctttagggcattcttttattcattcattcaataaatgtttattgagtatctactatgtgtcagacactgtgttaggcactggagatgcatagtgagccagacagacacagtccctgcccttgtggagcctacactttcacaaaaggatggtgaagttccaaccaaagaaatatatcaagccagagtaagacaagaaaattttccccatagcagattaaataaattcctaggactcttccagctgaaaggttgaatctgaaattagattgggaagctagtgggctacaagttactcatcagtggtctagactgggtagtaaaggaaaataaggttggaggggttaagactaatttatggaaggctttgaataccaggctaataagttttaaatacagttgtagacaatgatgaggcatccactttttctgatctgatcccttcttttttttttttttgagacagagtctcgctctgtcgcccaggctggagtgcaatggcgcagtctcggctcaccgcaacctccgcctcccggggtcacgccattctcctgcctcagcctcctgagtagctgggactacaggcgcccgccaccaccacgctcggctaattttttgtatttttagtagagacggggtttcaccgtgttagccaggatggtctcgatctcctgaccttgtgatccatccgcctcggcctcccaaagtgctgggattacaggcatgagccactgcgcctggccctgatcccttctttagagacccagagtcttgtttagtcacccaggctggggtgcagtggtacaatcatagctcactgcagccttgaactcctgggctcaagcagtcttcccgcctcagcctccccagtagctggaaccacaggtttgtgccaccatgcctaattgtttgtttgtttttgtagaaacagagtctcactgtgttgcccaaggtagtctcaaacaatcatcccaccttggcctcccaaaagtgctgggattataggcataagccaacatgccctgctgatcctttcttaaaattcagattctaggctgggtgcaatggctcatgcctgtaatcccagcactttgggaggctgaggcaggtggatcacctgagatcgggagttcgagaccagcccaatcaagatggagaaaccctgtctctattaaaaatacaaaagtagccgggcgtggtggcgcatgcctgtaatcccagctactccggaggctgaggcaggagcatcacttgaacgcaggaggtggaggttgcagtgagctgagaatgctccattgaactccagcctgggcaacaagagagaaactccatctcaaaaaaataaaaataaaataaaataaaataaaaacggatcacgaggtcagcagatcgagaccatcctggctaacacagtgaaaccccgtctctactaaaaatacaaaaaattaaccaggtgtggtggcgggcacctgtagtcctagctacttgggaggctgaggcagaagaatggtgtgaacccaggaggcggagctggcagtgagccaagaccacgccactgcactccagactgggagacacagtgagactctgtccccccaaaaaaaaaattcagattctaaagaaccactagctttcttcactcccaggtttcttcaacaaaactggaaaaggtaggtattgtctacaaatctttacactaggtgactgactaatgatctacatttgaggttgcttctttttttttaatttattttttattttatgtatttattcatgtttttgagacagtctttctcttgtcgctcaggttggagtgcaatggcacaatcttagctcactgcaacctctgcctcctgggttcataccattctcttgcctcagcctcccaagtagctgggattataggcgcccaccaccacgcccagctaacttttatatttttagtacagacggggtttcgccatgttggccaggctggtctcgaactcctgacctcgtgatccacccgccttggcctcccaacgtgctgggattacaggtattagccaccatgctgggcttttttttttttttttttttttctgagatggagtctcgctctgtcacccaggctggagtgcagtggtgtgacctcggctcactgcaacctctgcctcccgggttcaagcaattctcctgcctcagcctcccaaatagctggcactacaggcgcgtgccaccatgcctggctaattttgtgtgtgtgtgtgtgtttagtagagatgggggtttcaccatgttagccaggatggtctcgatctccttacctcgtgatctgcccgtcttgccctcccaaagtgctgggattacaggcgtgagccaccgcacccggccttattttgtatcttttttttttttttttttgagacagagtttccctctgtcatccaggctggagtgcagtggcgtgatcttagctcactgccacctctgcctcctaggttcaagtgtttctcctgcctcagcctcctgaatagctgggattacacgcatgcgccaccatgctcagctaatttttgtattttcagtagagacagggtttcgccatgttgcccaggctggtctcgaactcctgacctcaggtgatctgcctgcctcggcctcccaaagtgctaggattacagatgtgagccaccgtgcccagcctgattcttttaatatttgcatttcagccatcttttgtaacttacattttttctgatagtggaatcagaggtttaaaaaaaaatcaaaaagccaaaccataaaattccatattcaccttctttccagggcagaacaaactgaagcctgccaaacttgctccctaaaaccaatagggtcagaggaatgcatgccttcccagtcttctctgtatctgctggcttctttcttttttctggcatgagcactcacctctagaccacagccagccactcctctgaggggaaagcccaggctttccttcctctgcctttacatatcctttctctccctctgcccatgtttcccaggtgttctacttgctgctactttagttaacatttaatgactattaataccataatccttcatagctgacatcctgtaacaacatccctttgccatctaaattacctagaccaatagtaaggagattttttaaagagcctgaattcattttctttatagcaatattagttaacccatagacaattaattatacacacaatcatattacttcagtttggcatgggtttacacatagatcgtgcttttacagttatttacagataacttccttgtctattcccagcccatactagaattccacctgtaacttttctagccatggtagaagtagcaatttcccaagctacattccacagttattcctaacttctgggttaaaaatgcccacttcagagcctcttgaaccccaactactaaagtaccactttgaaatctgcctgcaaaaaatgtccagactacccattcccttccacgtcatacaccttagtccatctgttcacaccatcctcagcctgtcaagctttccttacagctttttctaaaaatgcctcatcatgtcacctacaagcacagagctgcatatattgtgttgctcaatcaccttcattgaaatattaggatgactacattaggacaaaaacctaaaactcagttatattttaattatcctcaccttagatcacagcccatccacaaatcatgtttgatttgggtggaaaaggtcattttagcacgagagtgtagtggtcaaaaggatagaattctgtcacctgttcataagtttaggcctttttctttttttttctttttgagatggagtcttgctgtgtcacccgggctctggagtgcagtggcgcgatcttggcacactgcaacctctgcttctcgggttcaagcaattctcctgcctcagcctcccgagttgctgggactacaggcacacgctgccacgcccagataatttttttttgttttgtattttttttttttagtagagatggggttcactatgttggccaggctggtctcgaactcctggcctcgtgatccgcccgcctcggcttcccaaagtgctgggattacaggcatgagccaccgcacccagtcgctgattttttttttttttttgtattttagtagagacggggtttcactgtgttgcccaggctggtctgaaactcctgagctcaggcaatccacccacctcggcctcctaaagtgctaggattacaggcatgagccactgcgcctggccgtttaggcctcttttgctaaaactgcatgaaagcatgtgtcaagagaactcagagcatgattgccctgggatttgacagcagggctgcacttcatcattctgggcagctcacatctgggaattactatcagaaaaatatctttgtgctgtgtcccttctttctcactgacatctgctttggaggggagatttggatggagtaaagtttctaagcaagtgggagaaggcctagaaatagaacacttcaaagtgcaggccatagtcgtttctcctgatatataattgattttagaagatttaagctttttcctctctggaagctggcaccagttttctccattatagaaaagctgcggctctttaaagggatgtagaaatttactttgactggaaaatatctgaggagagaacagctagtcttcaaagtaggaaaaccatttgtcaaacgttcttgtgcctcctacagggtaacacggagctgttgacagtttcctcctttctcctacagccaagtcaggcaggcattaaaggacaaacatggtctctaaaaagaaggctcaacagaaagcttgggtttgtgaaaagaaaagaaaatattggaaccccaaactcactatgccaaagggaaaagttaagctcgggaactgagtcatgcaaaaaactgccttgctttcgtttctaaacagataacttcaatgtagaagccaccaatatccccaggtggggatatccctcaccctaataatgtaaattaaccgcttatcttcccaggtagaggacaaagacaagaacagaaatcatcccaggctgggcgcggtggctcacgcctgtaatcccagcactttgggaggccgaggcgggcggatcacgaggtcaggagaacgagaccatcctggctaacacgctgaaaccccgtctctactaaaaaatacaaaaaaaaatagccgggcatggtggcgggcgcctgtagtcccaggtactggggaggctgaggcaggagaatggcgtgaacccgggaggcggagcttccagtgagccgagatcgcgccactgcactccagcccgggcgacagagcaagactccgtctcaaaaaaaaaaaataaaaaaaataaaaaataaaatagaaatcatccctctggccaccctgaaacaaatgcatatttgacttcttcctctactctatatttgttatcttacagaaaatgcagatttactgagtgccagataaattggctgttcctctttcccctcctgcctgctccgtcccctttaaatactgaagtcctcaaaaccctctttggacaacacaagccacagatctgtagtaagttgtttctctttttcctgggtgtgttctcagcctttgcacaataaacctctaaatcaattgagacctgtcttagacacttttttgatttacagtttttgttgtttgaagatgccttggcttgtcctccctcctaagatttgctggaatctgactactttggggtagtcttggagcttctgctattaaacccttttcttaaaatgtgctagggctgcctagttgctcttctatgtaaagaaaaacgtctctgaaagagtgtgttgatttgaaaagtatattcatcatattccaggaacagcttacattttcccacactttcatccttaaataaaaagttggctgggtgcagtggctcattgcctgtaatcccagcactttgggaggccgaggcaggcggatcacgaggtcaggagatcgagaccatcctggctaacacggtgaaaccccgtctctactaaaaatacaaaaaattagccagacatggtggcaggcgcctgtagtcccagctacttgggaggctgaggcaggagaatcgcgtgaaaccgggaggcggagcttgcagtgagcccagatcgtgccactgcactccagcctgggagactttgagactccatctcaaaaaaaaaagttacaaattaaggcatcatacactcataattgtcaatagaatctatccctggcgagttatcaaaaatatgggcttagcagtaacgtcttaatcacaaataacttttcaaatgtacaaagaaaatcttttttctctgactcatacagtgagatacaaaaatcaaattggtcccttaagataggattagagttgataagatcatcacccttagaattaggaggtaaacgttttagacctggaacaaagttagcacctagtcgtgcaaataaagaaaggactctagagtagagagaacaatccagggacttcctgggtcatttatttatgaattgacttttgacccttctcatcataggctgtgacctattcttaaagtttgatcttttttcagtccttttacagcatggcagtatttccttaagatctaccaagaatcctagcgagacttaattctgttagcctaacaatatgagaaattcagaaagttaagcgtacttacttcctggacttttacccctgtttcctattctctagtccccctcctgaaattagtgctgatcagaacagaagtttgaagaaactacctgaggctggagaaagtagcaccagaaaagagcagaaggaacaatcctcagagtaccagccccaacaagataaaattcactatgtctgacattcaaaaaaagttatcaggcctgcaaagaaacaggaaaatgtgatccataatgaggagaaaaatcaaatcaataaaacagatcaagaattatacagaagatagaattggtagacagagacattaaaacagttcttataactgtattccacatgttcaagaagctagaggaaagattgaaaatgataagtagagtcatggaagttattttaaaagatctaagtctaacttctagagatgaaaaatatggtatttgatatgaaaaatacaatggataagattaacagcaaattaaacattgccaaaggaaagactaaataacttgaagacatagctataaaaacaataagaaatgaaacacatagagaaaaaagactttaaaaagagcacatcagcgagccttgagacaacatcaggtggcctaatatatgtgtaattagagaccccaaaggagaagggagggtacagaaaaaaaagaaataatgaccaaatagtaatgagcagataaagacccaaaatttttcaaatttgatgaaaactataaacccatagacccaagaagttcaacaaaccctacatgggaagcatgaagaaaatgacaccaaggaactttataatcaatttgcttaaagctattgttaaagaaaaaaatcttcttcatctccagtgccttaggttaggtcctcttcatttcttagctgaacttttacaataatctccaactaattgccctgcctctaatataattccccaccagtcttttcctcttcaccactgttagagaactcttcactgaccattgactaaaatccaggctcttagcactgcaagtaaagctttgttagcatggcatatgtgacccttttcactctctccaatctcggcaccctatcctccacatctgttcccagtcctctaaccacatggtacagttcgtggaaagagctgtactgctctggcctctatgcctttacatatgctattgtctgtctggaaatgtccttctcttccttggtttattaatctgtggcccccactaatctctaagctcctggaagacgacagactgtctctttttcactgcagtgttgggctgaaaaaggaaatagagtggaatttgagaaggggtgtggaaggcaggaggagggaagggagaaaagaacaatagaaaaaacaagactgaagagcttagccaaagtgttctatttccacaaagaaggtaaatatagaagagagaaggccgggcatggtggctcatgcctgtaatcccagcactttgggaggccgaggcaggaggatcacgaggtcaagagattgagaccatgctggccaacacggtaaaaccccgtctctattaaacaatacaaaaattagctgggcatggtggcatgtgcctgtagtcccagccacttgggaagctgaggcaggagaatcacttgaacctgggtggcagaggtcagaggttgcagtgagcccagattgcgccactgcacttcagcctggcgacagagcgagactccgtttaaaaaaaaaaaaaaaaaaaaagacagagagaaaagatgggcaaagaggtgtaacgaagaggtctagtagaagggtggggcttgaacacagggagtgactcctcttttagtgagttgaaagaaagaagtggaggagatagagcttaagggaatttactactggcagtttcgtttccttcctaaagtaggagacaaggtcatgtgctgcaaagaaggcttgaggagaatggaaaaggctgtgacatagaataaccactcacattcaaaacagtgtactgtgatccgctgaagacttcaaatcagagctgaaaaccaggacaaaatatatcctgtcctcctcctaaacataccctacaatatctcctactggctcttccttcccttttataaaaaaccatctgcctagactctctagacagatcactgcctttgattctgagtatggggttttctctggaggggaaccggaaaatgtagcaaaacaagagtaaaggaggagggcaaaatatgaagagtgctcaagagtaggttatacacattttagaagtacagcgaagatcattaaaatagcccaaaatctggtttgaacctaaaggtttctaacaggtacagggaatcagatgtattctaatgtgtcagttgacaaatttcttggcaatttaccttcagaacagtgggagagatctacagctaacatattcagtcattcttggagggtagagggatctctctgcaggggtattattttaaaatcaaagcaaaatatctaacagaataacaagtatctgtaatgaaaaaatctccatttcaaagcgttgcttgaaatgaaagagacattttattagattatttatcagagagtggtctgaggaacaactgcatgatggggttgagggtgaggcccaggggttgggtctggacaaaaatagagattattaacattgcagtttcttgaatcccatgtcagatttactaatttagaatctccaaatggcagggtggggtacgggagaagcctagaaatctaaatattttacagatgttccaagtaatttttaaacattttattatggaaaattttagtctcacacagaagtagagagaatagtacaattaagcccattcacctaccacacaacagggggccgagttaggagttggtaagcaaagtattgataacctgtgcccaagcgaacaaagtaagtggtcacctatacaatctgctactccaatttgccttatatagttgctccaaaagtaaattgcctctctaaaagagaaaatgtagttataactacacattcttttatgatgtaaatatatcctgtctttctatctatattctataaaatgcaaacgtagcaaaaattctttgggaaggtgaggagctgaatgattctgaatagcaggtctgcatcaatttcctaattaatggccacatttaaaacatttaaaaatttttttaattttagaggcggggtcttgcccaggctggtcccaaactcctgggctcaagcaatcctcctgcctcagcttccctagtagctaggactacaagtgcaactatgcccagcagttaatggccacatttaatttaataaatattattgagcacttactgtggccagcttatgatgcaagatctaagctgctattacagagagaccaaaaaaaaacaaaaaacaaaaaaaaccagtgacttaaacaagataaatgtgtatttcttccttacacaacaacatgaaggattggcattccagcaaggaaaatggatattgagggatggttagcaatctctgctgtaccaactttgtacaagaccttgtggtgagcccagagcttatggaccctggagcgtgtacaaatttggaggccctctttaagtaagagaatatagaattatagatacaaaattaagtacagaaaactgagcaagcaaaggtctttaaagctaaattagctttacagtaaatctagctctgagtgggtttctgccatccagtcaggatttgcctgaaaaagacaattagaggccaggttcccagcactttgggaggctaagaccagcttgaggccaggagtttcagaccagcctgggcgagaccccatctctacaaaaaaataaaataaaatagctgggctaattggctcatgcctatagtcctaactacttgggaggctgagatgggaggatctcttgagcccaggaattcaaagctgcaatgagccatgattgcaccccgcactccagcctggatgatagagtgagaccctgtctctctctctctttttttttttttttttgagatggagtctctcactctgtcgcccaggctggagtgcaaatggcacaatttcagcctcccgattcaagtcattctcctgcctcagcctcccaagtagccgggacaacaggcatgtgccaccatacctggctaacttttgtatttttagtagagatgagatttcaccatgttggccaggctagttttgaatttctgacctcaagtgatctgcccacctcggcctcccaaagtgctggtattacaggcatgagccaccacacctggctgtgagaccctgtctctctccttttttttttggagacagagtcttgctctgtagcccaggctggagtgcagtggcccgatctcagctcaccacaacctctgccttccgggttcaagcgattctcctgcctcagcctcccgagtagctgggagtacaggcgcctgccaccacgcccggctaattttttgtatttttagtagagacggggtttcaccgtgttagccaggatggtctcgatctcctgaccttgtgatctgcccgtctcagcctcccaaagtgctaggattacaggcgtgaaccaccgctcccggttgagaccctgtctcttaataaaaataaaaagacagagatctatataagctagtgttttgtcatactataattgactgaagtgcctgaaataagtgccgtgtgcagtgacagtcctgggtagtaaaagaatttactaagacagaaataaaataacagaagcggctgggcgcggtggctcatgcctgtaatcccagcactttgggaggccaaggcgggcggatcacgaggtcaggagattgagaccatcctggccaacacagtgaaaccccgtctctactaaaaatacggaaattagccgggcgtggtggcgggcacctgtaatcccagctactcgggaggctgaggcaggagaaccgcttaaacctgggagggggaggttgcaacgagccaagattgtgccactgcactccagcctgggcgacacaaacagactccatctcaaaaaaaaaaaaaaaaaaaaaaaaaaaaaaaaggtacaaaagaaaacagaaggaaatttattaggggaatgctgctttatagcagcaacaggcagtagtgagagagctgctatctgccaagaggcagaaatgtgacagggttttttgttttgtttttttttttgagacggagtcacccagggtctgtcgcccaggctggagtgcagtggcatgatctcggctcactgcaacctccacctcctgggttcaagcgactcttatgcctcagcctcctgagtagctgggactacaggcactcgccaccatacctggctgatttttgtatttttagtagagacggggtttcaccatattggccaggctggtctctaactcctgacctcatgatctgcccgcctctgcctcccaaagtgctgggattacaggtgtgagccaccacgcccggcaagagggttttataggacagtgttggagagatctatgtacaagtgagcttgtgctgtatactaagaatacgtggcagtaatttttcactgccaggcctttcctcttcaggtgcccaagggaaacactctgctgttcttagccatcttgcaaccagcatgcctttcatttctggagttgcaagatagtggctgcggtttttccacaccctttaaaggaattacaaaccaggttaagtccctattccaccagcctggttccttcctggttccattaacttattgatttattacggccccacagtgagttcaaaatattttgctatactaagagttatggatagtcacaaaagcttgagaaaaaggagaaaggatgtttgttggagttacccgtaaaggcatcatgaagaagctatagtcagacacttaaaggatgggtaggacttgaaaaggcggaatgtagggaagaggctgatgaggaatccacatatgcaaagttctgaaagcaagaatgagcagaccacttgggagatgggaggacatctggactggaactagactaaatgttgaaaacaatgaaagattcggcagagacaaatgatgaaatgttctgccagagtgaagcatttgggtttgatcagatagatcaggggttggtaaactacatcagcaagcaggccaaatctggcccaccccgttttttcgtaaataaagtattactggacagtcgtgcccacttgtttacaaacctttgtggctgcttttggacaagtagagttgagtagctgtcacagagaccttataactcacaaagcctttatagaaaatttgatcaaacaacaagacaatataaaatcctctaataaggaagagaactgaagttttattggagaccatttttcaaaatctgatatatttacaacttcctaaagctccaaagcaggtttagaaaacttcaatcgaaatattttctgggccgtgcgcggtggctcacatctgtaatcccagcactctaggaggccgaggcgggcggatcagaaggtcaggagttcaagaccagcctggccaacatggtgaaatcccatctctactacaaatacaaaaatttgctgggtatggtgacacatgcctgtaatccgcgctacctgggaggctgacgcaggagaatcatttgaatccaggaggcagaggttgcagtgagccaagactgcgccactgcattccagcctggcgatggagcgagactctgtctcaaaaaaaaaaaaaaaagaaatactttcctagtttgcagagactgtgccttaaggcataatttaggttgaaatgaatctcattgttgcgcttcagcagttttgcatcattatttgtttttctctggtgtgcctttgtttcctaatatttcacaaaccagttgggccaattatcttccacacaattaaaacagtttgtgccatccagctgtttctccttaatcttgggcactttacatgatgctgtttgccctcctcactaaagctctctcattctatggtgggggcactttcaaattaacattcccggcaaactttttgcagggtttaaatttttctgagcaatatcttctcccctatattgacagtccatgagcaccctcaggttcaataaagtgttccttatactcattttttatttcacacatgaacactcagcagaagaaacaggtaagattattatacctaggagagttgtacctaggggaaaaaatgtaacatttaagatgattgtcacatttaagagggtgtctagattcttggcatcttgaataaagaattggacaaaatgcacaaacaaagcaaggaaggaatgaagggatttattgaaaatgaaagtacacactccacagtgtgggagcaggtacgagcgtaggggctcaagggccccattacagaattttggggagtttaaataccctctagaggattctattggttacttcaggtatgccctatgcaaatagagaggatgaagtaaagatacaaagctatttacttggcctatgccctatggagaggatatttcctgtcctagctgaagtgggaattggccttatgttccctgcctctagaccctattttcctgcctcaatgattacaaaatgttccccctaaaaaaaactttcatttattgacatttgtgcccccagattcccacaccttcataatcaattaatgtttattgagatctttcttttttcttttttactttttttttcccccaagacggaatcttgctctgtcacccaggctggagtacagtggtatgatctcagctcactgcaacctctgcctcccaggttcaagcgattctcctgcctcagcctgctgagtagctgggattaaaggcgtgcaccaccatgcccagctaatttttgtagaaacggggtttcaccacgttggccaggatgatcttaaactgacctcaagtgatctgcccacctcggcctcccaaagtgctgggattacaggcatgagccaccgtgcctggcctaaaaaattattcatggaaccaggactccttagagaaatggttaactcaatgaactgattgaacatcccaaatccaaaagccaaaatgctccagtgagcttttcctttgagcttcatgtcagcacttacaaagcatcagcttttggaacatttcagattttcagattagtgattctcaacttgtatcaatcacttgatcttcctcgtcctttggtaaacaagccaaaggtcccatataggatgtctctgaatttcgccgaaaaactgggttgccaatgttgatggaaatgtgaaaagtgaatgggactttccaacatatagaagtatataatagcctgatatattggaaagagcactgggaaagacatcaaaagacacccaactatacttcacagttctgccactaactaatcacttaattgctttaggctaaatttgttttggttttttaaaaatatgtaaaataaaagttatatactgtattatctccaagaacttttttttttttttttaaacaaagtctgtctctgtcacccaggctggagtgcagtggcatgatcatggctcactgcagctttgacttactgggctcaagcaattctccccacctcagcctccagactagctgggaccacaagcatgtgccaccacgtctggctaatttatttattaattgtagaggcaggtctcattatgttgcccaggctggtctcaaagtcatggcctcaagtaattctcccactttggcctcccaaagtgctcaaattataggtgtgagccactgagccctaccagagctcttctaataataaagttctgtgaagtagaaatgaagataaaattggaaatgttttgcctagccaaagtccctatgcccaacatggtcatatgtgctcaaggatagacaataaaaagtatttagagtgcttatctatcttatttatccatagagagtgaacaaagcctccctggcttaggaatatctcctctggtgtctggagagctcctggagctatgaaggaaatggcaccaggagctccagaagactcaggaaagctttcaaatccaatgggatgactatacaggtcagtaaaagaaaaagtacagaggaaagaaaatccttttgtgtgtatcacattctgtgctaattactttatataactatctcatttactctttgcttatgatgtaggtttactgttcccattttaaaaacactttttgcatcaatgagaaactgaggctctcagagtttaaatgatttggaagtctgtgcactgtccatattccattccatctctgtccagagagtcaaattctttcatgaaatatttctaccccttctgcagaaccttctctgaccattctggcccacaatgacttcttcttctgagcttctctagtgcttattacctgtaccaccaatttcacagctgtaactctttggaacgttgcttatatttgatttatatatcaatcagtaagcatttattgaacaaccaccatagaccccctaggcagtggggatacacaggtgaataagacacagcccttgaactcaggagttaaaatctaatagaggaaacaacaccactggtagtgaataaacaccctgggctgggcacagtggctcacgcctgtaatcccagcactttgggaggccaaggcaggcagatcacctgaggtcagcagttggagagcagcctcgccaatatggtgaaaccccgtttctactaaaaataaaaaaattagccagatgtggtggcgggtgcctggaatcccagctacttggggtgctgaggcatgagaatcgcttgaacccgggaggctgaggttgcagtgagccgagatcatgctattgtactccagcctaggcgacaatagctaaactctgtctcaaacaacaacaacaaaaaaaaaacagtttataaacaccccaatccattctaagagtaaatcactttctctacttctctctcccctagtttggaacacttacatttcagctctcattatcataccaataagcctgaaagtagcaaaaccaagccttcagggaaaaggaaaaggagaattttaactaatgaactactgcagcaaataccctataagccccaaggacaaaacacagcagaggtaacaactgtgttgttaccttaagttgacttaaaacttaaattctcctaagggacagtgcttttcccaggcaaagcaggcagacgggtttccgccaaagtctcagccctgtggcaatatacaatggcgggtggggccaggcatggtcgggggacagaggcaggaagaggattacttgaggccagaagttcaaagaccagtctgggcaacaaaatgagaccccatctctactaaaaaaatgaagagaaaaagaaaataatggctggtggcacactgttgtcttaacccactccatggagggaatcagtgaggaagagtctcactttctggtaactagggatggctttaggaataaaactatctattccagcccttattctaaccagctatcctactaacaacacattcctaagctagtcttccaatgcaatgataactttctaaaagataatgaaagcccatagataaaagttatatgaacaaagcccggtatatagaaaagatagtgctcggccgggcgcggtggctcacgcctgtaatcccagcactttgggaggccgaggcgggcggatcaggaggtcaggagatcgagaccatcctggctaacacggtgaaaccccgtctctactaaaaatacaaaaaattagccgggcgtggtagcgggcgcctgtagtcccagctactcgagaggctgaggcaggagaatggcgtgaacctgggaggcggagcttgcagtgagccgagatcgcgccactgcactccagcctgggcgacagagcgagactccgtctcaaaaaaaaaaaaaaaaaaagatagtgctcagctttggtttcttctcggttcttttggtcagtccggatcttgctcatcaacaattttaagttccattttttccttcagtttcatgtcctttgatactgaatcaattcaatttgatttaatgaacaacttcaacatgcaaagcaatatgtacttaagagaataaacgtgaagaagagacgattcctgcttcaaaagttgatagtcacgtaaattattatccataatatagatctggaaatgtcatgttcttgtgacaactacttatgctcttaagagccgtatataaaagccatgtatatatgtggctgagcttattccaccccatactgtaagattaaaatcattgccatcttcaaggttctgggctgggctatgttaacaaggagttctggtcgtgcctactgagagacttgtcccagaaatgaacattgcaagcattcttgaagtcaaagaatcacttggtcttatcattacaacctaggatttgaggaagagaaacaccaatccctgtgactatctacagtatccaccccacgtcctttctagagttgcccgagtaatatattcttcaacccaagcctcatcctgtctactaagcaagaggtaaggcaggtaaacagatttcctctaaaatgtagagggtagaattaagggaagtgaaattcattgagcatctaccatgtactatacatatcgtagcttgtttaaagctcacattagcactgtagagtaagtctcattgcccgcattttacatcttaggaaagtgaggccaaaagaggttaaataacttgtctgaggtcacggctagtaagtggcaaagccatgattcaggcttggagattggtagcagatggagttctagttcagaaaattttttggatgctggctctaccagagctttaacacggctaaaagacatttcagattatcaaagtgctccaaagccatgggcaggaggcccccacacagcaagctctactccagggaacttcagactctgcctgaaattcagttgcaccaaatgcctttagtctccacaatttaatttttgcaccgtaatttcaggctgctcctgattagaaatgtgatagctcaggtgccataagcaaaagaactcacaccaaggaaacccttgctgagttgtcagcaccctgggtggtaggagtcctgagagacagaaggtcatggagcaggaaaatatagagtcctcttagacatgaaagcactgaagatctgggaagccaggcagagtggtcagagggatcgccccacagctggaagtcattaatagtccggggttgcataaaaagcaatgtgaagggagtgaacagctttggtcaggctaccaaagtcgctggtagcctggaccctgagttcaccgatccttcctactcagtaatatctacaggtaagtccaaagggaaattgctttgggaatctgacaatttaactctgctctgctgatacaaggatgtcatcaccaaagctggaaagaaaatgggccactgatggtgacatgatttaataatgaggccagttctcatttttctattgggagcttggtaagaattctctagacagtagacaatccacaattcacttatatttgactttggaatttggggtagctttggcagcagtaggttgtttttgttttgttttgttttgtttttgtttttgagatggagtctcgctctgttgccaggctggagtgcagtggtgcgatcttggctcactgcaaccttcacctcctgggttcaagcgattctcctgcctcagcctcctgagtagctgggactacaggtgcgtgccaccacacctggtggcacctagtatttttactagagacggggtttcaccgtgttacccaggatggtctcgatctcctgacctcatgatccgaagcagtaggatttaacttcctgattatgtttaacttgggttgaaaactgaaataattagtagtctttgggaatgccctgattgatcaatgaggcacaaaggagaaccaatcaatcagtcacttagaacttgccatcagtgatccacaaaggggtgtgagagtcataaataaataattctggtggtagtcctaaattggttcttttttttgtatttggtcatagcactaaactaggctgggaagaaagattctcggggcagaattctgaaatctttgccttagctgtgtaactgttcagagaggaatttcttttcaacttgtcttttcctttggcctctaaagttcttctcagagaaaaaatcaatcccctgctccaggctagggccaagtgtgtaaggtttgtcagtttaatctctgtccacaagcctaatcactttaagctggcctgtcctggggctgagaatctactgacggtgttttcgtctttctcttaggaggatcgtgaatttcctaaactgtctttgagagactcagatattttattttataaatggcagtgacagatgttatgtatccattgctaatgttatctgtacaaaatcaagaagatatattacagtggatacaaacctagagtgccttttggatatggcaggtgaggagtgttccttgatggtttgttttcagttcagtgcaagacactcctgaagcacatcacttactataaatgacctttaagaggaaaagatactttggagttactctatcacttgaaaatggggcaggaccattacaagagtaaatatagttatttatgaaaagccagatctccaagtccaaaaggagagaaataactattattcatatagttcagtccttagaaccaattctcctctgctgtgtatggcatttccacatcttgtttagacttcaggctgagcctgtaattgtttggctgtgggaaatgagggagtgtatttcagaaaacccatcttcccctcgcacttccagggtcctattcagatcgacttgttctgctaccattttacccatacccagcatcccgatatttattgagcatatttatgtgtgccattctatcctagttcccaaaggggatacaaaaacgaaattatacgcaagatggtagagcatttacacaaaatcgtaaaggaggtgaagttggccagtttagttttttcagtttacttggggaactcattagcctgctttcagcccttttgtctccgaaagcttagaacatgtactgctggtggtatgtgagatggtttaagttaaacagaagatgactttaggcggtagatggacaagcataagattatcacatcatggaaaagtaatttcctttttaatttgctttcaagcctggattcatctagaagaaagtctcagtgggggttgatgtgtcattaacatattccaaaacttattcccttttaacatattcctttttaatcaagaaaatagacctcagaactggagtgctctcctggtaacagtagttatttagaatttattgacattgtattattaattttttctaggattatattctgtttatgaaaaatgacagtaacatgctataaattttccaatttacacgaatgtatttaagctttgaaaaagttattagttgatttaaagaaaaatattgagtaaataataatatagctgggttggagatatggttgaaatcctgacattgctattcaaatgactgaagtttgggagacacttctttcccccacccggagcccaaacaaaattactatttgtgacccattcctgccctctgctttacctaaaccaattcaggatcatgataatgaccaataatataataagaaccatacttctccctataagcattatgatagggctctgagatctttaacctaaagagtcattttaatggtagaaatttctaaaaagacaggataatatatttgtagtagatgaaactgtcacaataatgacactatcgagtgctgtcatttagactttttgagtattctctaattctcacaacgaccgtgaggcatttttcagatgagaaaactgaggttcagggaggttaaacaaaacctcaagcaataaggagcagagccacggtctggtgcctagaacttctggccatgtgggtagcttaactgctccccctaaggtttgttttcttttttttgagatggagttttgctcttgttgcccaggctggagtgcagtggcgtgatctcggctcaccgcaacctctacctcccgggttcaagtgattctcctgcctcagcctcctgagtagctgggattataggcatgcaccaccacgcccggctaattttgtatttttagtagagacggggtttctccatgttggtcaggctggtctcaaactcccaacctcatgtgatccgcccacctcggccacccaaagtgctgggattacaggcatgagccaccacacctggccctgctccccctaagtattaggcaaaccctggagaagccacacggatgaacagcctgaggaactcaagggagcatgtgaataggtgcacaataacacattataacacagggaaactctgaaatactatgggaggaagtacgttcagagtaggtgagaccaactgaaggaagtggggactctaccaaaggagtcacctcattgcatttatctctgccttgcattctacccctctgccttacagacctccttgtagggccaggtcaggcttcatgtctcccaccaaccccagtcactcagaaaggagcaagtactctggttgccatatttctgtctctggaaaggatgcctgtcttcccagttgggaagaccattcctcagctcggtccggtggactgctgcctgtaggacatgcagaggcaggcaggctgcatctgcttctggagataagctcccgctgcagagcttttgtcaggttggccactgtcccgcaacagcctttctaacccagcgccatggaccagctatgctcttcaccaatagcctaggcaagagcttcaagtgctcttaggagtcattccgtgtgatgctaacctggggcttcaagcctaccattgggaatcactatcccttgtgacactgtgtccaggccccacctcctgcctgtccgatagattggatttcttgcagtgttggcatcatcccagtcacacctcgttttaccaggtattttatagaacctcccagatgagaattaagataatgagtatgaaagataatgagtatgataatgagttgagaaattccaaagccccagaaaaatacataagatgatatcaccaaacctttccgcccactctagagtgtagtccttggaactcagcccttgtcactattcccattttccctgggtgatctcatctgttcccctggttttaattactacgtatatgataataacactcctatctgcatgtctagtttagatctctctcctgacctttagatttttattttgacagattcctagatatctatatttcagtgtattccacagatacttcagagtaaacagaactcacccccttcctcactaaggcttcctcttccttcggaattctgtatctcatcaaggtttctgatgagtctccaaagagctccagccggaagaaacacacacatcccatgcagtcttttctccataccaagtgcagagctgagctctggtgtggccaccgggaggcagtgcagacttgaggatgtgtttcgcagcaaggcttcaggagccccaatcctgagcaatcccagtcctgcatgcaacttctgcccagcttcctttcctctctttttcagggaatgtctttgtctgagtccaccattgactcaggctcctattgaattggtaagggagggactggaatggggcccaagtgcaaagctccttcacagagcagcatgcacccccatatgcacatatcctggaacactgcctgccttcagctcctgagaggcacagttcaacaaatcaagctggaggcttctttgagccaggaaacctaaaagactttaaaggaaagtgtggagcctggtgttaaacaggtattactttgttccctgacatacaggtggtggaaatgtcacatttctttaattttctaaattaaatacccttggcttccatccaacaatgagtagcaaatccaatcttggtcctttatcaggagcttacacatactggggggaagatgtctcttagatgagggtgcctgtcacccctggcgctctttgcccaaaacaattctacgaccctttctccaggtttctctatggcatgaagacctctgctgaggctcgggatcagcagtgcctttgcttacctccctgagcacactgtcatccccattgaaggccctctggtcccagcggtctgtgggaggcctggagcaggacctggccacaaaaggaggctgcagtgctcctcagcaccatgcctcaaagccaggctcaggaaattctcctctgccctcttctaattctacaaatccttcctcctctcagacaaaacagttttattgcctctaagactgggttaattttttaaaacaaaagcttgttgatttctttcttcgctttatttccttccctcccttccttccctccctctttctttccttccttcctctctctctctcttttttttttttttttttgacagagtttcactcttgctatccaggctggagagcaatggcacaatctcagctcactgcaacctctgcctcccaggttcaaacgattctcctgcttcagcctcctgagtagctgggattacaggtgcccaccaccatgcccagctaattttttctatttttaatagagacggggtttcaccatgttggccaggctggtctcaaatccctgacctcaggtaatccacctgcctcggcctcccagagtgttgggattacaggcgtgagccactgtgcctggcctgatttctttctttttttttcttttttggagatggagtttcgctcttgttgcccatggtgcaatggcccgatctcggctcaccacaacctctgcctcccagattcaagtgattcttctgcctcagcctcccaagttgctgggattacaggcatgagccaccaagcccaggtaattttgtatttttagtagagacggagtttctccatgttggctggtctcaagcccccgaccttaggtgatccacccaccttggcctcccaaagtgctgggattacaggcatgagccactgctcctggcctctttcttttttgaaacagcgtctcgctctcttgccgaagctggagtgcagtggtgtgatcatagctcactcctaggctcaagtgctcctcctgcctcaacctcctgagattatagacatgagccaccacacgcagctcaatttcttttctttgtttctttctctttttcctttccttttttttcttcttctttttttttttttcctgagatgagagaaagcctgatctccagaacaaaaagccctggttaccctttgggattgggagtgtggaggaagataggaatggtctattcttttgtgaagaacagaaatggcagacactacagaaaatcagtcaatttctcaaccaggttaccctccctgcactaaagtggtgcttacctcataccttgttgccaaagtttggggcctgcctcagattggtgatgcatcagattggaagtaagcagcaaacttggatcccccaagctttaaaacatttaaaaaaattttatggatacataatagttgcacattttataaggtgcatgtgatattttcatacatgcataaaatatataatgatcaactcaggataattgggatatccatcacctcaagcgtttatcattgtgttaggaatactccaactctacgcttttattttgaaatatgtaataaattattgttaactatagttgcccttttgtgctacccaacactagatcttattccttgtatctaactgtatttttgtacccattaaccaacccctctctttatctatctgtatagtcgacaacttccagcttctccagaagtggcaaataactttccaactgggtatccacacagaaatatgtgagcatgcttacatggcatgtgctgccccacctccccctgtgaggagcttggttacagctacagcatttctacaacctctttaaaccaactttgtagtatccggcagcaaagtatcattccctgacattcgagtcattgagtctctgaagacttggaaaagggataataagccaaatcattcaggaaccagggggtcccagagaggtatgtaataaatttcatccagatgttggaattggcctttttttcttccatctttttttttttccagttacattaaaaaccaaacacattgttgttatcttatcaagcaaggtgggaagaacattttttcctttatttctaggtaagcctgcacaaaggattgaaagggctaacagcatatgggtaatacaggatctgcattattggacatctgaattattggagagtactttgtacatgacagaattatccagataggtaaatggtgttgcaaacacttcaccaaaatccaactagagacctctaagttcattttaatgtacagcttccaaactgtttatctgcagtgtaggcagcccagtctgttttaaaatccttctaggaaactatggccgtgcaaatcagtccaacaaatagccaaatgtgcatgttactctgttagaaagggaaaagtagatgcaggcataagtgcaaatttttatctcatggcatccgaggaacctaaatgtctggacagctttgttgtgccatgtggctgacaaccaggttattagataactcacaaaactcttctccagcagcccagagtttcctgaggttacctcttcccatgggactagaatgaagaaaaaagaaaaacagatatccccaagctgcagccacatttaatgtcccctttaccccacaattgaactcctgctccctggaggaaaaccctaaataaatataccagtggcagcagagagggattatttttgatagtggctgctcctgactccaagctgtgggcactgaactagaaagcagtgctgagagagagaaccaggaataaatgacactgggaaatgggaaacccagagaagaaaaaaatcttactttcttcccctgaaaaagatgcactttgcaaggttcatcttttcatcttttaatctggtgagtctcgaaatttttagtctttagactacttaagcagaacaagagtctcacctatttactagattaaataaacaagcaagcaaacaaaaaacacccttgaggtgtttttgctgaatcccttgtgattatttatagctcctttcaaaaatatttgctttggtgcatttaaattttatttcaaatctgcagtggaaaatctgtttcaaaggaaaaaaaaaaaaaagaaagaaccacccaacacgcttgcatttcgactcagcccgctgaacgcctggaagaaattttgcagacccaccagagatccccagattccacttgtaaaaccattgatctaaaaactacgtcttgacttcagaacacttcttttgatctggaattatctattattgaccacagagagcagccactgacgatttcctggaacagggccctgtatagagagaggtgagctccagggagggaagaagaaatttctttcgctttctgagcgggtgctttggtacagtacaatatctatgctatagtaatatatctatgggcttgacttcttcttctcctcgttttcctctttctccatccccctccttcctcatctccttattttttttgtttatttgcttcttctatagtaaaactttctgaaagccaatgtgcctggatgatttttgcctggtacattctgctaattggagtttcagaatcacagtttcttgcttgggtgcagaattttcaaaagtgtttaagtgcctaaattattgttgtagttgctggccactgcccatgccttgtagacaggcagctgagaaggtaccagaaaaaaaaaaaaaggctgcaggtctgtacccttcactgtaccagaatgcagagccctactgagctgtaggaatgcagaaccctactgagctgctcctcatggaaggagcagccatgttgtactgagctgacaacacgggcaatggaaagagcaaacccagggcgtaaatggaaccaggccctggaagcgtttggttgggagtctcccaactgagctgagccctgagaataagatggttcctttggccaagtggctctgtgaaaatgaggaagaatctgatccacgatgaaggtaaggagtgcatctgtgtctcctctcctcaagccacagggatctcattaaggatcagggcacttacgctgatggcttcactttaggcacaaccctcagcaggagggccccatgcaaagataattaccaggaatggtgggcccattacagccctttgatttggtcactccaacatactgttagacagatgtaagaaagctgaccgacatttacctaaaagtgacaaattgcaggttgaaggatttggtttcagcctctggcaggttggggctttgaaaaaacagaatataccagactcttgctttggagctcttgcaaattcaagtacataaggacagatatagccaaaattgagacaattacctttttttttgttttgttttgtttgttttttttgctggagtagctcgagtgaggaacaattacttttaatagtctattttactgtccagcgcagtaacccccataacccccatatattgtaactggctctgggttggaaggcagtctgggaaagggcctgtttctgcttctttgagacagcctgcaggaaacttcaaagttaaaataacataaaacttgccatatcttggttccactatgagtgtttctcttccaagcacttctgcctatgggtaagcattctagcaaagatgccattacagtccggcacggagaaataaaaggagccaagagttgggcaaaagagataaggaaccagagccagaactctcattgaaaagggagatttcttttttttttttttttttttttttgagacggaatcccgctgtgtcgcccaggctggagtgcagtgacgtgatctcggctcactgcaagctctgcctcccgggttcacgccattctcctgcctcagcctcccgagtagctacaggcgcccgccaccacgcccagctaattttttgtatttttagtagagacggggtttcactgtgttagccaggatggtctcgatctcctgacctcatgatccacccgcctcggcctcccaaagtgctgggattacaggcgtgagccaccgcgcccggctgaaaaggaagatttcttatagaaaataggaaacaaaaagttcagatgtctgggaggagatgcgggcgggacgtcatctttgaaataaaaaagagtacgattcataggggaaatgtacacaaagagactgtgagttgagaaaaacctgacttgtgttggggagatttattcagattttgggaagaaattggaaagaactataaagctagagtctgtaattagttcccatacctgcgtagccggttctgaggggtgaagtactccctagagcccttagaggtctgcattttgctcacagggcagctgtcttgaggaaaaagatgaagaatgggagtgttatggagggcatacgcccctctgatcatcaccacaaaggtaggatccagctataaattgcctgctagagagtcaccagttccgtctccatctgttccccaaacttgtgcttatggatttgacattcaggtatttttcagaagaatcagcttgaagcaaaaatactgaacttaaacattctttttttttttttttttaaattcaaacccacaatttgaatcttgtttaaaagatggaaggatgagaagtgtgattctcttggcttgtttagaaatagccatagcaggtcgggtgcagtggctcacacctataatcccaacactttgggaggctgaggcaggtggatcacgaggtcaagagtttgagaccagcctggccaacatggtgaaaccctgtctctactaaaaatacaaaaattagccaggtgtgatggcgggtgcctactctagaggctgaggcaggagaattgctggaactcaggaggcgggggttgcggtgagcagagatcgtgccactgcactctagcctgggcagcagagcaagactccgtctcaaaaatagaaaaaaagaagtagctgtactagacgggatcccaggtcttacgcattttcactcttccttcgggttagcctcctctcaagtgccttcaggacttgttcaatacagtcagtaattgggcttttagaaagaggaaaagtatttatgtaaaattgcctccttatgtcctgtagctacaccccgtgtgcatccagggaagtgtacgcagtgaccactgagtgggtatccgcttatttcatggtagaactgacttaaagcagatacctagtccttggcatttctataagttagggacaaatttctcatcctcagcattattataaattagggacacagagaaaaacttgctggctcctagtgaaggcattcattgcttggaacccagactccgcaaggtcatgcagcctgacaactggctgtagtgcaccaagctcataatcaggaattaagagaccagagtcaggcttgcatctgcgtataactacctgtgagactttaatctacatattgaccgcctcaggggttccatcttcctatgaatcaaatgggaaaacaaagactcacctcctctactagcaagaattcttgtagataccatgacaggttaaaagtatttgccacagctggggaagagagaatggggtcagacccttgatgttgtggtagctgacttttttacttgattgcttaatttttttttttttttttttgagacggagtctcactctgccactcaggctggagtgcagtggcgtgatctcaactcactgcaacctccacctccaggatctgcttctgcatttcctcaatggtaaataaattcaagcgattctcatgcctcagtctcccaagtagctgggactacagctacatgccaccacacccagctaatttttgtatttttagtagagacggggtttcaccatgttggccaggctgggcttgaactcctgacctcaggtgatctgccgacatcaggctcccaaactgctaggattacaggcgtgagccaccgagcccggtcattgcttaacgttttaaatcctcatcttccattttcctgggctcctaaatggcctggatacacttttattttcttttttatgtatttatgtatgtatgtatttatttatttttcagagacaggatctccctctgtcacccaggctggagtgcagtggtgtgatcatccttcactgcagccttgaactcctgggctcaagtgatcctccccctcaggttcccaagtagctaggattacaggcacataccaccatgcccagctaatttttaaattttttgtagagatagggtcttgctgtgttgcccaggctggtctctaacttcaagtgaacctcccacctcaacctcccaaagtgctgggattacaggtctgagccaccatgcctagccccttattttcttgtaagtttttattgatttaaaatacagttacagaaaagtgttcatatcgatgaattttcactatgtgaacactcccagaaaactagaatctagatctagaaacagagcattaccagcacccagaagcctcctcattcccccttcaagtccctttttcttaccaaagttagtcactaccctgacttctaacaccatacattaaattttgcctgtttgggggctttatatgtgtgtgtaggtgtttttatgcgtggcttctttcgcttaatattaagtttgtgagattcatttatgttgtatatggtaatattttatttgttctcattattgtgtggtattacatgaataccacaatttgtttatccatttgtttatccataatttatttatctacaatttacatggataaatgccacagtttatttatccattgtcttattgatggacacatggagtgtttgcagttgggggctattactgaacagaagcattaggaacatctgtgaatactttttttttttaaagaacatatgagtgcatttctatctagaagtagaattgctgaatcataggacatgtgtgttccgcttttacagatattgtcagttttccaaaatgattgtatcattttacactcccaccagcaatgtctgagatttgttttttcttacatcctcatcagtggttggtattgtctgtcttttacgtttagccattttgatgggtgtatagtggaatgcttctttattttaatttttattccttgaagactaatgacgtttagcacctttttacatatttattggccttttgactatcctgttttgagaaatatctgttcagattttgaacccatttctctactaggttgtctgacatttttattgacctataagagttctttaaatatagatatgagccctttgttgtgtacatgttgcaaatatcatctcccacaaggctatgtggagtcacactggagcttcaggcaaaagaaaaaataaaaatcctgattcctgtctttattttagattttgatattttgttcaccatggatttttttgcattaaatttgattttttaaaatattgcatcaaatgtttatttctcctgattactgagttttttgtcacccccgtaaagaactgtatccaaggcaagagcctcacttgcctcaccccaatcctggcccatcccattctgtgtcttgcattgtcatgctctttaatatatattgttatttgttgaaaagcagtttctaatctaatgaagtccaaatgttcaagcttttcttttaagattagtgccttttcatttggatcacatttatacagttataaaaataaagatttgattttggtcattcttcagatgtttggctctgaatgacttaagctgaagtaactggttcctttttttaaatgttgtgccatcatttcacccgatgagcatttcttggagcctgctagatagtgttaggtcctcaggctgtaaagaggtcttcaacaggatgtaaagcaaacttaattgtaattactttattctgccgattaagaaatacagtactaaagttttatctctagtccctcaaattggcatccctcaaattggcatctggtaatgtacattgtggggtagactgataatcaaatgacagtgcaacatcttaccaagaagtaaatatgatctgagtgtcctataaataatgtaagagcaggttttcaaacttggagagctgttttctcatttcatgtacacttgccccaaattgtagtttttgaagtcatgtgcattgcacgttggatgagccagggaaattattacattaacaagcattttgtgtgtatgtagtagttactttgtactgagagaacttgctttggggtgcaattaaacaataaactgattttatttgggagaaacagggaagggtgcacttactagcaacctaagaataatttttcagcttttgcccttaaggtttaaattacaattccaaaatgttagacatactgtatctttttgttcagtgtggctttaattttcccccctatggtttgttctttaatgccttttacatttggacacatagtttatgctttttagattttggttgctatcttgccaaaataagtgttagctgtgtttcaaacttgattttctttctttctttctttctttccttccttccttccttccttccttccttccttccttccttccttccttctttctttctttctttctttctttctttctttctttctttcttttttttcctccagaatgtcttatttaaaaagaaagctaaaagtatacttctaagttagagcctctatttttgtataacacttgggatattttttacttcacattgaatatagacaggcacccaagaagtctgatggccaccggagtgcgggtgacaaggacctgacagagcccatgcagggctttagatttggacacacaagagttgataacttccttatgaactccttgcctgatctaaactcaatatggattctgactgtgtttgagtaaaggttaaacctgttggcagttactgcttttcacaaagtgcacagtggaaatcgagaattgatagggttaattttggagcagtggcttataccattcacctctttgtttttttgtgacttatctcacagataatgagaccttaataacaaacaggtgtaaaaaaatttcacattgaaatgatacaaacatttgatgtaataaaaccttgttggcttgatattttaaggaactgaaatctagcaatcttactggagagacaagaattggtctccagctgcctttgatagattcgggtgcgagtggagccggagccatatacctggagggaatgtggtttgtcacaccaaagaggattttttttcttcaaacttgcatgttgcctaggtttcaaattctttgccgcaaggctgatttgctttcactaactggaattttgtaggagatactggtgacctaagctaagttgcattcaacatactcagtgtcaagctaatgaggttctgttataaagcttctacttttaatctgagagaaaacatgttcagggcttctagaacactaaaaattttgacttagaacagtgttcagtctggtgccaaacttccaatggaattcaaattcacataatctgaactttgttcacaggttatcctaatagagtaattcttcattttgttctattgaactgtcttaaggatttgtttcaaacagctaagttacttgattaaaataatgataaaattgtaaaaaaaaaaaaaaagattagtgcctttttaaaatcccttataacaaattttgttttacccagtcttaaagatattctatcttatatcttctagaacagcaagcactgtccacttgaactttctgcaataatggaaatattcgatacctgcattgtccaacatgtagccactgaatggctactgagcgcttgaaatagcactagccacatatggctattgagcaattgaaatactacatatggtctacggccataccaccctgaaatattttacagatattgtcagttttccaaaatgattgtgtcaatcttgtctgaaacagtacatatgatgaaatgaattttaaattttatttacttttaaataatttaaatgaattgtggtgaatggcaatgtagttctggcaatgttgttccacctggaattgattttcaggtatgatgtgaggtcaagtttcccttttttttctgtatggatattcaatcaatccagcatcatgtaccgaaaacactattaatttcccacttttattattaatccattgtctatctaatatgtgtgtgttgttctggaatctccattcttttccatttgtccattagtctgtctttctgccacttgcaccctgtttccatttcctgtaactttgcaataagttttgatatttggtagaataagtccttcatgcctctcatcttccccaagattgccttggctattcttttttttttttttttttttttttcgagatggagtcttgctctgttgcccaggctggagtgcagcggcatgatctcggctcactgcaagctccgcctcccaggttcacgccattctcctgcctcagcctcccgagtagctgggaccacaggcgcccgccactacgcccggctaattttttgtatttttagtagcgacggggtttcaccgcgttagccaggatggtgtcaatctcctgacctcatgatctgcctgcctcggcctcccaaagtgctgggattacaggcgtgagccttggctattcttgaacttctatatttccacataaactttaggataactttataaattctaccaaaaaaaaccctgctggaatttttattgggattacattaaatctgtccatcaattaatatgaaagtctttacaatattaaatttttttatccatgaatatggtatatcccttcactagttgaagtcttattaaaattttttgatgttttatagttttctatgtagaaacctggtatattattcattggatttattcccaattattttctatttattttataagtggcatatatatatgtatattatatatatattttttgagacacggtttcactctgtcactcaagctggagtgcagtggcatgattttggcacactgcaacctctgcctcctgggttcaagtgattctcatgcctcagcctcccaaggagctgggattacaggcacctgccaccacacgtggctaatctttgcattattgtagagacagggtttcgccacgttggcctggctggtctcgaacgcctaacttcaagtgatcctcccacctcggcctcccaaagtgctgagattacaggcatgagccaatgcacccagccttataagtggcgtattttaattttatttatttatttattttttgagatggagtttcgctcttttttgcccaggctggagtgcaatggcacgatcctgcctcactgcaacctctgcctcctaggttcaagcaattttcctgccttagcctcccaagtagctgggattacaggcacacgccaccatacccggctaattttgtatttttagtagagatggggttgtttcaccatgttggccaggctggtctcgaactcctgacctcaggtgatccacctgccttggcctcaaagttctgggattacaggcgtgagccaccacgcccggccataaatggcatattttaatgttcatttttagttgtttgatgctggcatattgacataataattaaaattttgtatttatacttgcatacagcaaccctgcttaattaacttaataattcttatagtttatttatagattcacaatcatgtagtatgtgtagtgtgtgtagtgatttctttcagatagttatttttttaatttttttttttttttgagacggagttttgcacttgttgtccaggctggagtgcaatggtgcaatcttggctcgccgcaacctccgcctcgtgggttaaagcgattctcctgcctcagccttccgagtagctgggattataggcacacgccaccatgctggctaattttgtatttttagtaaaaatggggtttctccatgttggttaggctgatcttgaactcctgacctcaggtgatctacccactttggcctcccaaagtgctgggattacaggtgtgagccactgctcctggcccgttttttaacttctttttcttgaattattggactgggtaaaaccttaagaacaatgatgaataaaagtgaaaatagcaggcatccttatcttagttctgatagaaagaaagcactcaataatttcagttaaatatgatggttgctggagtttactttttgtagttactctttatcagattgaggaatttttcttctaattctagtttgatataatttttaaacattaacagatggtgaattttatgaaatgtatttttctcatcagttaaaatgagcctgtgatttttacactttattcattttatttattttctatttttatggataggtaatagttgtacaatttatgtggtacatgtgatactttgatacaagcatataatgtgtaatgatcaaatcaggataatggaatatccatcacctcaagcatttatcatttatttgtgttgggaacattccaaatctactcttctagttattttgaaaggtacaataaattatacttaattatactcaccctattgtgctaccaagtacaagtgtgcctggaattggtgggttcttggtctcgctgacttcaagaatgaagccatggaccctcacggtgagtgttacagttcttaaagatggtgtgtccggagtttgttccttcagttgttcagatgtgtccggagtttcttccttctggtgggttcgtggtcttgccgacttcaggagtgaagctgcagaccttcacagtgagtgttacagctcttaaaggcatcacgtccagagctgttcattcctcccaatgggtttgtggtctcactggcttcaggagtgaagctgcagaccttcgtggtgagtgttacagctcatagaggcggcgcatccggagttgttcattcctcccgctgggctcgtggtctcgctggcttcaggagtgaagctgcagaccttctcggtgagtgttacagcttataaaggtagtgcagacccaaagggtgagcagcagcaagatttattgcgaagagcgaaagaacaaagcttccacagcgtggaaggggacccaaacgggttgctgctactggctctggttgcctgcttttattcccttatttggccccacccacatcctgtcgcttggtctattttacagagcgctgatttctccattttacagagcgctgattttgccgttttacagagtgctgattggtgcttttacaatcctttagctagacacagagtgttgattggtgcatttacaatactttagctagacaaaaaagttctccaagtccccacccaattagctagacacagagcgctgattggtgcatttacaaacctttagctagacacagagtgctgattggtgcatttacaatcctttagctagacagaaaagttctccaagtccccacccaacccagaagcccagccagcttcacctctcacaaggtcttatttcttctattctaattgtattttgttttgttttgatttttgagacagagtcttgctctgtcacccaggctggagtgcagtggcaccatctcacctcactgcaacctctgcctcccaggttcaagcaattctcctgcctcagtctcccaagtagctgggactacaggtgcccgcctctataccaagataatttttttttgtatttttagtagagacggggtttcactatgttggccggactggtcttgaactcctggcctcaagtgatctgcctgcctcagcctcccaaagtctgggattgcaggcatgagctaccacgcccggcctcgaattgtatttttgtattcattaaccaaccctactttatatcttcctccctactacccttcccaccttctcaaaaacaccattccattcactacctttctgatatcgatttttttaactccacgtgagtaagaatatgtgacatttatctttctgtgtttgccttatctaacttaatgatgacctccagttccatctatattgttgcaaatgacagaatttcattcttttttatggcagaataatattccactgtatacatataccacttttttgtttttgtttttgtttttgttttttgagacaaagtctcgctctgtcacctaggctggagtgcagtggtgcaatcttggctcactgcaatctccgcctcctgggttcaagcaattcttttgcctcagcctcaagagtagctgggactacaggtgcaagccaccacgcctggctaatttttgtatctttagtaaagacaggatttcactacattggccaggctggtctcaaacttctcctgacctcgtgatccacctgcctcgacctcacaaagtgctgggattagccaccatgcctggcccatataccacgttttttaaatccattcatttgttgatggacagttaggttgatttcatatcttcgttattgtgaatagggctgcaataaacatgggagtgcagatatttttttgatacactgaattcctttcttttggaaatatacctatcagtgagattgctggatcatatggtagttctatttttagttttttgaggaatctctatattgttttccatagtgactgtattaatttatattcccgttaacagaatacaagcatccccctttctctgcatccttaccagcatttgttatttttttaaatttcttttccttcttcccaaacattactgctgatattttctatcttttctgataatagccattttaactggagatgagatgaaatctcactgtggttttgatttgtatttccctgatgattagtgatattgactatttactcatatgcctgttggccctttgtatgccttcttttgagaaatgcctgttcatttttaaattggatttttttaaaccagtgagttgagttccttacatattctggttattaatcccttgtcagttgactagtgtgtattaatattttcccattctgtaggttatctcttcactttatggattgtttcctttgctgtgcaggtttttgccttgatattatcgcatttgtccatttttgctttggttgcttgtgcttttgaggtcttactcaagaaatctttgccaggaccaacatcctcaagcatttccacaatgttttcttctagtggtttcatagtttcagttcttacacttaagtctttaatccattttgatttgatttttgtatatggtgagaaatgggggtatagtttaattcttcttcatatggatatccagtttttccagcaccatttatttatttatttatttatttatttatttatttatttgagatggagtctcactctgttgcccaggctggagtgcagtggcacgatctgggctcactgcaagctccgccttccaggttcatgccattctcctgcctcagcctcctgagtagctgggactacaggcgcccaccaccacgcctggctgattttttgtatttttagtagagaccgggtttcaccatggtctcgctctcctgacctcgtgatccacccgcctcggctttccaaagtgctgagattacaggtgtgagccaccacacccggcctccagcaccatttattaaagagttgactgtaaatgtatagatttgtttccgggttttctattctgttccattggtctatgtatctgtttttatgctagtgccatgctgtttgggttactatagctttgtagtataacttgaaatcaggtatgtgatgcctacggcttttttctgtttgatcaggatagctttggctattctgggtcttttgctgttccatataaattttaggacttttaaaaatatttttgtgaagaatgtcattggtatttttttgtttgttttcttttgtttttgagacacagtctccctctgtcacccaggctggagtgcagtggtgtgatcacggcacactgaagcctctacctcctgggcccaattaatccttctgcctcagcctcctgagtagctgggattacaggtgtgcaccactactcctggttaatttttttattttttgaagagacagggtcttactgtgtgcctcggttgactcaaactcctgggctcaagtgatcctcccaccttggcctctcaaagtgctaggattatacacatgagcgatacacagcacctggccttcactggtgtgtagataaggactgcattgaatctgtaaatcactttaagtagtatggacattttaacaatattgattcttccaatctatgaacatgagatggctttccattttttggtgacctcttcaatttcttgaatcaatgttttatagttttcattgtagagatctttcacttctttggtcgtttatgcctaagtatttttttctgtagctatcgtaaatgagactgctttgtgttctttctcaaattgttcacagttgaaatatagaaattctataatactaatttttgtatgttgattgtgtatcctgctacttaatttgtttatcagttccaatagggttttggtggagtctttagcttttctaaacataagatcatagtgtctgcaaccaaggacagtttggacagtttcctttccaatttggatgccctttgtttctttcttttgtatagttgctctggctaggacttgtagtactgatgatagcagtggtccatctggagcagctgctgccatcactccagctgcacattgcacagagctggtgggagccggcaacaagtgggagccctaccccttccaagttggtggggtgggagctctctgggtgcagctacagctgcccaagtcatggctgcagactcaggcctcccactccacggagcaggcaggaggcctaccctcacgggtgcagctacagctgcccaagttgtggctactgacctgggccttcctgtgctcttgggtggtccaggagcaggcaggaaccccaccctcctggatgcagctacagccacccaagtcacagctgcagagccaggcatctctgcactcttggcagcctgggaagacccccctgtacccccaaccaggctcagagaagtctgctcccactgcctggcctctccctgctcccagcacccactccaatcttggagtaaggttggggctgggcccaggcactgtcacaacccagccgtgtgtgcatacacttggggcagtgttgacatgacagtcccctgctgccttgggcccctctggatttggggcaccaacgagaatgggagggaagctaaggaggggccgagggcagcttggcattggcctgcaggtgtcccttggcatgataacctgggtgcgatggacagcagtgggaggcagacaggctcctgggtagaagggagggcctgaaggctgggagtctggctgccagtcccacagaccagagtgggaaatagtggtgccttttcccagcccacccatggctgcccatggaccaatcagtgtgcacttcctcccttttgaggcccataagagcccccaattcagccagagctgagcagattttgggacaacctgctacagagaggagctgcccactccagggcctcctctgagctattttgtcactcagtaaagcttctcttcaccttgctcaccctccatttgtctgcacacctcattcttcctggacgcaggacaagaactcgggacctaccaaatggtgggactaaaagaggtgtaacacaaacagggctgaaacgtcccttgctcaccacgttgagggtgaagagaaggatagaagagctgtggccctttggggagcccagacctgggagttccctgagccagggctatgactccgtctttggggccctgtgactcctggagtctccaagcttctgggagccaccacattccccagtggcaggtgtggaagctgcttgcagtgtgtctggtccagttgcagcctcacagagagtcagcacccacgtcagcacctggagctgcctgccccacagcagctgacatgcttgactgtgcgcagtggccagacccccatgcttgctcactcacacacctgctgccactccatgcctggcttgcctttggcaggcatgggatccaggccagtagtgtggaccaagcacaacctgccaggctgagtgggcagaataagaccagcgggcctgagcaaaactcaggcaaaggtgccaccagccacagaggtttccagccagaaaagtgacaccccgaggatcctgcaacagtactaggttgaataaaagtggtgaaagcagtcatccttgtcttgttccagatgttagatgaaaggctttcagtttttccccatttagcatgctgttagctgtggggaccttattcattttatgatgaaccacagtgactgatttttttgaatgataacttaatcttgtattcctggaataaaccctatttggtcatggagtattagtccttttatatatttctagtttgggtacgctaatattttggttaagatttttacatgtatattatttttaaaatttgatatgtaatttttctcttgtagtgttctctctcttttttaaagagacaggtcttgctctgtcatccaggctggagtacagtagcttagtggcttgattatagctcactgcaaccttgaactcctgaacttaagcaatcctgctgcctctgcctcccaggtacctaggactgcaggagcatgccaccatgcctggctcgatttttatttaatgttttatagagacaggttctcactgttgttgcccaggctgatctcaaactcctgatcttaaatgatcctcccagtttggccttcctcaaatgatcctcccacttcggcctcccaaagtgccagaattataggcatgagccaccgtgcccggcctcattgccatatattttaattttatatatactttaaattctacaaaatgttgttgttattgttgtcagtgctgttgttttatacaattggcatttgttaagatttacccactgttgttaacttaatgttgttctatatttcttctttcagttttgtgcttccattgagattactttctttctgcctgaaaaataccatttagaatgtcttttaatatgggtctacgggtgacaaatttttctcaggtattatttgtctgaaattgtctttatttccaccttcatttacgaaaaaatgtttttgctgaatgtagaatcccaacttagttattttctttcattttgaagatatcattccattgttttctgagttatgttgtttcctttgagaaattagcagtcagtcttactttttgatcttttgcaagtaaactgacttttttcttgtgctactcctaagatttttctctgggtcgttagctttttatagatgtacagtcacatgcctaggtgtacatttatcctgcttgggctttgtggcatttcttgaatctgtaaccagataaagatatcaagtatataaagctttggtacattctcagtaattatcttctcaaatattgcttgtgtcccattttctctctcttatccttctaagattataactgcttactatgtcctatatgattttacattcttttctgtatttttcatcattttgtaactccatgttttagtctgtgtattttcttctgaattttctttcatttcaccaattctgctttaagctgagtctaatttattattaaactcacctaatagattactctttaaacttttatttgtaaataatttcataacgtaaagaaaagttacaagactagtaagaaaaattgcaacaactcccatacacccaatctctgattgttaatactttgtctcatttgctttattattttgtgcctgtgtgttcactctctttcttcaaatgtgcacacacattcatgcacacacacattttttacacataaaatttgagagtaaatttcatacatatacattatgacccttttctactaaatatttcattgtgaatttccaaagaataagaatattttcttaagtaaccatggtacagttatcactcctataaacttatttagtatattttaatattgatgcaatacattatctactgtctattttacaattttaacaattgacccaataatgtcttatatagtatttattttccttcagtacaatctcctttaatctggagcagttcctcagccattctttgtcttttatgacattgacatttttgaggaaaaaaaattcttcttttgtgtgatagaattattttaattttgagtttatctgatgttttcccacctgcccttgttaattttgatcactccattgagatatttccattctttacccttataactaataagcaatctgtaggggaaatactttaagaatgtgcatatatcttgcatctattgatgattcttacttgaatcaattcttactatgatggttgcaaaattaagattttccaactccagcactgcttttgagtgactgtaggacttaccagtcagcacttgacatactactataagcaagaagcctcctagaatgtttatccctccaaaagtcactttaaacttagttgccattgtaacagtatcaacaggtgagacttctaagaggtgattaggccatgaggactccacgcttgtgaatagacctaatgctgctatcattattgcaagggtgggttcacccttcttgctccttctcctccatcctttctttatccttctgccatgtgatgccttctaccatgttatgacacagcaaaaaaggccctcaccagatgccagcccttctatcttggacttgccagcctccagaactgtgaaccaataactttctttgcattataaattacccagtctgtggtatgcttttatagcagcacaaaacagtctaagacagaaagttaatgccagagagtggagtgttgctataaccaacacctgaaaaatgtgaaagtggctttggaattgagtcataggtagagactgagacagttttgaagtgaacactgaaaaagtctgtctctaaagcagcagactggtcattttcttctgcgggccagagtagcacttcaaaaattgcatgaagcaggggcatgaacatctgttgtaaaaacggggatacttgtaccttgaatttggccgtaatctggttgataagaggaatgaactcctggaggtcttttgcttcacaatctttgagtatatgttctgaagcagatgggatgaacggaaaaacttcttcctccaggcaaataatcattcgatgaaggaaagtacagactccacttctgagaatacccttttgtaagggacaactgagggccagcaagaatgtctgtaaacagtccagataaacttcggaacagccacactgtttcacagtctgcttgttgctgaaagctttactagttcgacttgcaaatccaacagcatggttgagacagtctgctagagaggcttgcctttcttcatcttgtgccagcatcaaattttctaacagaattttaaacttctccattagtggagtcaacagattcctcattaaggcttctttcctttctgccgggtattcattattaacaatcatcactccaactgtctcataaataaaatttgatcatcgctgctcaggaaggactggtggccattctcaggtggagaaagctttaataaatcttgtattctattcaaaatatcctcaatgaaaggattcatttgcttattgagagatttgacaaatctagaaaacaggtaagccatcttgctctgaacttttgcactggaatgacgcagacctctgtgatctaagaaagccattagtacacatggaacgtgctgaggttcaactgtgaaaaacttttcatatctaacaacagtttcgaagaactccaacgtcacagatgtatgctgataggaactgactcctgatgttaccagagttcgcatcataccctgcaaagcactagcttttgaaacatcacctgagaagtgagcaccatgagatagatactggaagagcttctgccaacatatacagcaatcttattgctacttcaacttccatgaaccgtgtagtctgccaattctgcagtgtagaactaaaaactctgcgaacagaggccagtagtaactctcgtgaaacttgagcaagcctgtccaacactaacttcagttgttttctatattctacaaacatggctttatcttgaccctcattttcaaagttatattcttcatcataagtcaattttttcataacggccaacatgattgcctccacattagctttttgctgatccgagagcactgtaagctgtttcaaaatatgaagataatcataacaaaatccaatattagaagaaatatcatcatcctcatgaattagtagctgcaacatcagtgccacttttgtttcaatagcttgtagtgcctcttgagcattcttaatattcccattcttagttaatttactccaactaactatccatgactgtcccattccgtttaccggcttagaaaatctggccaacatcttcttcctggtcaatgctgaaaagaagtcaacatcttcttcctggtcaatgctgaaaaagccagcagactgtaatacttgacacaaagattctactagtttcattttatcaacagggtccattcctttatttacaacttcaaataaacagtcacatgcttcttcccgtagaacttctattgacatatgacctagcagcatatttataaacctatcattggctaaaagggataagtcaatccaagagacataagccccaactacttcaaggcactgacacatcacttcagaattagtatactgataattttgtgatatttggtaccatgattccaccagatttggaatgcactgttccctcatggtatcttttatgagagtattcctgtgagcctcctctgatgtatgcaccacatcacgatccaccaactctgagttgatagccatgaggattcgcaggtacagatctactccccttggatttaggtccactactgagagaatgtcaaaaaaaaaacttgggccacttagtgagatattctgcaacaaaaagcaaggcgaggacttgggcggctttatttggtataaaggtcttctctggttggggattcagcatctgagcttgcagccatgatatgagcgtctccctaattagttgttgttgaacagtggttagttctgaatatttgtatttaacttgatgttccagtacttgaaagcagaaaaactttacatgatcatcactatatgtcctctgggctagagcttctgcacacacctgccaggcatctggggaaatctttaactgctcaaaataggccagggcccttagtctaaagtctgaatcagcatttggatttagccctaatagagcctgtttatccatccttgctgctatacttggagttttctggttataataggcttgccctctgatcccacagaagaatttataaacatcttccctatcactccagcccgcctcccagcctgaactccatggtcagccagcggaacggagccgagcggcgcagctcgcagagagctgggacagcggccctcgtccttgtcgccgtagtcctctgccacgaccgcagcgccaacgccagagacggagttggccgggactgcacgcctctcgtcgctccgcgtcccctggcaccttctcttgagtggcaggcaagcaagcaagcaagcgggcggggtcagcgccccaagaagggaaagagcgcgagggccagctaacgccgccgccgccgtcgccgctgagtcagcgcgaagcgccctctccgagtaggtgccgcgcgggcgggcgctggcgccagcagtctcatggagagtgcgggcggcagcccgcgggctggggccgtctcctgtctatttcttatttattcctttcaaaatggcgtcttatgataagcaaaaaaataaattttcttgaagtccaatattttatttttacttttatggttagtacattttatgttctacctatgaaatttccgtttactccatagtcacaaagatatacttctagaagttttatggttctagtttttaatgtaggtctatgatccatcttgaattaattttttgtatggaatgccataggggttagagctgtctttccatagagatacccagtttttttcacacatctgttaaacaggcattcctttgcctcactgaattgatctgatgccttggttgataatcagttgactatatatgtatagatctatttttggacttgatcctgttccattcatctgtatctgtctactctagctttgtggcaaatcttgaacttgtgagtataaatattctaaatttgttcttttttcaatattgttttgattattctaggtcctttgcatttccatataaattttagaaccatgttgtcaatttcttcaaaaaagcctgtggagctctggagacgatttgaggttctatatgatgttatctctctccagaagggtttacttttgtttctgtcaagcgaataggctagaggctgaaactttcatctagtaagtgtctgaggaagtcaaagctgggctttaatccttgtgagagctgatctctttccaatttgcccttatccctagagtggagcccttcatggtcccagctgaaagcctggagaggctgcgcgcggtggctcacgcctgtaatcccaacactttgagaggccaaggcaggtggatcacttgagcgcaggaattcaagaccagcctgggcaacatggcaaaaccccatctctacaaaaagtacaaaaattaaccgggcgtggtggtgggtgcctgtagtcccagttactccggaggctgacgcaggagaatcgcttgaacctgggaggcgcaggttgcagtgagccgacatctcgccactgcactccagcctgggggacagaatgagactccaactcaaaaaaagaaaaaaagaaaaagaaagcctggggatatttaccaggacccttcctccttttcaggtaccttactacaatttatgtctcatcagccctggctgggaatctactgaaagcttatttatgtatttatttatttattgagacggagtctcgctttgttgcccaggctggagtgcagtggcgcgatctcggctcactgcaacctccgcctcttgggttcacgccattctcctgcctcagcctcacgagtagctgggactgcaggcgcccaccaccacgcccggctaatttttttgtacttttagtagagacggggtttcaccgtgttagccaggatggtctcaatctcctgacctcgtgatccgcccgcctcggcctcccaaagtactgggattaacaggcgtgagccaccgcgcccagcccgctgaaagctcttttcagcctctcagcgctgcttttgcttttggaatcagcaattgtcttcagagtaaagtgtctccaaataccagtctcaccttacttggcttctctttttctccagatcttggactagcaaattctcactgcttttgtagctcttccatagctccaaattgctgtttttaaaaagtgctaatttgttcagcatttgtaattgttctcagcaagatgtttgaaaaagaccaactagtcagcctttgccagaaatggaactctatgacacacatttttagaaatataagttcattaagattaactttgttttggaagatacgttcagactttattaatgattttggagacaattgggaaattgcgagcatggaggtttggcttcagcattatgagggtaaaaaactcccacaaatcctcagattggaatgacagagcccacaagcaggatatgatatttggagctgttcactaaggctatttggtgtgccttgtacacctaccacttcttcaccactcccttctaaaaaggagagattgggaaaaatatagccttgttcattacttttatccagtcccactgaggcaaagtggcatcacccatttatcattttttattactgagcaatagcagcatgcaggtcttatagctggatacttctggggagcactcctcctatttgcttttagatatctgctcacccaccctagcttaatcccaggaatttttcacagtgctgtcatttaacagggggaatcaggctggtggagatggcagtagcaagggaaaaggagcatgtgtccttttcagcaatttttttttttttgagaccaggctggagtgcagtggcacgatgtctgctcactgcaagctccaccccctgggttcatgccattctcctgcctcagcctcctgggtagctgggactgcaggcgcccgccaccacgcccagctaatttttttgtatttttagtagagacggggtttcaccatgttagccaggatggtctcgatctcctgacctcgtgatcctcccacctcggcctcccaaaatgctggaatcacaggtgtgagccaccacgcctggccccttttcagcaattttaacgtaaccctctgaagtttctcaaactaaatgtgagaatagctggaaacctatggctcttgtatacagatgtacactataggcagttgtatagacttccaaacacatacacattacatgttcaaatgtatataaatatagactcaaagctcctagggaacaggtagtataagaaaaggaagcctaaccttaggctaaactagataatgtcatgtaatacactagactagacactatatggaaagaggtgatccaagtgatcctcttgaggaaggagagaatcaaggagtaaaaactaacttttgtggatgcttgttatgtgccaagtgtggtgcttaaacaccttttctatctttacacattcaatcatcataatgatcctgcagaataggtattgttatccccatttttaatttaatctcccaaaaggccacacccaagaccaggagctagtgtatttgcaaagccaagattcaaatctaattctgcctggctccaaaacttattctctgaaagtaggaaagagaggcagaagttcttatttaaacaattagactctgcaatagagtttccaagcaaaatataattaataaatttgtttactctttctctctcatagtggtcaacagcattaatctcagtgaataacactgtataagcacttactagaataaaagtgctcagttactaggttttgctgggcaagtgtaaggttgcttgtgggtggtgagaggaacagagcacagaaatgttaacattcacaaactttctgaacacctgagcactgagctgggaacccagaatataaagataaaaaatacaaaacatgtgctgggagcggtggctcacgcctgtaatcccagcactttgggaggccgaggcaggcggatcatgaggtcaggagattgagaccatcctggctaacacggtgaaaccccgtctctactaaaaatacaaaaaaattagctgggcgtggtggtgggtgcctgtagtcccagctactagggaggctgaggcaggagaatggcatgaacccgggaagcggagcttgcagtgagccgagatcgtgccactgcactccagcctgggcgacagagcgagactccatcttaaaaaaaaaaaatgaactttatcttccaaagtttacagtctagttacttcagagatggtttatgtgccatctacacgtgtagaactgacatacccataaaaggaacagataataaaaagactagtaagtctggaccttctctcatgaaactcaaagtctaagggggaatcagactaataaatgggcattttcaatacaagagattaagttaaaagtaagcacaggggccgggtgcagtggctcacgcctgtaatcccaacactttgggaggctgaggcaggctgatcacttgaacccaggagttcaagaccagcctgggcaacatgatgaaaccctgtctctacaaaaatacaaaaattagccgggtgtggtgcatgcacctttagtcccagctactcaggaggctgaggtgggaggatcgcttgaacccaggaggcagaggttgcagtgtgctgagatcatgccactgcactccagcctggatgacagggcgagaccttctctcaaaaaaaaaaaaaagaagtaagcacaaggtgtcatgagaccatggagagcaagcatttaactcaacacggggaatcagggaagcaggaaggaatgactcctgaactgacatagggaggcagaatgaattcatttgacatgcttagcacggaacactgacaatatacgtgttctgaacagaataatacagattatatggtaccatagaaagtcaatgactcatgattgatgtatttcctgaacaactaaagagtggttgctctcagactattaatcttcctttctcttccctatgcttttgtcactccgaaagcccattctctgttgtgtggatgtttttcttcctttcttctttccttctttttttttttttttttttttttcttcagtgaaggaggatgtcataagagctggagaaactgaggaggtcttcaagcagaatgtgggacttgaagaatttgtggaatataaaaagaggatgttgaaagggaaacaaatggcagggccaggcgcgatggctcacgcctgtaatcccagctttttgggaggctgaggcgggtggatcacgaggtcaggagatcgagaccatcctggctaacacggtgaaaccccatctctactaaaaatacagaaaattagccgggtgtggtggctggtgcctgtagtcccagctactggggaggctgaggcaggagaatggcgtgaacctgggaggcggagcttaaggtgagccgagatcgcgccactgcactccagcctgggcgacagagcgagactctgtctcaaaaaaagaaaaaaaaagaaaaagaaagggaaacaaatggcaaatgttgactcagtcagcttgcatttattgggccctaccctgcctctttttatcatgttccagggacactgagatgaatctgatccatgggttgaaatcagcaggatacgtatgtgggcaataaatggaaagcatatgtagcatagttagaagtaaagtctaataagcaaaatgggataggttataaagggcctggaaaacagacacatttagacttgatgtggatgataccaggagtccttttaggtttttgagcagaaagtaggtggaaaagattttagaaaaagaaaactggaaccatacagactaagaaggtgtgtgtgagcctaattctggcagtgaaggtctctagggcatagcggaaggaatagaaagaaaagagcaaaggacactgtaatgaagagattaggccagccacagtggctcacacctgtaatcccagcactttgggaggccgaggtgggtggattgcttgagctcaggagttcaagaccagtctgggcaacatggcaaaaccttgtccctacaaataatacaaaaattagccaggtgtggtggcatgtgcctgtagtcccagccacttgggaggctgaagtgggaggattgcttgatcctgggaggtagaggctgcagtgagccataattgtgccactgcactccagcctgggcaacagagtgagaccctatctcaaaaataaataaataaataaatataaagaaaagattgaccaggcatgtggatataaagaatctttagctgtaggataccagcttttgccatagaaaatacccagttacagctcatagaacctaaaagaatttgagttggcaatggtaggctacagggaggaaggataattaaaaaaaaaaaggctacagatggaggaggatgaggctgtaactgctatgatctacagcaaataagtagcccaggccttaggtgttttcatttgtggtttagggctccagagcttcttttgaataaccagtaaggacccatgactcagaatcattgcttcgagggccgtattgagcaactctgaaactagatgcagaacagatgtcgttgtagaagcctaacatgcagagaaacttgtaaaatatatatttttttcaggccctagattctaagatcctgctttgcagatctgaagtgggacccaggaatctttaacaagctctaaggtaatggtaatgcaaaagttactccctctccctctccctctccgtctccctctccctctccccacggtctccctctcatgcggagctgaagctggactgtactgctgccatctcggctcactgcaacctccctgcctgattctcctgcctcagcctgccgagtgcctgcaattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactacaacctacacctcccagccacctgccttggcctcccaaagtgccgagattgcagcctctgcccggccgccaccccgtctgggaagtgaggagtgtctctgcctggccgcccatcatctgggatgtgaggagcccctctgcctggctgcccagtctggaaagtgaggagcgtctcctcctggccgccatcccatctaggaagtgaggagcgcctcttcccagccgccatcacatctaggaagtgaggagcgtctctgcccggccgcccatcgtctgagatgtggggagcgcctctgccctgccgccccgtctgggatgtgaggagcgcctctgcccggccgagaccccgtctgggaggtgaggagcgtctctgcccagccgccccgtctgagaagtgaggagaccctctgcctggcaaccgccccgtctgagaagtgaggagcctctccgcccggcagccaccccatctgggaagtgaggagcgtctccgcccggcagccaccccgtccgggagggaggtggggggtcagcccccccgcccggccagccgtgccatccgggagggaggtgggggggtcagccccccgcctggccagccgtgccctccgggagggaggtgggggggtcagccccccgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattatcaataaaaaaataaattaaaaaaaaaaaagttactcaggagacccttttagaaatacttagggaaagataagctgtctccttgggatgactgggctggtgtctgtgcatatgccttctctggatccaagtgactttaccacaccaagccttaagactgccagactgttctctccattgaaagccattctgcaccactggccatacagaaggaatctcatattccaggagactggcccaaacaggactgttgagtggctctaaggcttttagacgtcaaaagggtttataagaataatcatcataatatagttatgaatcagaaacatgcatacattttcttaaatgaccctgtggggatgagttaaaaagggaggagtacccagatgcaggcgtctagcagaatggacttgcttgagaatatcaagcaagacagccaaagaggactcctaggattgtctcaccaggacttctgaggcgactctaatgaaatgacttaaaagtgtggtggagtggcttctgtggctcccacacctgcctaatcctggttgatattgcacaaccagggtgcactgacaatctctgggaaaaaagcaaggtctaatattcaaagcttggcaaacatgaccaagactttttctctttcctttgaattattttagttccctaattttttgtcccatatgccacttaattctttttattttgtattaaaagttgtgctcttgtctcaaccttctttctagattggatcctgcatgttttttttatcattatacttttggcagccctaccactaggcttcctgaaatatagcacctttgtttttgtttgtttgtttgtttgttttgagaccgagtttcgctctgtcacccaggctggagtgcaatggcacaatctcagctcactgcaacctctgcctcctgggttcaagcgattctcctacctcagcttcctgagtagctgggattacaggtgcgtgccaccacccccggctaatttttgtgtttttattgagacggggtttcaccatgttggtcagactggtctcaaactcctgatcccatgatctgcctgcctaggccttccaaagtgctgggattataggtgtgagccaccgcgccctgcctgcacctttgttatatagaaaattcttatcaacattattgtctacttttagactttattttgttctattgaactattctggttctagtaccatacattaaaattatagctttataatactttttaacatctgacaggatgtgctccccttatcatccttctttttcaatattttatcattctcacagtttttctcagatcaacttcacatgtaatttacaaaaaaaattaaaattacattggtatttaggtggaaattatgttaaatttatgtactaatctggagaagtcttgtttcgtaataataattcttaccatgaaggaaaatagcttctctctccgctgattcatgttttttctcatgtctctcagtagagtttatagctttttttgtataagttctcataattgcttgaatatattcctaattattttatttttgttgttttgggtgtgaatgagatttgtttttgttcatttttaatgggttcttgttggcatatacaaaaaccactgattttaaaatacttatgtaataactagatgtgcacctactttttttttttctttttttgaaacggagtcttgctgtgtcgcccaggctggagtgtagtggcgcagtcttggctcactgcagcttccacctcccaggttcaagcgattctcctgcctcagcctcctgagtagctgggattacaggcatgtgccaccacacccggctaatttttgtatttttagtagagacggggtttcaccatgttgggcaggctattcttgaactcctgacctcaggtaaggaggtcacccaccttggcttcccaaagtgctggaattacaggcgtgagccacacgctcagctgacgtgtacctactttagaacgtgtgtctcttatgtcagcttaccattattgtccatgtaatttgccattttaacagactaaaaaagaaaagctatatgacattttcaataaatacattaaaaagttgagaaaattcaacatttattctgatttttttttaacttttttattttgagatggagtctcgctgtgtcacccaggctggagtgcagtggcacgactttggctcactgcaacttctgcctcctgggttcaagcgattctcctgcctcagcctcccaggtagctgggactacaggtgcacaccacaaggcccggctaatttttatattttttagtagagacagggttttgccatgttggccagactggtctcaaactcctgacctcaagtgatccacccgcctcagcctcctaaagtgctaggattataggaatgagccactgcactcagcctgattttttaaaaagtcttaacaaactaataatagaaaggaacttcctcagtctgataaagctcatctacaaaaaatctacagctaacttacatacttaatttttttttatgttttatagagatggggtcttgctatgttgaccaggctggtcttgaactcctggcctcaagtgatcctcccatcttggcctccccaaaatgcttggattgcaggtgtgagccaccacacctggccccatacttgattaaagaccaaatgttttcttctacaataaggaacaaggcaaggatgtctgctctcacatcttctattgaactctctactggacattccagttaattcagtaaggcaagaacaaggaataaaaaacaataagcttggaaatgaaacagtaaaactatttatttgcaaaagacatgattgtttatgtaaaaaatccaatgaagtccttaaaaagtctgctagaactaataaatgagtttagcaagtttgaagcatacaagattaatatacagaaactagtttatttctatattgtagcaaagacaatacaaattgacgtgttaaaaaatgccatttataatggtaccaaaaatattaaatttttaatgataaatctgtgcaagactcatatactgaaaccataagacattaatgagagaaattaatacttaaataagtaaagagatataccaggctgggcacagtggctcacacctgtaatcctagtacttagggaggccgaggcaggcggatcacgaggtcaagagatcgagaccatcctggccaacatggtgaaaccccatctctactaaaaatacaaaaattagctgggcatgatggtgcacacctgcagtcccagctactcgggaggctaaggcaggagaatcacttgaacccaggaggtggaggttgcagtgagccgagattgtgccactgcactccagcctggtgacagagtgaggctccatctcaaaaaaaaaaaaaaaaagagatataccatattcgtggatcagaggactcaatattgttctgatgtcagttctccccaggtttatcaatagattcaacacaactccaatcaaactcccagtaggttttagtagaagttgacaagtttattctaaaattcatgtggaaatacaaaggacttagagtaatcacaacttcaaaaaagaacagtttgaagacttcactctccctgacttccagacttggagaataatcaaaacagtgtagtattgctataaagatagacaagtcagtagttcagaatagagagtctaggaatagactcacacatgtatggtcaagtgatttcccacaaggtacaaaatataatcttttcagcaaatggtactggaacagttagccatatgcaataaaatgaacttcaattcataacttcacaccatataaaaattaattcaaaatggactgtagacataaatgtaaaatctaacactatagaactttcttttttttttttttttttttttttttttttttttttttttttttttttttttttttttttcctgattaatttttatttattttttttattttttcctttggaaactactttattttttatttattttttttttgaacatatgtatttgtcaatatatttttggctgatgtgtttacacaggaaaaaataatatttacatactcaaacctcagttcaacattttaacaaaacaacatgcagaaaagtcttcacttcctttctaaatacaaatgctagaatgtcggaatcacacgtggatgttttgaaaagcgtgctgagcctcctcaagggtcatggagctgcacatgctacgacaccaaagcaactgggttttgttggttttgtggcagttgcttattaatatgtaatttacattcagtaaaatctgccttttattttttttttattttttatttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggctgggcagaggggctcctcacttcccagtaggggcggccgggcagaggcgcccctcacctcccggacggggcggctggccgggcggggggccgacacccccacctccctcccggacggggcggctggccgggcggggggccgacacccccacctccctcccggacggggcggctggccgggcggggggctgacccccacacctccctcccggacggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgaccccccaacctccctcccggacggggcggctggccgggcagaggggctcctcacttcccagtaggggcggccgggcagaggtgcccctcacctcccagacggggcggctggccgggcggagggctgacccccccacctccctcccggacggggcggctggccgggcggggggctgacccccccacctccctcccggacggggcggctggccgggcagaggggctcctcacttcccagtaggggtggccgggcagaggcgcccctcacctcccagacggggcggctggccaggcggagggctgacccccccacctccctcccggacggggcggctggccgggtggggggctgacccccccatctccctcccggacggggtggctggccgggctgaggggctcctcacttcccagtaggggcggccgggcagaggcacccctcacctcccggaaggggcggctggccgggcggggggccgacacccccacctccctcccggacggggcggctggccgggcggggggccgacacccccacctccctcccagacggggcggctggccgggcggggggctgacccccacacctccctcccggacggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgaccccccaacctccctcccggacggggcggctggccgggcagaggggctcctcacttcccagtaggggcggccgggcagaggcgcccctcacctcccagacggggcggctggccgggcggagggctgacccccccacctccctcccggacggggcggctggccgggcggggggctgacccccccacctccctcccggacggggcggctggccgggcagaggggctcctcacttcccagtaggggtggccaggcagaggcgcccctcacctcccagacggggcggctggccaggcggagggctgacccccccacctccctcccggacggggcggctggccgggtgggggggctgacccccccatctccctcccggacggggtggctggccgggctgaggggctcctcacttcccagtaggggcggccgggcagaggcacccctcacctcccggaaggggcggctggccgggcggggggctgacccccccacctccctcccggatggggcggctggcctggccggggctgacccccccgcacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggtctcggccgggcagaggcgctcctcatcttccagacggggtcgcggctgggcagaggcgctcctcacatcccagatggggcggcggggcagaggcgctccccacatctcagacgatgggcggccgggcagagacgctcctcacttcctagatgtgatggcggctgggaagaggcgctcctcactgcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagctagaactttcaaaagaaaacatagaagaaatcttttgtgactttgagttaagcaaagatttcttaaatatgacaagaaaagcacaatcaataacagaaacattaaattgggctttgtcgaaattaataacttctatcaaaggacactgttaagaacaatgaaaattcaatcctctgactgggagaaatatatacaaataacttatctgacaaagaacttgtatccagaatatagttttaaaaataagaaacactacccagttttttaaatgaacaaaagatttgaacagatactctaccaaaaaatatgcaaattgaaataagctcatacagatggaaataagctcattagggaaatacaaattatcactgcaatgagatactactatgtacctattagaatttctcaaattaaaaagactgaccataacaagtgttggcaaggacattgagtaatggaactctcatatatgtcaggggtaggatttgactttaccctacttataagccagtaagttagcttgttgtttcatgaattctaacagaagatatgagactcaggtcagagacaatgaactttattattcatcacacagcaagcagcatgagcattaacttttgcatcagctcttgctccctgagtccaacagggacaacacaaaggcccagatgaaggtctacacatgtggtaaatgtgttacatgacaatagcactgagtttggggaacccacattttatagaaagcagtaagtgagcttgctttttaacccagggagatattacttcacagctcaaagttgcttgctgcaaagacaatcctgagaaatggcctggctaaagagcagtcaataccttacattcttggtatactctataagatgaggaggagcataagagactcatggcagaatgtctctcaacagcatccaccgtcagttctacatcatcttgacttcttgagagattttcacttgagcatgccattctgtaggccactttgattaatctgattagtagaggttggaaccaaatccgtccaatttatctcatacagcatagaccactgtcaataaatccccaagcagcaagatgagacaaacctgcagtattgacctcagagtaccagattcaaccacctgtgaataagtctcaggaggatctgtaggtcttatttgagacatccagtatatagtttaaggccagtcgtaatcaccatacatagcataaccaaggccactcaggcatcaggagaagcacatgattttgtatgagtcagcttaaaacatagttgtgccagtctgtgtttgtacatgtatgtagatgtatgtccacctttgacagcaccaggcacagaaggcatagtgtcaggccatgtccacatgagtttctctgttttaatagcacatggactggtttgacaaacccagcagcagatgagattggcagcctgatgacagtgtgcctcaaacaaaccatgtaactatttgccaggttgcagtgctggatctaagggacatagagaacattaactgttccctacctctccacacttcctggagtttaacgtgttctccctccaggtactgggatcgttgttctccttccacagctacaaaatcagtgtgtcccaacccagtagctgtaacttcaccttttctccaattcttccccactcacaccaacatttttcatctggaagagtcaactgtgaatgggacaagagcttttttttttttttttttttttgatacagagtctcgctctgttgcccaggctggagtacaatggtgtgatctcagctcactgaaagctctgcctcctgggttcaccccattctcctgcctcagcctcccaagtagctgggactacaggcacccaccaccatgcccggctaattttttgtatttttagtagagatggggtttcactatgttagccaggatggtcttgatctcctgacctcatgatctgcccacctcggcctcccacagtgctgggattacaggtgtgagccaccgcgcccggcccacatggataaactttgaaaacattttgctaagtgaaggaagccagccacaaagactacatactgtaggatggttgcacaactctgtgaataaactaaaaaccttccaaagggtgaattttatgatatgtgaattacatctcaattaagctgttttttaattaaaagtttattccatctctcaatggtaccaccagtctgaagataatgaattggctaccaaatactttgactataagcccattgttgatgagtttttgcactaaaaaatgcagtattatcaccatccagaaagccaaaatcatgacacagattagtttcaagggccacaatgatgtggccacaattggctgatcagactagaacagcaaaaccattacctgagaaaaagtcaacaggaatgagataccagtggaatagcttggaagaggtcaaaggtctgatgtcaccaatttaccaggagccagtcaacactctgcagccagtcaacactcagtgcaatatggcctctttcaccatgagacaaataggctaacttttggcagaggtcacaaatctggcatgtagtggtagcttctgattcagaaacacagagtcccttactttgtgcccagttgatgatggtgtcaccatgtccaatgttatgatggatctaagtggcaactgtggccatctgagtggcacaagcttgatcaaaagcttgattctagttggtctcatcagagaatgagcccttaccatgcacaccacaacagtgatccagactgtttggtggctacaatttgtttccagggctcatgacccaaagtgaagtgcctttaatctgccagtctgtaatcttctaagtagcagacaagaccactagtgcctaagaatcagtaaaaatatagcataactagtcagtcctaagggaaaggtgatagcttttgttttagaccattgtgctaattgacccttaatgcagtaggtcttccagagttgtggttgaggccaggcatccagtgggcgctatcagctttctttctttctttttccttttctcttttcttttcttttctccttccttccttccttccttcctttctttcctttctttcttcctcactctgttgcccaagtgtatatgacggactgcatatatgacagtggtcctataaaccagcctgaccaacatggcgaaaccccatctctactaaaaatacaaaaattcgccgggcgtggtggcaggcgcctataatcccagctactcgggaggctgaggctgaggctgagccaggagaatcatttgaacccaggaggcagaggttgcagtgagccgagattgcgccactgtactccagcctgggtgacagagcgagactcagaaaaacaacaacaaaaacaacaacaaacagtttactgtaaaacagtatgtcatgttatacccacagtatcctcatatatttcatgtttaccgcatctcttgtttgcacattattttctctcgcatttgatttaatcttgtgttgtttttttcatcatagctcctaagggtacaaaatccatggctaatgttgccagtaagaggccacatcaagtgattgacctggaaatgaaatttaaagtaaaagtcagtgatgattattgctcaccagtcaggcatatcccattccaccatagctaccatcttgaagagcaagagcaaagtgaccgaagctgttaaataatctgcttcagccgggcgcagtggctcacgcctgtaatcccagcactttgagaggccgaggtgggcagatcatgaagtcaggagtttgagaccagcctgatcaacattgtgaaaccccgtctctactaaaaatacaaaaattagccaggcgaggtggcaggcacctgtaatcccagctacttgggaggctgaggcaggacaatcgcttgaagcggggaggcggaggttgcagtgagccgagatcatgccattgcactccagcctgggtgacacagtgagactccatctcaaaaacaaagaaaaaagaagaatctgcttcactgaaggcaatgagactaacaaaagttcacgaaggttctatatgggatatggagaaacttctaatgacctagattgaagaccaggcaacagaagtatatctttcttagcacgataacaatcatggccaaaacaaaaagtttgtttgtgatgttgaaagaaaagtctggctgggcatggtagcgcatgcctgtggcccctactactcaggaggcaggggtgggaggattgctagagcccaggaagtcgtggctgaagtgggctcatgataatgccactgcactccagcctgtgtgacagagtgagactctgagaaagaagaaagaaagaaagaaagaaagaaagaaagaaagaaagaaagaaagaaagaaagaaggaaggaaggaaggaaggaaggaaaggaaggaaggaaggaaggaaggaaggaaggaaaggaaggaaggaaggaaggaaggaaggaagcgggagggagggaagaaggaaggaaggaaggaaggagggagggagggaagaaggaaagaaggaaggaaggagaaagagagaaagagagagagaagaagaaagagaaagaaacagaaaaggaaggaaggagagagagaaagaaagagaaagagaaggaaggaaggaaggagaaagaaaggaaaggaaaggagtggaaaggaaaggagaggaaaggagaaaggagggagggagggaaaagaaagaaagaaagaaaaggctaaacctgactatgatattgaatttactgctagctctaggtggtttaaatgattcaagaatcatggccatggctgggcgcagtggctcacgcctataatcccagcactttgggaggccgaagcgggcagatcacctgaggtcaggagtttgagaccagcctggccaacatggtgaaaccctgtctctactaaaaatacacaaaaaaattagccaggcatggtggtgcgtgtctgtaatcccagctacttgggaggttgaggcagaagaatcgcttgaatccaggaggtggacgttgcagtgagctgagattgcaccactgcactccagcctgggcaacaagagtgaaaactctgtctcaaaaaaaaaaagaatcattattcagcctggcacagtggctcacgcctgtaatcctaccactttgggagtctggggtgggagaattgcctgagcccaggagtttgaaaccagcctaggcaagatggcgagacccccatcttaaaaataaatcattatgcattatataatgtgaatgtgagagagcaatatgcaagtgctgatacgaaggcagctgaagaattttgggaaactctagataaggtgattgtatttgcctgggaaaatcttcttgagttttatagtttcaggtcttattaatacatttaggtctatgattcattttgggtaagtttttgtatatggtgttaggtaagagtctaacttcattgttttgcatgtagatatccacttttcctagtaccatttgttgaaaaaaactcttatttcccccattaaatggccttgacacctttgtcaaaaatcacttgaccacacatgtaaaggtttatttctgggcctttatttattctattatgggtttatttattctattccatttttctacacatttgtctttatgcaagtaccacactgttttgattactgtggctttgtagtaagttttgaaatcaagaagtgtgagtcctccagctttattctttttcaagattattttggctatttggggtcctttgagattccatacaaattttagaatgggttttttttctatttctgccaaaaaaaacctcctagagattttgttaggaattgtattgaatctgtagattgcttatatttatgtcttatttaatttctttcagcaatgttctatagttgtcattgtacacatctttcacccccttggctatgttaattcctaattcttttgatgcttttgtagattgaatcattttcttaatttccttttcagattgttcattgttaatatatagaaatgtaactgatataactttgtatcctgctactttgctaaactgatttattagttctaacagtgttttgtggaatctttaggcttttctacatttaagatcatattatctgtgaacagagatcattttactccttcctttttaatgcggatggctttgctttcttttccttgcctaattgttctaggtagaacttccagtactattttgagtagaggtggtgaaagcaggcatctttgtcttgttcttgatgttggaggaaaatctttcattctttcatcattgtgtatgatgttggctgtgggtttttcatatatggcttttattatgttgaagcagtcctcctattcctagtttgtggagtgtttttttttatcatgaaattatgttagagtttgtcaaatgcttttcctgcatcaattgagataatctgatataggattcttggttgacagtttttttctttcagaactttgaatttgtcagcccacagcctctggcctccaaagtttctgataagaaatctgctaatgattttattgaggatttattgtatgtgatgagtcgcatctctcttgctgcttccaagattttatctttggttttggctttcaaaagtttgattataccgtatctttgtgtggatctctttgagttcatcttacttggagttcattgagcttcttggatgtttatattcatatctttaatcaaactttggaagtcttaatcaatgtttcttcaaatattctgggtttttttctctcttctccttctgggatggctagacttctgagagaatgcatatgtttttctgcttgatggtgtcccacatgtcccttaggcagtgtttacttttctccaatcttatttatgttcctcagactcagtaattttcatggttctatcttcaagttcattgagtctctcttctgtctaatcaaatctgcctttgaatccctctagtgcatttttaaattttggttattgtactaatcaatactacaaaaagttcttgtactttctggtttctttttaggttttccatatctctattgatattccccttttgcttgtacttgtttttttcactctccacatcttcctttagttctctgagcatctctaagacaattgttttaatatatttgtctagtaggtctgccatgaggactttcagagcttctgttgacttttttcctttgaatgtgccatattttttcttttctttgtatgccttgtgattttttggttgaaaactagacattttagtttaataatgtggtaactctagaaaccaggttctcccctttcctcagggtttactttattttgttactgttttttgttattgttgatgtttcttttttattgttataggctatctctgtgccaaggacactttgccatccaagccttcacctagaagttgcaagccttcaatagactccatggctttaaaatagttacagattctgccagtacaagttttggttaggtaaggaaacagaatcctagagcttcctactctgccatcttcccagaatactttcctggctaattatttctaagggaataatttaagcccccaaagacacctgggccaagtctttctctagaaacttgatatcttttctgctttctttccctgctttttcttttccacttagttccactcccatcccccatctcaccacctaatatccatcagactcagtatgttcctcttctcctcccaaccccatgttcaaatactttttttttttttgagactggcccaggctggagtgcagtggcacaatcttggctcaccgcaacctctgcctcccaggttcaagcgattctcctgcctcagcctcccaagtagctgggactacaggcacctgccaccacacctggctattttttgtatttttagtagagacggggtatcaccatgttggccaggctcttctcgaactcctgacctcaggtgatccacccacctcggcctcccaatcaaattctttatccaaagccttacttggtgggtcatataatgaactaaaatttggaaaacattcacatttgtggaatgcttcagagttttcaaggcgtctacattatctcattggatcctcttttcagcccagtgtggttggtagatgagatagcagtgttcagacagtttatgtgacttgtccaagatcagagagaaagtaacaaagcctaaactggaatccagatctcctgactccctattcacttatctttccagttgcccttgtctctacaaatcaccaaaagaaattggttcctagaaataaggataatgtaggggtgtgccatcccctatcccactcttctgcacccatcaccacgaaaacagacaatgtttattgcagggccccatattaacctactttcttctgcagagcctctaagctccacattatccaggaagcaatacattgtgactgttgaagtcaaaataaaacatagcgatgaatctctaactttaaagcattctattttggaagcaaggattgcagtttgaggcatacacactaaccaggtggtcttcagtgtgtctgaggaacagaaagaaggttgggagttttattagagaaatgttctatactgttttgaaagaaagctcattggcactaaagaatcatttggaaagaagggaaaaaaagagaaaaaagaagcatttgggagctggcaaactctgattggtgagtgatggtggtaggcaaaactattcttaaagtcatgtttcagcagctactaaactagtcttggggttacagcaggccattttagcagctgggcttgtgaaaaatttaattcatggagcaggtgctgtgccccaagtgcttcttccctcctggtccctagactctgatttagttgggtatgacaagaatgacccagtttgtgtgatcagctttcacataaccttgtaaattctagttgatccaaggaaaaccaactaagtaaggagaagaaaagaactgcagcgtcatagtttttgagtctgtgtaagtacagccctttgactgaaatctgaaaattatgagaccaatattcctgcaaaaaaaggtcccaaagagattttactaataaggtgggctgggcctcagcaatctgcccatcaagagtttagcttctccaccaactactccttaactcacccggaatttctgaaacaagctgaattagacccttctttggcaggacttgtttttctaggttaactcaattagactgttttattccgtctcttgggatccattctgaattaaattttcattaaactctgcccttggagtatccttgatgcaaccacttcccttccaatcccttgtaacctcaatgtcaacatcaattccaattctaaagaattgggagaaatatgggaagaacagaccacaagacttctggcaaccagaatgagtatgaaggcatgacgtttgcttggctgaaagcaaagagatgaggtggggaagccagctctgggagatcctgggatctttaaaaaatctcagagcaacacgccttgcctctgctatccacggacaggaaagacgctctgctttggcgacccttagaggggctaatagaggcacagtcacttgcaccgtaaataggaggaaacaattttcttttcttctgccgcctatagagattctattttcttctctaagtttaacttttatatgaactgggttgctagagagctcctttgtaaaataaaggataaccctttaccttttgcttcttttgtaaaacctctcttgatctgcttgcagctgcctttcagctgatgaaacatttcctattttcactgtggatctgaaagaaccttcctgcctgtgagatgtggtgaagtttgaaataattttgtagtatgattggttgttttcttgttcttgtctttgaagttatagatgagcaagcagcaaatctctacagctgcaaggtgaaaaaggaagttccttggcctgggctctttgcgggaaagcatgtgagtttagatggcaactttaatctgctttcaggagtgaagctgctgctactttggaaagttgaaaggacttaacagttatccctcctttcttggaaagttaaacagatttttttgattcacttttgtgggtcagagtagttaagaggagttcagtgtgaagaaagcagttgatcttttgctaactagtggcttctttctctttactctgtgccttttccattgcctagcagtaaacgaataaataaatatatctatatgtatatctaagaaagaagtactcctaaatatcgaccctgaccccaaagtcacactttaatgcttctttaaatgtcttcagaaagttgcttgtggtttcagatttctaataactcttacagagcagaatttaggatttagggatcagtctgcacgtgtagcatttgttcatttcatatttattagagatgaaacagatgaccaaaattccatttattgcagactctccttttcctttgtaaatgtttgacttttctgaatggatatccatattcacacattttaatgcccattaaaggaagctcaggttaatgttttcaattgtaggtgagttcgctctgcttcagtgatatggaacattttgttctgctgtttccattggaggagattaaagaggctaaatgggatggcatagtgaagtcatttttggtttcctttttaaaatttttattttattttattttattatttttattttattttatttatttacttatttatttttgagacggagtctcactgtcacccaggctggagtgcaatggcatgatcttggctcactgcaacctctgcctcctgagttcaaacgattctcccacctcaggctcctgagtagctgggacaacaggcacacaccaccacgcctggctaatttttgtatttttagtagagacagggttccactatgttggccaggctagtctcaaactcctggcctcaggtgatctgcccacctcagcctcccaaagtgctgggattacaggcgtgagccacagcacccagccagtcattttgggttttctttggttattttggatgccttactgggacccactcaaaaaacaaacaaacaacaaaacaaaacaaaatgaaaaacactttcataaatgtctgtctcaaaaccttttctactttctccaaatagaactaatgcatacatattcttaagatttgctcagctatatctccttggttctgacttaatcctcttctgcagaaaatttcatctcacatcaaagcctcttccctccttctgctgtaaagttgttgagagctgtcacagactgtcagctcagcttcagctatgcttaatgagtgcttgtgcagaatgcaccccaggtaaaggaattcagaaatcaaaagacatgattactgagaaggagaaaaggcagagaagtgatttctggagagcataaacaaaaccaatatagtacccactaaggtctttgttgagtaatgatagataaaacagcctaaagggaatgatgtcaggagatctaaaacaatcatttagcatcgcctatcagcattgtattccttgtacactgtgggaatgaacatctgggaagcctagactctgacccctgtttcagtggaacagggagacagatttcacactgacaaacagctgcctgaaggagtcttgtccttttgtcccttgagaagggacacagcctcaagtcttctctcaagttctaactcaggacccctcaggcagtctgggcctgccatatggttcttggtctcaaagaagagttctgaagcaggttgtctacagaagattcaaaccacccattaaaatattattcaatttggcatctgttaggcataacaattagactagccaattcagtcacaatagtgaaatcggtacgtgtatgtagatacagcccaagagatcaaataattttagtgttgttaagaaaaaattattctgaatttttttttacacaaggacaattttaatcctgcattttcctgtggtaacatccactgctggctagctatggattgaaactgcatttgctaagaactgtggagcacatgttgatacaggcacacagacatctgccagcaccaacagaatacatatgtaacacataccagatagtctcgatggataaatttgctccaccagtaattctatttagtagaattcacagttaatgcagaatttcatttttaaattttacatctttctaatactttacatttttctaatattgtatttaaaaaaaaaaaaaaaaaactgtctcgccgggcgcggtggctcacgcctgtaatcccagcactttgggaggccgaggcgggtggatcatgaagtcaggagatcgagaccatcctggctaacacgatgaaaccccgtctctactaaaaatacaaaaaaattaaccgggcgtggtggcgggcgcctgtagtcccagctactcaggaggctgaggcaggagaatggcgtgaacccgggaagcggagcttgcagtgagccgagattgcgccactgcactccagcctgggcgacagagtgagactccatctcaaaacaaacaaacaaacaaaaaaactctcattcaagatcgtaatttgcatgacaataaaccatggttttgtgggctctaagtttcttagaagtgtccgcagcaatttagaacaaacaccgcaagtcttccttccaatttgcagcatctgatttaaagtttaaattcatctaatgcatcattaaaactgtcatttttacttctcttgtcattaaaacttctcttgtgagaagacatgtttcacttgctatttccaggactacatcttgagcatgggtgtacagtatttttcattggttagcagaattttactcacataatttatagccagaataagaacctctagcctctctgaatggccttccactcagaacaatgatgatgattaatgtctaaaatgtgtctgaggtgcccgcctttgacattaccaaaatgtttccaagtaatcttagaaaatatgattctttaaacatatgcgtaatattctaccacacaatgtgccatcacttgtttaatcattttccaattgttcatttgtaacatttgcaatttttcattataaataatattgtgatgaatactttcatccataagttttacgcaaggctggttatttcttctaatgtcttctaatgtcaaagaagtggcttactgtttcaaacagcgcacattcatggttttaaggcttttagcatactttatcaaataatctccagaatagctcgaacaactcctaccaacagtatgttattgtgcccgtagggtggactttgtaacaacaaagcaaattgaaccacaaatttattagattcacacccatctcaaaactgtcacatcaatgaagcaaggagacgtattactggttaggaagccaaattcaaattatttttaaaaatcactcagctttagatcagtaaaataatcaacaaaaatgctccacataaaaagtctaccgggtttttcaaaaaataaaaagacaaagagagagtcaggccgggcacagtggctcatgcctgtaatcccagcactttgggaggccaaggtgggcaaatcacgaggtcaggagttcgagaccagcctggcaaacatgatgaaaccccgtcgctactaaaaatacaaaaattagctgggcgtggtggcaggcgcctgtaatcccagctactcaggagactgaggcaggagaatcgcttgaacctgggaggcggaggtggcagtgagctgagatcatgccattgcactcgagcctgggcgacagtgtgagactctgtctcaaaaaaaaaaaaaaaaagagagagagacaaagagaaagtcagtaccaaatgaccaaattttattttatttttttagacagagtctcactctgtcacccaggttggagtgcaatggcagatctcggctcactgcaacctccgcctcccaggttccagcgattctcaggcctcagcctcctgagtagctgggactacaggtgtgcgccaccatgcctggctaaattttgtattttttttggtagagacggggtttcaccatattggccaggctggtctcgaactcctgacctcatgatccacccgccttggcctcccaaagtgctgggattacaggcgtgagccaccacgcccagcaaatgaccaaaattttttatttgactaaattctattcatgcatgagcatgacagtctccctgtttatttgactttggcaattaaaaaaacaagcaaccttgtacaaaacagtgaaaatgccaaggacgagggcagtctacagttttactgtagaatatatatatattctacagtaaatatatatatatgtatatataaaggcctctctccctttggccatatcaactctcagttcaggccattaaatacagacaaattttcaaattcacttctttacttctccaagatctttgatgctgtcatcatctacttctggccatttttctgaatgacatgaattatgtcatctgtaaagtctccccgaataatttcatcctccccattactgaggcagcacaggagaatttttgagcaaaaatctttgtgcttctttaagatcaatttcaaaagttgcaaggccacacactcttgtcacatgtttcttctttgctctaggaattttggccttagtaagcttttgtggtatggtcttctttttttgttttatttggcctcttccacctctcttctgttttttcttctcctcttcttcccctgctgttccttgaccctcactaattccagcttcttgtttgggtgaattttctacagtaaattttgcaagttcatttagaaaattcttctctaaccattgtttacaatgagcaacatcaggcatatattcacagtactctgttggtaatgaacagactccacaataaaggactcgaagtgggtaattggcatctaacttggcactgttccttgggtctcctttgcaatcagccccactggattcagaaatctcagctcactgcaacctctgcctccgggctcaagcaatcctcccacctcagcctcctaggaccacaggcacatgccaccatgcctgactaattttttgtatttttggtagagatggggtttcgccatgttgcccaggctggtcttgaactcctgacctcaagtgatctgcccacctcagcctcccaaagtgctgggattacaggcgtgagcccctgtgccgggccttcatcttttatattttttaaaattgcagataaacttgaagctccctttactgattaactccaattcccacaactcttctatttatttcttttcctctgtacttttctcctctctcctttccttttctgcctgttttatactcctctctttaatttaaaaacctagtgagtttaacattttatgtttttagttttttttgttttagttgtcattgttgttggtttttgtttttttgttttttgttttttgttttagacagggtctcactctatcacccaggctggagtgcagtggcatgatcatggctcaccacagcctcaacctcccaggcttaggtgatccacctgcctcatgctttcaagtagctgggactacaggcatgagccaatgtagcccgttgtgtttaacattgtatatgcctctctcctaaatagctatttttagaaaagactgatttaaattgatatttgcctcacatggtcctcaattgaaacaggtttccatcttattacgaaagctatgattattacattatatgatgcttttttttttttttttttgagacagagtctccttctgttgcccaggctggagtgcaatggtgtgatctcggctcactgcaacctccgcctcccgggttcaagcgattctcctgcctcagcctcccgagtagctgggattacaggcacatgccaccacgcccagctaatttttgtatttttgtagagacgaggtttcatcatgttagtcaggctgtcttgaactcctgacctcgtgatccacccacctcagcctcccaaagtgctaggactacaggcatgagtcactgtaccctgctgatgctttttcttatatgacttttttttttgagacatggtctcattctgttccccaaactggaatgcagtggcacaaacacagctcactgcagccttgatctcctagactcaagtgatcctcctgcctcagcctcccaagatagctgaaactaccatgcccagctaattttttaaatttttgtggagatgaggtcttgccgtgttgcccaggctggtctcaaactcctggtctcaagcaatcttcctgactccacctgccaaagtgctgggattacaggcatgagccatggtgccctgtcttgtatgacttttaaattgcccctgaaggccgggcgcagtggcacatgcgtgtaatcccagcactttggaaggccaaggagggcagatcgcctgagatcaagagttcgagaccagcctggccaacatggtgaaacactgtcgctactaaaaatagaaaaattagcctggcatggtgatgggcgcctgtaatcccagctactcaggaggctgaggcagaagaatcgcttgaacccgggaggtgaaggttgcagtgagccaagatcgcaccactgcactccagcctggtgacagagcaagactccatctaaaaaaaaaaaaattgcctctgaaggtatgtctagaattcaaagatattttaagctacttgcagcattagaatgaacttatgacatctcaatattacaactttggggaaaaacattctactgactgtctcaattctggttatattagctaaaaactaaaaccacttttaagttataaaaatcccattacttaggccacagctcattttcagtcaaaaacattattattcttaccagagttagctggaaatcattgtctattttcagaggtcagatttattctcagagggcaaatcctcaccataaaagaaatattcaggtcaggcacgatggctcacgcttgtaattccagcactttgggaggccgaggaggcagtgtctcttgagcccaggagtttgagaccagcctgggcaacattgtgagacctcacctctactaaaaaaataattggcctggtgtggtggctcacacctgtagtctcagctccttgggaggctgatgtgggaggattgcttgagcccaggaggtcaaggctgcagtgagctatggtcttgccattgccttccagcctgggtgacagagcaaggccctatctataaaaacagaaagaaagaaatattcagcagaatatgttgtagcctctctgaaggggatgccactcatttggaataacagcaattcaacgttcgaagagaacttaaaaatctaataattcatcagcctgggcaacatggtaaaaccccatctctaccaaaaatacaaaaaaaaaaaaaaaattagccaggtgtggtggcacatgcctgtagtcccagctactagggaggctgaggtgggagaattgcttgaaccctgaaggcagaggttacaatgagctgagatggcaccactgcactccagcctgggtgacagagtgagaccctgtctcgaaaaaaaaaaatctaataatgcaaattttttctcatacaggtgaagaaaaagttatccatagagagaaagtaacttgccagaagtcacacagggagctagtggcagggctgggaccagaacccaggtttttacatgctggttcattctttgactccccaaacgcattcccatcccccgcccccaatcccctatctcctcgcctccactgagatatccgatgcccagagccctggttagacagctgaaggtgatgtctataagcagtctcattattatatgacttactgctgaaactttactgagtgtaatgtaatgtttcccctaatccgcaaacttcttcataaccactgtgtcatatgatcagtgtcaactttctcaatcttgtaaccacagctggcttcatgagcatgcagcttgtgtagctgcaccaggcctcgtgcttaaagggccaatggcttggtttaatgctctcctgtcaccatctcttaattttttaacaaggggtcctacatttcatttttcacagggcctggcaaattgtgcctcaactctaacacttccccctcctccttttgttagttacttgtctctcttccctgcactgaaagccatttaaaggtagggcatccgttattcacatatgcagaacataaagcaacttgattcagtttttcagggccagagaacccattatggacccagagaaagctatggaccctctcccctgaaaaatcacatatgcacagtgtttcacagacaatttcaaggtcaagaattccctcttgctctatcatttccctttcttcccaagtatatgcttttttccaaaagcctgatcaaaggaaagcctgccttcatcttaactaacctgaatgagtctgctgaagtctgcagttgctcctccatgctggggtccagctgatacttcttgatctgtgttcactgtccttcacagggatgagctttaccaagaacccccaggtctctggccattggtgcttggcagggctggtggaagccactattatgactaactgagcccagtcacctcccctccaatgccagcttgctggctacccagacactctggctgccttgactagtgccactagcaaagcccagggcaggctgtcagagttgtgcctcatgaacacctagtatggtcagcagctgacactgttcactgtcttcaagaagactacttaaacaaacaaacaaaaaatactaaaacaatgctaaaataaaaattaaaaggggagccaggtgcagtggtgcccctatagtcccagctacttgagtggctgaggcaggaggatcacctaagtccaggagtttcaggccagcctgggcaacacagtgagatcacatctcaaaaaaattaaaaaggccgagcacggtggctcacacctgtaatcccagcactttgggaggctgaggcgggcggatcacctgagatcaggagtttgagaccagcctggtcaacatggtgaaacccgatctctactaaaagtacaaaattagccgggcgtagtggtgcatgcctgtaatcccagctactcaggaggctgagatgggagaatcgcttgaacccgggaggtggaggtgcctttgcctcttcttccattctcatctctcactacacctctgtctcagtaggtacttagccatgccacatgactgggagactgtagtcctttcctttgctgtggggaacaaggccttatccctgaaggattaagatacaatactctccccagtgctgtcgctaaggggatgccttcagtgcacactcaggacgctgagtgtaccctactcagggatgatctcaacactgttgtctcttatattccctcaagcagagatcttgcacattagcatacatgtgtgcacgcacgtcaacaagactcctgggttacatcaaccaattgcactggacctgtacaaaccctcattgctgttactactcatgaggaacacactcactgctattaatacaattgcagtgggcttgtacaaactttccatgactttccatgccctcttttccacaacttagtcagattcagtcacacttatgcatttgtaaattcttcagctcttaaggaaacataataagtgacccttataaatctttctctgtgtaactttttttttttttgagacagagtctcgctccgtcgcccaggctggagtgcagtggcgtgatgtcggctcactgcaacctccacctccccggttcacaccattctcctgcctcagcctcccaggtagctgggactacaggtgcccgccaccacgcccggctgatttttttttgtattttttaatagagacggggttttaccgtgttagccaggatggtcttgatctcctgacctcgtgatccgtccgcctcggcctcccaaagtgctgggattacaggcatgagccaccgcgcctgaccttctctgtgtaactatttaagctgcccagtggcacaatgacagggaggcaagaattggaaatgaggaatttgctatgttctgaatgtttatgccctctcagattcagatgttgaaatcctcactgccaaggttatagtgtaaggaggtggggccttttggaggtgactaggtcatggtggcagagccctcatgaatgagactagtgcctttacaaaagaggcccaagggaaagcccttccaccttgtgagattagagagatgatggctgtctatgaagaaataggccctcactagatatcgaatctgcctgcaccttgatcttggacttcccagcctccagaaccatgagaaataaatttccgttgtttagaaaccacccagtctatgatattttgttatagtcacctaaacagactaagacaggattcatagaattaaggatagaaggtagattctttcattcatataacaaatttttgtcaagtttccactctgtgcctcagactctatagtgagtcatatagtcctatcctcttatgaagggggcctgcccctccacacctgtgggtatttctcatcaggtgggacgagagactgagaaaagaaataagacacagagacaaagtatagagaaagaacagtgggcccaggagaccggtgctcagtatacagaggacccgcactggtgccagtctctgagttccctcagtatttattgattattatttttactattttagtgaggggagtgtagcagggcaacaggtggggagaaggtcagcagggaaacatgtgagcaaaggaattagtatcatgagtaagttcaaggaaaggtactgtgcctggatgtgcacgtaggctagatttatgtttttctttacccaaacatctcagtgtagcaaagagtaacagagcagtattgttgtcagtatatctcccctctagccacagggcggttttctcctattttctcctatcttagaataaaatgaatgggaatggtcggctgtacactgagacattccattcccagggaggagcaggagacagatgccttcctcttatctcaactgcaaagaggcctccctctttcactactccccctcagcacagaccctttatgggtgtcgggttgggggatggtaaggtctttcctttcccacgaggccatatctcaggctgtctcagtggggggaaaccttggacaatacccaggctttcttgggcagaggtccctgcggacattgtgtccagtgcattgtgtccctggttaatcgagaatggagaatggcgatgacttttaccaggcatactgcctgcaaacatgttaacaaggcacatcctgcacagccctaaatccattaaactttgattcaatacagcacatgtttctgtgagcacagggttgggactaaagttacaggttaacagcatctcaaagcagaaacaatttttcttagtacagatcaaaatggagttttttatgtcttccttttctacatagacacagtaacaacctgatctctctttcttttttttttattttttttttagacgaagtctcgctctgttgcccaggctggagtgcagtggctcactcagctcactgcaagctctgcctcttgggttcacaccattctcctgcctcagcctcccgagtagctgggactacaggtgtctgccaccacgcccgcctaatttttttgtatttttagtagagacggggtttcaccatgttagccaggatggtcttgatctcctgacctcatgatccgcctgcctcagcctcccaaagtgctgggattacgggcgtgagccaccgcgcccagcctgatctctctttcttttccctacgctcttatttttattttattttatttatttatttatttatttatttatttatttattttttagagacagagtcttgctccgttgcccaggccggagtgcaatggcacaatctcagctcactgcaacctccgcctcccggttcaagcgattcttctgcttcagcctcccaagtagctgggattataggcatgcaccaccaagcctggctaatttttgtatttttagtagagacgggtttcaccatgttggccatgctggtctcaaactcctggcctcaagtgatgcacccacctcagcttcccaaagtgctgggcttataggcgtgagtgccgggcccttaaaactgagaaagctgagacctaggtggacctagggtcaggcagccatttaaatgacaggttcatccaagtgatctgactcgtgtgtctggatccttctttttatccaccatgctgaagagaaactcatcttaagtcctaaatacagatgatgaatttaaaaggagaactgtcatcagagatatcacacatcaaataacagtcttcatcattgcagagtggaaagacagttgagaaacccagttacacagctactcattgctgtcagcattattgtcctgtttttttgttttgttttgtttcgttttttttttgagacagagtcttactctgtcacccagcctgcagtgcagtggcacaatctttgctcactgcaacctctgcctcctggattcaagtgatgcttctacctcagcctcccaagtagttgggattacaggcatgcgccaccacacccagctaatttttgtatttttagtagagacgagctatcaccatgttggtcaggctggtctcgaactcctgacctcaggtgatccacctgccttggcctcccaaagtgctgggattataggcgtgagccacagggcccggcctagcattattgtcctgtattaatagcagggagtgtgtttctctaatgagtaataacagcaacaaggtctgtacagatccaaaaacgtttacctgtaattgcaaaatcccaacaccctgaaaagtataaggttttgttccccctttggcaactcatttggcagcaaaatctgaacttacctgaagacatttggcaacaaaacccgtcccgaattgatgtgaatcaattcatagtctgtattcatcctgcctattatgaagatccatgcctttttgctatagaagcattaatattttcattatagggttctcccagaccccttatatgtggtttaacataatatatggatgatactatttttctaacgttcacaaagttctgaattctaaaaaacatctgaccccaagaatcctaatacaactaaacattatggacctgtattacatttagaatatacatatccctccagaattgaggtaaggaatactggtctttaactttctccctattatacccaaataagatttactccactgagactttaccaatccaagactcagtccaactgtatggttctaccaggagaactgttttgccgggggttggtctgtttgtcttaaactaacccctaggattcacttttcctgagttaggctggggatttgacctggtgagatctcctgcctacccattgtgcagtgaatagtgtttacattaggcttatggctgctctgatggtgaactgagcttgtacctacattatgaagtgttcagagcaagtgatcactgtggactttggccagtccatggacatccagtcccatggatattggcctctggtcatgagctgtcccactaccccttggatttgtgaatattgaactggactgttgattcagccccctcgttctcaatcctgttcctgggtctaacttaatcttccccaaactcctgccacctttttctttcttcctttcttttcttttttggtatgatcacagctcactggagcctcaacctcccaggttcaagcaatcctccctcccacctcaccctcccaagaggctgggaccacaggtgtgtactatcacacctgtgggtggcaagccacgcaggtgccaaggcaagagaccgagggcacaagctgctccagtataataaagaaaatatatagaataagaatagttatactagaaatagattatagatgtgattatatatgaatatcattaatcattagtttgtagcattactctttattccaatattataataatctttgttctacaattataacctaggaaaaaccaggccatacagagataggagctgaagggacacggtgagcaagtgaccagaagacaagagtgtgagccctctgttacgcccggacagggccactagagggcttcctggtctagcagtaatgccagcacctgggaaggcacccattacctagtggaccttggtctagtggtagcatcagtgctcgggaaggcaccggttacttagcagaccgagaaagggagtctccctttccccgggggagttagagaagactctgctccaccacctcttgtggaaggcctgacatcagtcaggcccacccgcagcctccagaggcctgaccatctccctgtgatgctgtgcttcagcggtcacgctcctggtccgctttcatgttccaccccgtacacctggctccgccttctagagagtggtagcagaattagtaaaagtactaaagtctttgaaatgcatagaagaaataatggcataaactgtcctctctctccgcctcggctgccaaacagggaagggcctcctgtctggtggacacgtgacttgtgtaaccttatctatcactggagatggctcacactccttaccctgcccccttgtcttgtatccaataaataacagcacagccaggcattcggggccattactggtctctgtgccttggtggtagtggtcccccggacccagctgtattttattctgtctctttgtcttgtgtctttatttctacgatctctcgtctccacacatgaggagaaaaaacccacagacccagtagggctggacccgataacacccggctaattttttaaaaattttttgtagagatgaggtctctctatgttgccaggctggtctcaaattcctaagatcaaggaatcctcctcctgtggcttcctccagtgctgggattataggcgtgagccaccatgcctggcctctttttctagctcagattttccggccactctcacttctttgtagaaattcccattacagtttttggcccatgagtatattatttatggtaaggaaaacccaaagacacaaaataactacacgtaccgcctcctaatttataacatgcctcttgtaacttgccttaatcgagctcatttgtttttgtttttgagatagagtctcactgtgttgcccaggctgggtaacagtgcagtggtacaatcacagctcactgtagcctcaacttcctggggtcaggtgattctcccacctcagccacccgagtagctgggaacacagtcttgtgccgccactccctgctaagagccttttgttaatcagagcttcccaccacattccaccacatctccatcctttactttccttgttttttaaagttgaatttctttctttctttttctttctttctctctctctttctttctcttttttttttttgttttttgttttttgttttttgagacagtttccctctttcacccaggctggagtgaagtggtacgatctcagctcactgcaacttcctccccctgggttcaggcgattctcctgcctcagcctcctgagtaggtggatttataggcatctactcaggaggccaccacctggttaatttttgtatttttagtagaaacggggtttcaccatgttggccaggtcgaactcctgaccccaagtgatccattcgcttcagcctcccaaagtgctgggattataggcgtgagccaccagcccagccgggttgaatttatttctaatttgccttcctaattaatacccattaaagctagatgctgttatttgaaaaatggtctttttagcaacaatcagaagctaaaaattaaaaacaatattgcttttggaagagatcaatgatacagaataaaaattttaaatatatatttaattttatgtaactaaaatattatctagtttacaaatatttcatatttctattccaaatgttactgtattgaatctttatgaattctagacagcatgatataataataagtttcaaaacattatgataactattcatgatgtaatttttcctctgcctccacaatccaagtttaccagtcctagctcttgtctcattaggacccagtcctgtactaaaacaaatctgaagtctgataaattaatgagaaatattattggcacattagccttttaataaaggtcatcaatatcttttcctgaagaaatagttgggctgggtgcggtggctcacacctgtaaccccagcactttgggaagccaaggcaggcagatcacttgaggtcaggagtttgagatcagcttggccaacatggtgaaaccttgtctctacaaaaaatacaaaaattagctgggcgtggtggcaagcacctgtagtcccagctactcaggaggctgaggcaggagaattgcttgaatccgggaggcagaggttgcagtaagccaagatcgcaccactgcactccatcctgggcaacagagtgagattccatcttaaaaaaaaaaagagagaaagaaagaaaagaaatagttaagtgctccatcggttagtagatattgatggagcaaacatgatgttcttattccaatccatcatgattcttacaatctagacggagttggcaaactttttctgtaaaaggccagataataaatattttatgctttgtggaacacatagggtctccgttggatattctttttttttttttaatagaatcatttaaaaatgtaaaaaccattcttatctccagactggataaatgccatatgaaatgtgagaagggcaaataagtactgtagtcactcatttgggctttgatgaccattaacaaatgataagtaaataaatgtttgtatagcaagctaagcactgcgatcagtgggaaaggacaagcatcatatggggaccaggaagtagccaagcttggatggaatttattacttcctgtgagaaaatataaagctggaaatcatggtggagagcccctgtcattgaggagttaatatcttagaagggggatgccatatatatatatatatacatactatatatatatattatatatattataaaatatatatagtatatatatactatatataatatatgatatatataatatatatagtatatatatagtgtatatataatatatgatatatataatactatatatagtattatatatatagtgtatatataatatatgatatatataatactatatatatagtattatatatatagtgtatatatatatacacacatacacacaaatgaacaaatatggctgagtggtggctcactttgggaggcttaggtgggaggatcacttgagcccaggagttcaagaccaacctgggtaatagagtgagccttcatccctacaaaaaaaaatttttttttaaattagccaggtgtgtttgcacatgcctgtagtgccagctactcaggaggatgaggtgggaggatggcttgagcctgggaggttgagactgcagtggcccaagattgtgccactgcactccagcctgggtgacagtgagactctgtctcaaaacaaacaatgacaacagaaaaaaactatatgagcttgagttagaaaatataggccaggtgcagtggcagtggctggcggatcacttgaggacaagagttcgagaccagcctggccaacatggtgaaatcccgtctttactaaaaatacaaaaattagccaggtgtggtggtgggcacctgtaatcccagctactctggaggctgaggcacgagaatctcttgaacctgggaggaggaggttgcagtgagccaagatcgtgccactgcactccagcctagctgacagagcaagactctgtctcaaaaaaaataaaaagagttagaaaatataaaatgcttagtctggccaatgtggtaaaatcctgtctctacaaaaaatacaaaaattagcctggcatagtgatgggcacctgtagccctagctactggggcaggagactgaggcaggagaatcacttgtacctgggaggtggaggttgcagtgagccgagattatgccactgcactctagcctgggcaacaagagagagactccatctaaaaaaaaaaaaatccagctagcaaataaataaatacataaatccagggggcctatgtcaacagctccatcctcctgacacaaactatacctgcattcgttctctctgggtttgggaatctaggatatgagccaacatatatgcttgtctgaaggggccacttacctcttcatctttctcactgagacttaatttattagccttattctgtacatcttaataaaatctctgctactgtgaggccctactgggggcctttcaacaactctgcccaggcctggggtctcctggggccacagacattaaaaaaacacacagaagcagccaacacaccaccctctggacagcagagaccagtgcaatgcattgctttttctctttgctccaatctccttctgttccttgtctttctctcttcctcttcccatctctcttctctcttcttccctcatcaattccccttccccatcctaagccttgctaatcctccagctccaccaggacacttgcctaacagggtcacaacaccagcccaaagaagcacaaagaaagcaggaaggcctcttaccattacccctgacccacccacctgaccaccttctctgtcccactcaggcctcctgggatggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtgggtaagtcacctagcctctgggctctggcccaggagaggggctgcaggagatcaagcatgcttcccagggtgctaccaggatccaccgccatggtcacggctccttcttgctcgttccaggaaataatcctgggagaataaggtggcccttgactcatttggtttgggaaagctctgcatgccaccagtctaataagcagcttagcatatggtagaggctctgaaaggcctgaagttaagacacttggtgaactttgtttaatttagcatttctgaaacttaatgaatcacagaactcctgtcaacagtaacaaacttcaggaaatgctccagaacatatgcaagtctgggatggaccagtcctgtcatgtcagggttgggaatgaaggctcaggggaaaatatgaggggcactggagcctggcattggagatctggtttgacttcacctgataataatcatagacatactgtgtggtaggcactgtgaggtgagtatggtctttattcatatttcacagttgaggaacttgaggcttaggagaattaagtaactagcacggatcacacagtttttaactggcaaagccagaattcaaaatcaggtacttaactccagaacctaagctcaaaactaatatctcttactacctcggcttttgctaggaaacgaggatatttgaggctgggtgaggtggctcacacctgtaatcccagcactttgggaagctggaggcatgaggattgtttgagcctaggagttcaagaccagactgagcgacatagggagaccccgtctctacagaaaaatttaaaaactagcaaggcacgtggcatgcacctgtaatcccagcactttcgtaggctgaggcgggcagatctcttgagctcaggtgttcaagaccagcctggtcaacagggtgaaaccccgtccctattaaaaatacaaaaattaaccaggcatggtagcatgcgcctgtagtcctagctacttgggaggctgaggcaggaggatcacttgagcccaggagtttgagcctacaatgagccatgattgtgccactgcactccagcctgagtgacagagtgagatcctgtctcaaaaacaaacaaacaaaaactagccgggaatggtggtgcatgcctatggttccagctatttgggaggctgaggcaggaggattgcttgagcccaggaggtcgacgctgcagtgagctatgatcacaccattgcactccagcctgggtgacagacagaccctgactcaaaaaagaaattttttaataaataaataatcggccaggcgcggtggctcacacctctaatcccagcgctttgggaggccaaggtgggcagatcacctgaggtcaagagtttgagaccagcctggccaacatggcaaaaccccatctctactaaaaatacaaaaattagccaggtgtggtggtacatgcctgtaatcccagctacttgggaggctgagacaggaaaatcacttgaacccaggaggcagaagtcacagtgagccgagatcgcaccactgtactccagcctgggcaacagagtgagactctgtctcaaaagaaaaaaaaaagaagaagaagaaagaaagaggatattctacacatatcagacagggaagggaggaacatcaacatttattgatcttcagtgtaacagacttttcactttataaacagacttcatttatcctcaagacaatactgcaaggcagatattatggaaccttttttgcagatgaaaaaactgagtctcatggaggataagtaagttacccacagccacatagtcattatattggcagagtcaggattcaaatcaggtcctcctggctccagagctctcaggaatggaaaataggaaacacaggtgcatctgtgtacaagacaggagtccattttctgggtatcacaatgttcctgtgcctgccacaatggagatgaaggaaggggcacctggggtggctctgagtggcccaagctcacttaggtcgagggaccaggccccacaagagtgtcacaggcagatcccagtgcctgcttggatttcccatttgccttccctcagaggacacgttgctatcagtgcctggctccaggtcagtagccgggctaacaagaacctactggcttgagtcctacagtgtgactcatccagcacgcttcttctcctctccctgaccttgtgacttcccaagccccctctgcccctctcacttcactgcagctcaacgtccccagaaacatctgactttgctccttttgtctctctttgaagcgctgaacaagaaatccaaacagatcggcagaaaagcagcagaaaagaaaagatcttctaaggtaagggcagggaagttctgggagttctcattgttggggtgagactggacttaaagaaggaggacccccaacctctggctaggaactaaatgaaagatttttcaggcctatattaacaaaagaaactgaaagctactaaagacttcctggcttgagctctgagccagacacccacagaagcccagggagctgaagtccactgagcaaaataggttacgaaaagcagcttcctctactagttagcccctgcctgaaatttcaccatcactcatacttttggatgaatgtggtgtttcccaaacctcagtcatttcagaaccacatttataactttgccatatctgagttccacctatttatttaacatatttgtttaaaattaaatcttaggccggatgcggtggctcacgcctataatcccagcactttgggaggccaaggtgggtgaatcacctgaggtcaggagttcgagactagcctggccaacatggtgaaaccccgtctctactaaaaatacaaaaattagccaggcgtggtggtgggcgcctgtaatcccagctacttgggaggctgaggcaggagaattgcttgtacccgggaggtggaggttgcagtgagcttgagccattgcactccagcctggtgacaagagtgaaactctgtctcaaaacaacaacaacaaaaaattaaaacttaaaaaatgcagttgactcttgaacacatgtgtttgaactcatgggtccacttatacattggttattttatgtctttttttttttttctttttttttgagatggagttttcgctctcgttgcccaggccagagttcggtggcgtgatcttggctcactgcaaccttcacctggcgagttcaagcgattctcatgcctcagcctcccgagtagctggaattacaggcacatgccaccatgcccagctaatgtttttgtatttttagtagagatggggtttcgccaagtttgtcaggctggtctcgaactcctgacctcaggtgatccacctgcctcagcctaccaaagtgctgggattacaggggtgagccaccttgcccagctgactttttaaattggaaaatatttttgaagattgacaattagaaaaaacaggtgaatcttgttacctagaaatatttaaaaaatgaaaaaaaagtatgtcattaatgcataaaatatatgtagatactagtctattttatcacttgctatcatacaatatacataaatctattataaaaaattaaaatttcccaaaacatatgtacacacagacagtacataccattcaaaatagaaagaaaataaccaaatgtaaagatgtagtactaaatcataactgtgtaaacaactgcagtacatactgtactaccatcataattgtgaagatacctcctgttgccattgcggcatgctcaggtgttgcgagtacgtgcttacaacgctctgtgagctaatcatctctgcacaaggagtctcaccaggaaatcacatattgcagtaaaatgtgatccctcaaggttctcgtgtatttttcaatgtgtttaatgcaatattgtaaaccttgagtagtaccaagggacccatactaggtgctactagtgattctggaagtgttcccaagaagcaaagaagagtcatgacattacaagaaaaagttgcttgaattacttgattgatactataggttgaggtctgaagctttggttgcttactatttcagacagacaatacatcttgtaaacagatgaagtaaacttacggtatcaataaatacagtacagtactgtaaatgtattttcacttccttatattttcttataatcgatctctacttatccaataattttcttaatattttattttccctagtttacttcatttttttttttttttttttttttagaaatggggtgtcactctgtcactcaggctggagtgcagtggcaccatctcggctcattgcagcctcaacctcccaggctcaagtgatcctcctgcctcagccccacaagcagctaggactacgggtgtgcaccaccatgcctggcagatttttgtattttcagtagagatgaggttttgcggtgttgcccgggctggtctcaaactcctgagttcaggcaatccgctgcttctgtctcctaaactgctgggattacctgcattagccaccatgcccagccagtttacttgattataagagtacagtatataatacatataacataaaaagatgttaatccacagtttatgttatcagtaaggcttccttctggccaacagtaggctattagtagttaagtttttgaggagtcaaaaataatatgagggccaggcacggtggctcacacctataatcccagcactttgggaggttgaggttggcagatcacttgagtccaggaattcaagaccagcctgagcaacatgatgaaacctcatctctacaaaaaatttaaaaaattaactgggtgtggtggtgtgctcctgtagtcccagatactcaggaggctgaagtaggagaatcgcttgagcctgggatatcgaggctacagtgacttgtgatcataccactgcactccagcctgggcaacagaataagaccctgtctcaaagaaaaaaaggatttttgactgtgtgtaaagagtttgtgcccctaacccctgcattgttcaagggtcaactgtatataattatgatagaaaactagtatcacttaccataaatagaaggtaactataaaaataagtaaagttggccgggcacagtggctcacacctgtaatcccagcactttgggaggccaaggagggtggatcaccttaggtcaggaatttaagaccagtctgaccaacatggtgaaaccccatctctactaaaaatacaaaaattagctgggtatggtgctgcacgcctgtaatcccagctactcaggagactgaggcaggagaatcacttgaacctggaaggcagaggttgcagtgagccaagatcacaccactgcaccctagcctgggcgacagagcaagactgtctcaaaaaaaaacaaaagcggagggggggaagttaaaacattgttagtaaattctgggtgaatggatggtattgcctaccaaaggctctaaatttgaggcctaaatctctgtgttaaaaggcataatggccaggcacggtggctcacgcctataatcccagcactttgggaggctgaggtgggtggaccacaaggtcaggagatcaagaccatcctggctaacacggagaaaccccgtctctactaaaaatacaaaaattagccggaggtggtggcgggcgcctgtagtcccagctacttgggaggctgaggcaggagaatggcgtgaacccgggaggcagagtacagtgagccgagaccgtgccactacactccagcctgggtgacagagcgagactccgtctcaaaaataatataaaataaaacaaaaaataaaaggcagattaggccaggcacggtggctcataactgtaatcccagcacttcaggaggctgaggcaggcagatcacctgaggttaagagttagagaccagcctagccaacatggtgaaaccccgtctctactaaaaatacaaaaattagctgggcgtggtggtgcacgcctgtaatcccagctacctgggagactgaggcaggagaatcactggaacccgggagatgaaggttgcagtgagccgagatggcaccactacactccagcctgggtgacacagcaagactccatctcaaaaacaaacaaacaaacaaacaaaaaaggcagattataaagtgttagaaaggcactaaggacacgttagcaccaaactgaccctttcaagttgaaaaagattgaaaaaagaatccttttttattgtataattcaggatcatttaacattcacgtaccacctaaaatcataccaccattaacacaggttcccactttgggaaatactggactgaggcattgctgaaatgcacaccttattcctgtcttagtgtgcctcagtttatcatatcaactgtaaccaaagcaaggagcactggattaggtattaggaggtaggatctggcactgtgtgatcttgaaagtccctgctcttttctaggcctattttgttggctgtaaagtgaacaagcaagatgagattattgacagataaaaatatataactgacaaatatatttatatgctaagcactgggaacatagcagtgaataagaaagatatatcttatccttggtctcatggagtttacattcttgtggagaaaacaggtgaacagcaagtaaatcaataaataggtaaataaattcagatgttaaagagtgcaaagaaattacagcacggtaatgagactgaagggaagagtggtctgggaaggcctctgtaaggaagtagcatttaaatagagtgaaaaactcagtaacctagagcagcagcgtccaatagaaatacaatgtgaggccaggcgcggtggctcacatctgtaatctcagcactttgggagggcgacaagagtgaaactggctctcaaaaaaaaaaaaaaaaaaaaaaaagaactgtgatgtgagctacataattttaaatttgcttatggccactttatttatttattttttttgagacagagttttgctcttgttgcccaggctggagtgcaatggcgcaatctccactcacagcaacctccacctccccggttcaaacaattctcctgcctcagcctcccgggagtagctgggattacagatgtgccaccatgctgggctaatttttgtatttttagtagagacgggtttctccatgtcggtcgggctggtcccaaactcccgacctcaggtgatccgcctgcctaggcctcccaaagtgctgggattacaggcatgagccaccacacccagttgataaccatatttaaaaaaaaaaaaggtgcaattaattgtaatattttatttaacctagtgtattcaaaatgttaacatttcaatatgtgattaatttaaaaagttattgaaataatttatttttgttgtgctaaatctttgaaatctggtgcatagtttacagcacatctcattccaatgctcagttttgacaagcataaaatgtagttctaactaaaaagttgtgtttaagaggaagaatatttttatattgcttcagttttacattttaaatttaaattaattaaaattaaatttgaaaattcagtttctaggttgcactagacacatttcacgtactcagtagccacagatgaccagtggctacctgtatcgaaggtacaaaaaccagtggctatttccttcccaggaaaagaagcagcaagctgtggcagcagtgtccaagacagctcctgctgggttcctgcagcaggaactcacctgctgcgttcggtgcacagcggggcagcgaagttaacaggggtcggagaggcaagcaagggccaaatctcaaaggccaaaagaaagttcatgtttcattttaagttcaaagagaaaccacttaggccgggcgcggtggctcacgcctgtaatgtaaacccagcactttgggaggccgaggcaggcagatcactttagctcaagagtttgagaccaacctggacaataagtgagaccccgtctataaaaacatagaaaataaaataaaaataaatttagccaagcgtggtggtgcgcacatgtggtcccagctacttgggaggttgaagtggcagaatcgcctgagcccgagatcgagattgcagtgagccgagatcgcgccactgcagtccagcctggctgacagagtgaaaccctgtctaaaaaaaaaacaaaaaacaaacaaacaaaaaaaacacaaactagggagaagacgaccagggccaggcaagagccaggtaagtctggatggggatggaggtgagggaatctgactgggggagcgggcggtgggcggtgggcaagccagcggggaaacctctggtccgggatctccctagcccgaggagctcccaggcagaggtgaggaccggaggggtgggcgtggccggctcataaagccccggcgtttcccacgcagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctgctcgaaggtgtgcggctgtttctgtaaaggtcccgaaagttctcggtcccttcgccacggagtcccgcgctgctctcccggggctcaggaaacccgggcgtcccagcctcacagctgcactcccagtcaccgctgctgccgacctgggggttaggaacgaggctatcccctgcctttaaacctgggaacacccgaggctgcctccaaaaccaggaaattcagaccagccaggaagaaaggaacagcctttcagtctcacacatttcctcctaggtgctcccctctccccaggggaaaaaaaaaacggaaagaaagaaagaggccaagcgcggtggctcacgcctgtaatcccagcactttgggaggccgaggcgggcggatctcctgaggtctggagatcgagaccatcctgaccaatatggagaaaccccgtctctacaaaaaatataaaattatttgggtgtggtggcgcatgcggtaaatctcagctacttgggaggctgaggcaggagaatcgcttgaacccgggaggcggaggttgcagtgagctgagatcacgccgttgcactccagcctgggcaacaagagcgagaaactctgtcttaaaaaaaaaaaaaaaaaaaaaaaaaaaaaaaaacaagaaaaaagaaagaaatccgaggctggacgatcacttgaggccagaagttcaagaccagcctgggctacatagtgagagactccccgccaccccaccggtctgtacaaaaagttttaaaaattagccgggtgtggtggcatgcaccggtagtcccagctactcaggcagctaagtcaggagaatcacttgagccctggagttggaggctgcagtgagctatgatcacaccactgcactccaggcttggccacagagtgaaactctggttaaaaaaaaaaaaaaggaaataatcattcctgttcttgttataaatccaaggtagtgtcctgttccctctctgttccttaacacaagaaacaaacacacacacccccacacaggaaagctgccagatgcttgttttgttttctgttatttaggttgcagtcctacagggcaagaaccttttgttccttgtaccacagttgctgctgagtaaatgtcatattgggaagataccgcagtcactcctcgtgttttccagacactgttcaccaagcaggcaccatttggcccccaggggtgaggccaggatgcaaagctaaagactcagtcgattagtaacaaagccacttggctgctgggtccagacaaccacatggaagaccaacccattcattcattcattcagcaaatgtgtattgagcacctagtgtgtgccaggtgctgtggacatagtggtgaagaagtccaatatggatcctctccttacagagcttatgggccagtgacccatggccattgtctcttgttagaggttagaaccgttgttagcatatgtggtctattccctcagactatcagttttggtttttctttagagatggggtcttgctatgttgctcaagctggtctcaaactcctggcctcaagcaatcctcctgcctcaacctcccaaagtgctgagattacagacatgagccactgggcccagccagttcttgcttttgtttgtttgtttgtttgttttgagaaagagtctcactctgtcactcaggtgggagtgcagtggtgcaatcttgcctcactggagcctccaactcccaggctcaagctatcccccaacctcagcctcccaagtagctaatttttgtatttttagtagagacagggtttcgccatgatggccaggctggtctcaaactcctggcttcaagtgaaccacccgcctcagcctcccaaagtgctgggattacaggtatgagccaccacgccccacctccttctccttttcagaattcctcctcaagcctaaagtgctaagagcatggtcctgggcctctcaaaactctgctggtctaatgaccagaactgaaactcacatttgtgactcagagttatggtttgattgttgtgagaatctgggaccgccgtctccaacaccattattcattctatttctgtctcacacacatagggtgaacttgacctaggaagatttgccctacctttgtggccactgattgattcaggatcatttcttcctgaagggcatagccttaaacttgtgcccaaagttctcatagtgtggcgttgaacaagccttttttttttttttttttgagacggagtcttgctctgtcacccaggctgtagtgtagtggcgcaatatgggttcaccacagcctctgcctcccaggttcaagtgattctcctgcctcagcctcccgagtagctgggattacaggcatgcgccaacacaccagctaatttttgtatttttagtagagacagggtttcaccatgttggccaggctggtctcaaaatcctgacctcaaactatctgcccacctcagcctcccaaagttctgggattacaggctatgagccaccacacccagcctgaacaagtcacttttgatgctaccatttccacgtttacaaagtgagaagtaaatcagtcagagtattttaggtgcaaacaacagaaagaactctagctagcttgagagaaaaaaaggtagagggttagtctcctggggagacttggggacctcaaaggaaagattatacaacgtgcctccaaaaaaaaaaaaatagcccctgaggggtgctagaggagccaagcggacaatgtcttccaagcaaagccacaggaatgtcagctccaacctcttcagtccttgcactggaccattcaaagtaattcccaggagaggctgattcacctgatgtggggccaagaaagggtggtccaccttgactgacagtcccattgttcaggaaaaaattctcaaaccatgtttccctctgctttcacaccaccacaacagtcatcaacacacaacagacttgtgtgaccccaaaatgagaggggatttccccccaccagcaggcaaacaatcagttctgcagtggacaccagctaggtgtcctccaattcaattccaacactatctacttggagatggcatcagatcccacagtctgagggctcagtccccaagactgccctcacttcagacaccagtcaaaagtggagcctctagaacttttgacaactggctttaagttggggtttccacaaccctctttgggctcaattaatttgttggagaggctcacagaacacagggaagcaaggccaggtgcagtagctcacacctgtaatcccagcactttgggaagccaaggtgggaggatcgtttaagtccaggagttcaagaccagcttggtcaacagagtgagaccccatctctataaataataaaattagccaggcatggtggcacaagcctctagtcccagctactcaagaggctgaggcaggaggatcgcttgagcccaggaggtcgaggctgcagtgattcatgatcacaccactgcattccaggctgtgtctcaaaaattaaaaaaccaaaaagaattcagggaaacacaccagtttattataaaggctattacaaaggctgcagatgaagagatgcatagggtgaggtatgggaaggggtgcagagcttctgcgtcctccctgggcctgccaccttctaggaaccccagcatgtctggctatcaggaagctctctgaagcctgtcctcttgggtttttatggaggcttcattatgtaggcatgattgattaaaccattggccattggtgatcaacttgaccttcagtccctctctcctccccagaggttgggggatggggctgaaagtcccaaccccattaaatcacgcatttgcccttgtggtgaccctttttttttttttttggaggcacattgtataatctttcctttgaggtccccaaatctctccaggagactaaccctctaccttttttttctctcaggctagctagagttgtttctgttgtttgcaactaatatactctgactgatttacttttcactttgtaaacatggaaatggtagcatcaaaagtgacttgttcaggctgggtgtggtggctcattgcctgtaatcccagaacggtgatcaaatgatccacccacctcgacttcccagagtgctgggataacaggcgtgagccgctgcagccagcccctccatctttttgagcaaccacagatctaacatcaccagccattgttgagaaattaccccagtcatacagtaggaactttagaaagaaatttaactccaagggccaattcccatttgcgaagaggacaggataggcaagaaaagaatttaatttgaactgaattagccaaaccatctgtagtcaatttaagatgagtctagagtagacgagttaccctttcttcttccatgtaccaggagtagaaggtgtgtatgttgggagcgggtattgggttcaggaaggaggaaaaggaatgacttttgtttaattggtaaaatcctttaaaactgtcaaatgctttcatgttcattacagaaaggaggtttctattaattgattgcctgcagagaaatagaagctctcccagctggatatacgagttgtagagtctgggaggtggcaccttctaatggtgagaatgatgatattgacaattattatgccttctttttgcctggggagcccagcaaatagcttcattggagtccagaggctttcacactttccagagctcctctttagaattcgtggactctatggctgtatagactaccagagcaatagtaaatattgggctgctgctcactgctcgaggcctgtgtggtctgcagttatcatagtgccatactaacagtgattatttattgagcagctacttcatgccaggcatgacaccaagactatcaaattaacgtcttgacctaagtatcactgtaaataagagaactggggctcaaagatgttaagcaatgtgtctagatagacctcacacctcagcatggggattcagatccagcccatgtcattccagagcctaggcccttaaacaccaggccactgaaaaccaggcagaggggactctgcctgcgtagagccaacaccttgcaagagactcggcccaagaggtgtacccaacagactccccatgtgactccccagctctctaatgagaccttgtcaacaccaccccagggagtagtctcactagtggagcttctggagagaagcagctgcatcttcttttcttgggtcagtacttactcaagaggccatgagaggtacaggatagggcactgataaagaatcaagaggggctggggtatggtggctcactcctgtaattccagcactttgggaggccgaggcaggaggattgcttgagcccaggagtttgagaccagcctgggcaacatggcgagcccccatctctacaaaaaaaaattttaaattaaattagccaggtgtggtggcacgcgcctgtagtctgagctatttgggaggctgaggcaggaggatcgcttgagctcgggagttcaaggctgcagtgagccatgaatgtgactatactccagcctggatgacaaaatgagactttgtctctttaaaagagtcaggtggtacaaattcctgttccagcactgcccctcactgctgtatgaccttgggcaaaattccctcccagctgcaccatgaagggattggacaaggcagtcttgggggcgaatccagtccccttcatggtgcagctgggaggggacctggcccaagttctctattttctttttttttttttttttttgagatggagtctcgctctgtcacccaggctggagtgcagtggcttgatctccgctcactgcaacctccgcctcacgggttcaagcgattctcctacctcaccctcccaagtagctgggattacaggtgtgctccaccatgccaggctaattttgtatttttagtagagacggggtttcaccacgttggccaggctggtctcgaactcctgacctcaggtgatctgcctgcctcggcctcccaaagtgctgggattacaggcatgagtcaccacacccggccctctgttttcttttctctgttgtttttctataacctggtgtcttcaatgtcttctccactacagcgagactcagaattgtcagacagcaacctattgagatgggtttagggaaagaaggtaactttctggggggttcatttcactaaaaaggggctagatccagttagtgtaaaacatgtctagattcagctactcaaatattctctggaatgtgtcactctctctcaattgtgttggctttatatctttcttttttttttttttgagatgagcccttgctctgtcccccagactggagtgcagtgtgtgatctcaactcactctaactgccacctcccagttcaagtgattttcctgtctcagcctcctgagtagctgggattacaggcgtgcatcaccatgcccggctaatttttttttttattctattttttttttagtagagctagggtttcattatgttggccaggctggtctcaaactcctgacctcaggtgatctgcccaccttggcctcccaaagtgctgggattacaggtgtgagctgctgcacccggtctgtgttggcttcatcctaaggcaagctggccttcgtgggggcaaaggagcagctacaggctcacattccttccaatcctggcagccccactgaagacagtaccttttctgtttttaggatagctgggtctcttttacagttgccacctccacctactgtgcaacaggcacagaggcaaattctacacttggtgtgcaccagcagcattgggaaacactggggacgttgttaaaatgcacactataaggcctcaccccagacctacagaatcaggactggggataagccctccaggtgtttctgaggtttgctcaagtctaagaaccacactgggttatggaacaggctttaggggaataaatacaagccagcagttagtaggaaaagcaggtgcaggtccccacgagagacaggttgaggaggggcattcagtacacagtgtgggtggatactctagggaggcacccacctctctatttctctccctggtaatagggcaagtatgacaacactgagcagggttgatcagactattacgatgctaagcagtgtgaatttaggttccaataacttatggaagttgtcaggaaaagcccaccacccagcacccgggggtctttagaacccttgcaaggttgtaactcctcccaccagggagaagcagcctctagtcctgggggagtctgagtccaagcagcccacagagtgaatcctggagtcgctcctgcaccacaccagatttctagcaaaagtcctaaagtcccgggattgagtccagaccaacttgagccacatgcctgtcttggagccagtttggagaagcaaccaacctggaactgatcgaagcccgcccggaccactgcacacccctggctgcctctaccacctcaagcaggtttcctagctcggtcccctgggctagtcctgagtaggtctcagggatgagaatccggattcctggggtttcctggaacctcagactcccaaagcagggctgtcccaacagcagcttcctggagtcctcactggcatcaacagtccccgtgatccggcttcctggagtcctcactggcatcaacagtccctgtggatccttcctgggttttagtccatgctacttccagaccctctaagctcattatttctggactgaaaagggatcccagcacctctagcctaggaggcccctcccaccacagccagtcacacagaggtgggcatggggcttggtgtgcagaaagagccctgacatggactcgggtgggacacccagacctgcagagtgacccggataagtcacaacttctctgggcctccgtttctccacatacaaatgctgggttctgctccacaggactctaaggttctcccttagttccaagatcctatgacttctctaattttctaatttcctaagtatcctaaattccctgctctcaaaacagctccctcccaccacctggtgtctcatacagcccttaaaactcagcataaaggccgggcacagtggctcatgcctgtaatcccagcactttgggaggccaaagcaggcagatcacgaggtcaggagatcgaaaccacggtgaaaccccatctctactaaaaatataaaaaattagccggacacggtggcgggcgcctgtagtcccagctactcgggaggctgaggcaggagaatggcgtgaacctgggaggcggagcttgcagtgagccgagatcgcgccactgcactccagcctgggcgacagagcaagactccatctcaaaaaaaaaaaaaaaaaaaaaaaaactcagcataaaaactcctcactaatgttctatcattcgagcgtcaagacagccatctgaagtaggtatttctgtccctgcggggaacacagtgagtcagcagcagacccagggctcctctttccaaagttcagtccactgctccataaacagccactttccaccaaccacaggcctcatcttcccatctctttcctggaaaaaatccaaccagggctaggcctggatactgcaggacccttggccaattccttctttctccatgaagctttgatgggggcagcccagatatcaggagtggagtattggggtattgggggtggagcaggagacacatcatctttcattgtgggtacccggtcagtgtcacacatgtgacagattagcagacctgaaatcagaggtaagtctgagaccagatgtgaaaagaggggctgtgttttctgaaacaaaaggttctgggaactgacaggacacctccgaacaggaaaggaagaggctggcataacagaaaccagaactcctggaagaagggaggtggggggctacatgggatctggcaggaggaagcattctgacagcatttcccacatccaggaggagacacgctagagggaagggagcatgcgcacacacaggcagcggctgtgcagcagaaggcgttcaacctctctggcttagaagaacagcagcctctccttttttctactgtgaagttatcgtcccagcagccaccccagtagaagaactgaggcagggctctgggtagccctctggtttacagttccagagttcctgatctaatgttgggaaatctgaatccaggctcccttcctaaacctgaccttgctggtgtggaaggggcttggattttggtctaagtcctaccacatacaaaagtcagctcatgcttatggctcctctcagagcctcagacaggggaattcaagtctctatgaggaataaataagaccatacctttttacatatgatgtaaagatacatcatatctttagaacttaatgtgagtccccacttagtgcactaaggccaggcatggtggctcatgcctgtaatcccagcactttgggaagctgaggtgggcagatcacctgaggttaggagttcaagaccagcctggccaacatggtgaaaccctgtctctactacaaatacaaaaattagccaggtgtggtgatgagcatctgtaatcccagctacttgggaggctgaggcaggagaattgcttgaactcaggaggcagaggttgcagtgagctgagattgtgccactgcactctagcctgggcgacgagagtgagactccgtctcaaaaaaaaaaaaaaaaaaaaaaaggccaggcacggtggctcacgcttctaatcccagcactttgggtggccgaggcgggtggatcacgaggtcaggagatcgagaccatcctggctaacatggtgaaaccccatctctactaaaaaaaaatacaaaaaaaaatttgccgggcgtggtggcgggtgcctgtagtcccagctactcgggaggctgaggcagaagaatggcatgaacctgggaggtggagcttgcagtgagctgagatagcaccactgcactctgctgcctgggcaacagagcgagactgtctagaaaaaaaaaaaaaacaacaactctaaaagatgcttgcaccatgcctgtcacccaagtgtgcaagatctcagcctgttttgaccacttgtgttgtggtcagttgggagtgggtgccctgtcatttggtactaataatagttgaagtaccaaagtctgtacactatttacagcagagtcacatcacatacacacgtaacttatgcaacttaaactatgtgcactcagggaaaaagaaaaggtaagaattaattgtcaggcaggacacactgatgagcatctaagccagagtgagcagttttcagcccctcatgcctcactgatcatgggccattgagtgtgacttaagggttttacttgacattgtatctttagaacttaatgtgagtccccacttagtgcacttttaaaaatactgcaaacagccgggcacagtggctcacgcctataatcccaggcagatcacttgaggtcaggagttcaagatcagcctggctaacatggtaaaaccccgtctctactaaaaataccaaaaaaaaattagctgggtgtgatctcaactactcaggaggctgaggcaggaggatcgcttgaacccaggaggcgaaggttgcattgagctgagattgcatcactgcactccagcctgggtgacggagcgagactctgtctcaaaaaaaaacgaaagagttccctcttcactttacccattctttcaagcctaaggaccacagacagccgttccactgcagagtaccccgtgaatgcttcatcagcacaactataaccccctattcatggcatacattgttggcagaggattatctataaaataaaggctcaaaattcttccaggcaccaagatttttatttacccaccttcctgctttcttttaacattataggccaaattattctctttttgacccagggttgtgaaaggaaccatctggttataaagtggtggcagatttcacgaaatctgcctgcattcatgtttttctggcccctctcaacccctagctgtcacttctctgttctttctcagttgccccttaacagtctattctaacccctgtaaaacagggactaaaagtactaacctcattgtaatgaggtttaagagaaggcccagcactaagccaggctctcaggaaaattcaaacaacagttcctctttgcccttcaatatagccccttctcatctgtcatgggctgaagaaccactggacctgtaaaccaagcacacaggtataagtccacagaccaggtgaaggcctagatggcaaaacacatgggctttgtgactccactactgacttccaggctaaggaaggactgacttagtgagctgttccaagaccactgagctcatggttccctgtggctgggacctccatcatgaccggggcttgaagagggtactctgttcccgctgccacatttggaacagtatgacggctgcagcagaggccaaaaactaagtgatcagccccagagagtcgatgggggacactgacaaaccaatcacaaagttggtgccattagctcttagggaggagaggtggggcctgggcaaggacagcagctggagggtgaaacgcagacctggctctcagtagcggtagtgatccggcttgaaggggccatcacaggacatgcccaggtactgggcttgcttctcagttagcttggtcaacttcacattcagcttgcccaggtgggcttcagccactgcctcatccagctggggagaaacaaaggaagaccgggaatcagtgccattttctgggacccctacacgcgtctggctgccaatagaggcagaagtgttctgttagggtttctgccatgtgtggtactcatgttaactctttctatcctcacacccagcctcagttaatgtgttgttttggctgcccagcccccctcaaaagggaaccatgccacaccctcccctacatgtggcttgacaggaccatcaatcacatctccttcctcattcttcaactcaagcagctaaccaaaatgcttctctggaattgatctatgcacaggacatattttccatgacaggcagagacaaggtgctccaaccccactgggattcctaaacagggaagggtatctatcaatctcagctcaccagttccaagtctattttacaagtgaaatgaagatagatccgagagacagaaggacagagccatgatgacacggaatcctaggtttccagtgtttggatccgagaataaagttcttttttttgtgacagagtctcattcggacgcccacgctggagtgcagtggcacgatctcggctcactgcaacttctacatcccaggttcaagtgattctcctgcctcagcctcccgaggagctgggattacaggcgtgcaccaccacgtccagctaactttctgtttttagtagagatggggtttcaccatgttggtaaggctgttcttgaactcctgacctcaggtgtcgaactcctgacctcaggtgatctgcctgcctcagcctcccaaagtgctgggattacaggcgtgagccaccgtgcctggcagattcgagaataaagttcttttttggattaaactggttgctttttttgattaaaatgtatctataaattctttgatactcctttaagaattagagcctaatccccaccgcctccccccaccccaccgagtgattcctttctaatgaatagaagaaagcagaagtgatggtgtgtgactttggacacaagttcatagagaccctgtggcttcctccttgctctcctctggatgacttactctgggggaagccagatgccatctcctgaggatgcataagcagccctctggagaggcccatgcatgaggaattgagacctcctgtcaacagcgatgtgaagaggatcttccagacccagtcaaaccttcagatgattgcagccctggcagaaatcttgaccgcaacctcatgaaagagcctgagtcagaagcagccagctaagctgatctcaaattcttgacccacagaaactgaaataataaatatttattatttgaagccagtaagtctgggggttagattgttatgcagcaagataactgatacactggtttgaatagtgtttctatcacttgtgaccaaaaggattctaatccactgccatcctccttttataaaatgaggaaatcaaggttcagaaacgtgaaatgacgtgtccacggtcaccaagctagtgaatgacagagctaggatttgaacccaggtctatctggcttcaaagccccaaaatgtgtctcaagcatcccagcttatggcctctagagcagctttgaagagattatgcagaaaccgaggaggacagaggcaagagttaaatacaagcaagcctctaactctctcatgaggtaggcctctccctacccctaagggaccccatcctgtcccatgatggcatggcggcctctgaccacagctcagcccacagcttttacattcccaagtggtttcacatctactgtttcattagagcctcccaaacacccttaagaagtaggatgggtgcggtttatccttgtatcttcagatgaagcaaagagcctgcagaaggtgatgtgctcagcagagaggcgggcaacagtaggaccagggcccagcctagaactgagtccacgtcagttccagaggtagaacgatggcctccaacccccacagtacacattgaaatcaaccttctgcttggcccggactagcccagaacttttccttctcccagcaccctgaaccagaaggtgtgtgtcacgtcctaaggtcaacaccttggacagacagagctaggttctattcctggcctgatacttaacatctgtgagagcaagtcggtctctacacctgactttccccattcgcaggatggatggatcactcatctctcaaggctgttacaaagatcagtgctactcagagtcattcgtgcagtaggtgacttaataaatggtggctgccttctctgtcattgttgaccaaggtacctagtcccttgcctgcatacagcatgtgaggcatgatgccaagagtgtcctgtccccaagccacatgttagcaatgatgaagaaaagtggtaaggacagggtcaggtgctgaggcgggagctttgcctctttcacttccaaccctgccctcatttcaaaggcctgaccaatttctcaccaaactcatagccatatttctcccaactgggattagatggggatcaagtgagaatctttcaaccccacaaccagctgcacagaacaaggtatgccttgaggtccttatgagtaaaatgtttggtccagcaagacattgctccagggagattagttgttggctggccctggaggcagatgccccaggcctcttcctgcgtcttcctcaattggtagaaccagcctttcaaaagatgaagggatggtatgtagaccccatcacagcttctccagcagcaaaaggctggaagagcaagagctactcttaccatttagctcataaggagactgaggattggacagggtaagggacaaagcaaagttcacctgtaaaactgccaagaaaagccaggactaaaacatctgtcctgaccccagggaagggtggactgcatggggtgttagggtgagcactggatttcatgtcagaggacttcatcttcatgagtatgcagaccatacaaccatagtgagatgccatgcttagggatgtatcttttttttttgagacagggtctcactctgtcaccaggctggagtgcagtggcacaatctcgtctcactgcaacctccacctcctgggttcaagcaattctcctgcctcagcttcccaagtacctgggactacaggcatgcgccaccatgcccagctcatttttttgtatttttagtagagatggggtttcaccatgttggccaggctggtctccaacttctgacctcaaatgatctgcccacctcggcctcccaaagtgctgggattacaggtgtgagccaccgcgcctggccagggatgtatcatcttattacaaggccacaacgtgcagcctgcagactgcactcagcttatacacatgtccaagttaacccacccagttattttttaaattataatgaggccaggtgcagtggccgaggcgggtggatcacttgaaatcaggagttcgagaccagtctggccaatatggcaaaaccccgtctctactaaaaatacaaaaaaattagccaagtgtggtggcatctgcctgtaatcctagctactcaagaggctgaggtgggaggattgcttgaacccggcaggtggaggttgcagtaagccgagatcacgtcactgcactctagcctgggcaacagagtgagactctatctcaaaaaaatcaaaatcaaaataaaattttaatgagttgcctgtatttgaaaatcattttgtatagagatcttggtatctctggctctcctgaaaggttagaagccctggtcagacggacctgggttcctaggtggcaaccagccctttaccccttcagctcttccagtccttgttcagctggcatcactcatttacctgcctagcccctgtgggtgtgtgggttcatgatctcaggaaatcctcacaatcctgaagggggttgctattaccttcatttcacagatgagaaaatgaagacagagaaagaatttgcctggattacacagcctgtaagtggtggggctgagattcaaactggggtgtgtcccgctccaaggcccaggctctcctcaccacctggtcctgccgctctgctgtgctccagggagccactccctactgtgggtctcagtttcttcttctgtcaatggggagaatgacttctgcactgtagaggaccccatgagggcctctaagagggcagacaggcaagcactttataaactctggcaagccctgtgtggggatcccaggattagacacgtgacccttggcttgaggtagaagaataaacccaccttcttgggcaggaaatgaaccccaacggggtacttgtctggatgggtccacagctcgatctgcgccatcacctggttggtgaaggagttactcatcacgaagctggggtggcccatggcacaacccaggttgaccagccgaccctcggccagcaggatgatgcggcgcccattcttcaaccgataccggtccacctacacgcaggcagggcaacagtgaaggcaggcagggccccgctcccacagcccaccctctgatctggcaggcctctctgcctccaacagtgcccatgaggagtccgaactgctccaaaacaacctccagcacatggcttagcacaaaaataacagccaatatttattaagaaatgttgagctggccggggcacggtggctcacgcctgtaatcccagcactttggaaggccgaggcaggcggatcatgaggtcaggagatcgagattatcttggccaacacagtgaaagcccgtctctactaaaaaaaaaatacaaaaaattagccgggcgtggtagcaggcgcctgtggtcccagccactcgggaggctgaggcaggagaatggcgtgaacctgggaggtggagtttgcagcgagccgagatcgcaccactgcactgcagcctgggcgacggagcgagactctgtctcaaaaaacaaaaaacaaaaaaacaacaaagaaatgctgagctgcagactgcacagttctgctgtgagaacttcacgtgctcacacttgcttggcgcatatgaggcactcagtaagcagcagctaatgttatcgttatgatcactgtcatgtgccctgtactaagtcctttacaggtaactaccacatttcatcccagaaacaaccctgtgatttcagtactgctgtcatccccatttcagattcagaaactgaagtttacaagggttaggtcacttgtccagagccacacactaagaggaggctgcaatttgagtctggacggtctgaggacagatcccatgttctcaataaccatgaaatagttttgaatgcagcttagcaaaagctgaatgccgtggcgctcacattggaatcacctcagaagctttaaaaaatgaggatacccaggccagacgcggtggctcatgcctgtaatcccagcactttgggaggccaaggcggggggaatcacctgaggtcgggagttcgggaccagcctgaacaacatggagaaaccctgtctctactaaaaacacaaaattagccaggcatggtagcacatgcctgtaatcccagctactcaggaaggctgagccaggcgaatcgcttgaacctgggaagcggaggttgtggtgagccaagatcgcgccattgcactccagcctgggcaacaagagcgaaactccgtctcaaaaaaaaaaaaaaaaaaaaaaaaagataccttggcctcattcccagagactcctattcctgtggcccacagtgtggctcccaggtgactgccaaggttgagaactcccggtttagtgagtgaacgtgacatggaaatccccagcctcagtgccccagtcctccgtctgtcccagctgtctgaacacacaaacttgctttctccccactcccagctcttcccttgccatccctccaccctcaggcagcctcccaaacatttccccaaaagcccaggtttccaagctgctccagaggcctagtaccgatccaaggaaaggtctctgatgcccatcaggcattgattgatgcttcaatcaataagcactcactgatacccatctaagccccttgcagggacacgtcaacctggactctaccctcctggtacaacagtggggtcagagaccaaagccagtgatggatgctgcactaggggtctgtactaagagtgtgggcattgcctctgccagaggagctggccaggaagggggtctcttttttattttattaattttttttttttttttttttctgagacggagtcttactctgtcatccaggctggagtacagtggtgtgatctcagctcactgcaacctccacctcctgggttcaagcgattctcctgcctcagcctccagagtagctgggactatacgcatgagccaccatgcccagctaattttttgtatttttagtagagacagggtttgaccatgttggccaggctggtctcaaactcctgacctcaagtgatccgcctgcctcggcctcccaaagtgctggaattacaggtgtgtgccaccgtgcctggccagaagggggtctcttgagctgggctgagaagatgaacaaggagaagggcatgtgttctgttccagacaaatgcagctgtctggacagatgagcagaagtaggagctgcagtgggtattcagggagtggtcaattatggcctgagtacagaggcccttgagaggacggacaagagataatgttgggcagaaggttggcaagactgtcaaggatgttgagggtgggcatagagtccagctttggagggcagcttggcagaaaggtgcccatcaccccaatgtagcaggtttcacctgtgatgcctttgcaaaaaggaggtctagacagatggctgtcaggggtgtggctgccacagaagcacgccctggccacccccacactgtgatgagtgccaggccttctaggcagagatggaggtgccctctgcctagccgggaactgacaccctagactagtgcaggacctagccaaggagaactcccacgcaggagcagagcacccaagaggagcagtgtaggggatgtgggttcatagagctgcctgtctgcctctctgggacttgggcttctggtgtggctgtgactgggtgggtgtcagggctttggccaactctgtgtctgtatcttccttatcatatctcaaacacggcacagcaccaactcaaagaacctcacataggtgggcttttctccctttaaaaaatgtggtggacctggtgtggcagctcacgcctataatcccagcactttgggagataacttaagctcaggagtttgagaccagcctggggaacacagcaaggcctcgtctctacaaaaaataaaaagttagccaggtgtagtagtgcacatctgtagtcccaggtacttggaaggctgaggcaggaggatcagctccttcagcccaggaggtcaaggctgcagtgtgccatgatcatgccactgccctctagcttgggtaacagagtgagcccatctcaaaaaaagaaaaaaaaaatgatgaacatctctacatacatatttaattatcctaaggaccaattataggagagattgcccagtcaaagaggttgcttaactttaaagctcttgatatccaaagccaaaatgtcttccagaaacatactacttttataatcagagaaaaaaataaactcataataattgcaactcaagtaaaacttcacaccccctataagaactcatcttccagtttcagtgccccaatgcccaatgcaaacctgttctttcccagctcagtgcatgggcctgctcctcacacagtgattcaagctgtgtccctttttgttttttgtttttagttttgtttttgagatggagtctcgctctgttgcccaggctggagtgcaatggcgcaatctcggctcactgcaacctctgcctaccacgtttaagcgattctcatgcctcagcctcccgagtagctgggattacaggcacccaccaccatgcccagctgatttttttgtttgtttgtttttgagacagagtctcgcactgtcacccaggctggagtgcagtggaacaatctcggctcactacaacctccatctcccgggttcatgtgattctcctgcctcagcctcccaagtagctgggattgcaggtgcacatcaccacacccggctaacttcttgtatttttagtagagacggggtttcactatgttggccagactggtctcaaactcctgacctcgtgatctgcccacctaggcctcccaaagtgctgggattacaggcatgagccactgtacctggccttttttttttttttttttttgagatggagtctcactcttattaaccaggcaggagtgcgagggtgcgatctcggctcactgcaacctccgcctcccagcttcaagcaattctctcctgcctcagcctcccaaatagctgggattacaggtgcccgccaccacacccggctaatttttctatttttagtagagatggggtttcatcatattggtcaggctggtctcgaacccctgacctcatgtgatccgcccgcctcgacctcccaaagtgctgggattacaggcatgagctaccgcacccggcccagctaatttttttgtatttttagtagagacggggtttcaaccatgttggccaggctagtctcgaactcctggcctcaggtgatccgcccatctcggccttccaaagtgctgggattacaggtgtgagccaccatgcccggccaaagctgtgtcctttgttactctgcctccatcctgaccccacatgccgtccatccaccccagcactccctaagctgaggctgccatcatcccctgcagggattctacgagcctcctctaaaagcctctctccccaccacccgccattgttgcttttattctgcacacagtagctagagtgatctttctaaaactacagcctcaccacatacagctcacctgcctgataccttcagggatgccggctgcccacaggataaggttgccacgtctggctggctctgatgctaggccctcttctccccatccccctgcacaggttgccaccatctcctcagctctcctccctggcagccagcactcctctgcactcccatctgcccagcccactggcaaggcgggagcttctcacctgcggcttgatgttcaccttctccacggcgttctcgttgagccacttgacatcgatctccacgtcaaagtgtccaatgttacacacaatggcatcatccttcatctgctcaaagtgcctgtcaggcagcccaagaccgtgggagattgtcagggacagaaagctgtcccaactctgccctcctccctcactccccgggaccccccatctggcacctaccggccaaggatgatgtcaatacagcctgtggtggtgacaaagatgttgccctcctgacaggcctcatccatggtggtcacctcatagcctgtgcagagacagtggctgtgggtcatctacggtggccttgcccctccctctggccccagtggctgacaaccaacccttgccctatcctaccctccatggcagcctgcagtgcgttgatggggtcaatctcggtgatgatgacgcgggctccgaaaccccgcagggcctgggcacagcccttgcccacatcaccatagcctgctaccaccgctaccttgccggcaatcatcacatctgtggcccgcttgatgccatctatgagggactcccggcagccatagaggttgtcaaacttgctctgaaaggaaagggggtaaggagacaataggggcaggcaaggccctggggccaggacaacttggcctcagagtattctgaagagcccaggcatcatgggcccaccaagcatcccggcctgggctgaacccctccagcacccaatgcccccacaagcccttcaccccgatcggctcaaagagcttctctctaatctttctctgccagtgtggagccttcctaggcatcagttactaggagagattgcccggtcaaagaccttgcttaacttgaaagctcttcttcccaaagccataaagctcctaacacccagctctgacaccccttttaaacgcactcattagcctgtctataaccgcttttgccccctcaaatgagggcttcatgtccctaatctcagccttcctgggcactcttcttcagaggcctcgtcctgagctgcagccactgtagcgggagctgtcactgcccctcggctcaccttggtgacggagtcattgacattgatggcaggcaccttgaggatcccattggccatcatcttgtagaggttgtggaccccagtcgtggtctcctcagagatgcctcggatgcctaaacaagaggggacaggacaagcctcagagatgccacacctgtgctcatgcaaattcctcatctttaccccctaaagccattcctctttctgggttcccatctctgtgactgatcccacaggccccccaatcacccagacccgcgtgagggaggagtccccaacgccctcctacagggaagccaccaccaggcctagtgactctgcctccgaacaactcccagcttctctattctcactgccgctgctctagtccgtgaccctgtcgcttcttcccagtctccctaccacaacccatcctccatgcagcagccatttctaacatgtatcttctcagagaaatcttctcaacgccctccagttatttccccttgctctgcaaatcaggtcaaacacttttctattggcctattaggccctgacacatctggtcttcacgaagttcacaccatacccgcagtgaaggctccctttgctcactgctatcctgtgggcctcttttctgtttcctgaacactccagccattcctgcctcagggcctctgcactctgcgtacctgctttgaacaaagctggctccctcccagctattcccaaccatggccctgtctgtgcctgcccttgggccatcagctcagctgccctagcctcgcaccctcagaagtcaggaggccccagcatgaatgccagagcctgccatcctcccatcttccagatcctgctgcttgaggtgatgggagtcctgccaggcctgcggccatcatgtgggcaaacaggccccacccaggccaccagcacccagcccacctgccccgccctgctcacctggcagaagctgcgggtacttggtgtggatgaggttggtgaggtcgcccccgtcgtccagaatcatgttgaggggcccgtccttgaagtacagggtctgctcaatgcaccacaggtactcctcgtccgtttcgcccttccaggcatacactggagggtgagtggcacatcagggcctggacttcccaactggtacctgctccagggaacaactctggcagagccaaaactacctccttcccaactcccatccccagccacctccggcccctctgaaaactcagcagtggtcaggacacaacttggagccagatagatctgagttcaaaccctggctctgccacttgccagctgtgtgaccttgggcaaatcacttcacctctctgagcctcagtcttctcctctgtaaatagggctcacaatagtatggattaagtgagacagaagccatgtacagccccccgccccagatatagatatcaggaaatcattctttcctttcccatccccttctgcctgggcgccaaggactgaggcatcaaccctgagtgaccagggcttgataccccacaacgcctccccctcagcaggatccacacggcaggatccagggtttgctctgcactgaaaggactggagcactagcagcctctgtgtgggggaatctcaggcaaagtctggccaaaaaatgactacgagcagctaccatgtgtggggtacttgctttctgccagacatgactctaaatcctccataccccatctcattcttcctcatagaaaccctgtgaggcagccatgaccattatcatcacttacagatgcccagagaggagctaagacgcacttgggccactctaaatgaaattccagaatagacaccagaactgagggctactgaccaccagcccacactcctcccatgtggcatgactagggcacaggtgtggggttcccaggagcctcttgtgagcaaaggacgctggccaagcagagccagctgcttctacccacaactggagcagacaatagtcttaagaattgcagtgagccaagatcgcaccactgcactccagtatgggcaacggggcaagactctgtctcaaaaagaaaaaaaaaaaagaagaaagccacggtgccaaggctgaggaatggggatcatgcccattcagccctggtcagtctgtgaaggagtgctgtgccaccccctcctgtccacctgtggttggttagaagcaatcttgaatgtcctaatcactgggtcagatctaaccactcccctccccaagtccaagcagacatgtgcccagcctgtgaaaactccattctcgttagacttggtccttcctcagtcctttagaccgccataccctaggcagtgaacctctttttctgccccgtagccctccccagttctttggaaagagatccacatccttcctttaatgaacttcccctccgcttcatcatgtagttcccaatcataagatcttgctcttcctggttacacggcttgacctgggtcaataaacaacttccacaggattttagatgatgatgggacaaagcagctctttcctgtggggtcgctgggctaggattttgtggcggtgactcctctccctttctgatatgtaaggaagtctgttgctctagcagtcagtgaagcaaagagggcagaatcccttcacaaattccacgtctcagaagcaagcaggacttacccggaatgccagccttggcaatggcagccgccgcatggtcctgggtggagaagatgttgcagctggaccactgcacctagaagagccatcaaaacaaggctgttggtcactgatggctcaaaagcaccagggacgctgggcgaggaaaagggagagcttcgggtagtggggagaggcttgggatctaggcacagcaagctctaggatcacaggctggggatgctgggtgggcagatgggagccagagcaggggcgagatccaactcaggttttaaaacctcactccagtgctgtgtggaagggaaagggtggaagcaaggggacaactgcagagactgttggagaagactccagacaagaaatatgacagtagcagtggagatgatgagaagttgtcacatcctgggtctactctgaaggctgcactgacaggatttgcagagggatgagttgttggagtaaagggagttgggagtggggaggaaagggaggggaggagatgactcccagattcgtgaattgagagaacccagaaggctggaacagaggttccatttactcaggtggggaaggctttgggaagaagagggggcagaaaatcctgagtctgtttgaacgcgttctgcctgagatgagtactagacctccagggagcgtcaacgcccccgctcctggatatgccagtcttgagttccaggagaagtccaggctagtacaaaaatgtgacagtcatcaccagatagtgtctaaagctataaaatcagaccgccaagagtgaatgctgaaaagaaagaagaggtccaaggactcagccctgagcccctctgtggattttggctccattgccctaccctgctttgggaaaccagcttgcttcttgactctctgagaccttaggagagctgttaatcattggcacacatgacccaggctgaaccaatcagagctgccatcatccagcagccatgatgggtccagggtaggcctgtgacccccgaagggccaaggcaagctggcccttaagagactaagtaggacatgggtgttgaatttttcctgccagagcatccatcaggaggatgccttgagggtagccaacagtgaccttcccagccagggagaaaatctgcagaacactcaccacaaggggtggcagcactgggaaacggaggaaaccgagtgagagggaggaacccctccaggcccgcggtcagctccacacctggaaggtccccaccctggcacagtcgtcttcttccctggctgaacccagggagggcaaggactctggggtgatacagctgtgggcctcacctcagcacccagggtgacgagggtctcaatgaggacggccgtctccacggtcatgtgcaggcagccagcgatgcgggcgcccttcagtggcttggaggccgagtaccgctcccgcatacgcatcaggcccggcatctcgttctcagcaatgtccagggccttgcgtccccaggcagccaggccgatgtcggctacgggaggaaacaggtgggagttccgtgagtcccctcatcccaccaaccaagaggggcggtcactgcatggaccccgatccacgtgtggactcaacacactagggcttagcactctgtcaccgcattctctcactcatgcaacaagtatttatgaagccagagtactcaagaaagacacggtccctgcctacctgcacctttctgacttgtgggagaacacatttaatcacacagggacacaaaaattacaacataaagaagcgtccctttgaaaaatagctcacatgatacttcccactaccctgcctttctgctgacacctaccaacctccaggccactcctcactccctaaagactccctaaagatgttagctgctggttctccatcttcctctctcagtcatcactctcggtgattcaacacttataaatactatctaacattttggatttgacagttccttgatctccttttagatgtaaaaatgcttccccactcctgatgtttctttccacctggaggaactcatccgtataacgaatgctcttggcctctctgccccaggggaggtggggtgagcttgtctgaccagtaaaactgagaggaaaaaatggtgtgctcagcttagctctcccttctttttgcaagcaagcactcacctgcccacttgcaggaagctggtgttctctgcttttccagagaccaacctaccctggcccaccttgcctgcaactgattgggtaactgctgaatctgggggttcaataagcaggatcatttggatttcatattaatctatatcctctggctttgaggttattagtaataaaaggtaatatttcaggtgttgccacctaaaatactaatctacatcctctggcttcatggttactagtaacaaaaagtatttcaggtgctatctgccacctaaaatgtctcgaatttgttcaaattctcaggcaggaaagaaggatattattatgagctaactcactatctcaatactctcccctaccacactggtccacttccaaggtcataccctaggtcagtccctaggtcaaagtttgcagacttccccggtaagggatgttcctctggcatgcttgtaaatctcccctggaaaatatgattcagcaggtctaagactcctggtgatttttatctttagggaagctgagatcctgccaaacacccaaagaggtaggcggtgggaggcaaaggactctgtagagaatttaataatctaagaatttaataatcaataaaattgtctgtcagtcagcttcctacagtgcattttaacaatttcagagatgaaacacgcctcccgcatgagagaccactccggctgtgcctcaactcaagccacccaccccagccctcctaccctagtaggccatcaccagtgatagctctccttggaaatctggacttcaagcacccaactctagccacgcctcatctttctggttttctccttccagaggccaagctccaacaaggctgtggcctgtcaggtgagaacctctattcaattcatcctaccaatttctagtgtcccttctaccccctttccctttgagaactcacttggcaaaactctcagcccaattaaacccgaccctccactgcaccggacccactgaacccagcaggaggacaatcacaaccccaccaagacatcatatttaattaattaattaattaattattttagagacatagtctggctctgtagaccaggctggggtgcagtggcgcgatctcggcccactgcaacctccacctctcaggtcccggttcaagcaattctcctgcctcagcctccccaatagctgggattacaggaactcgccaccatgcccagctaatttttgtatttttagaggagacggggtttcaccatgttggccaggctgatcttgaactcctggcctcgtgatccacctgcttcagcctcccaaagtgctgggattacaggtgtgagccaccacacctggccaagatatcatatttattaagaccataaaagacacatagcacattgcagcaatcctatgacattttcctagtaaatttactcccattttctactctcctcaaccctccaacacctttccccattgaatgacaatctcacttcccaattcactgagatgaattcagaaccaggccacttttcccctatggaatccactagtcacctatagcagtcatctacagcttcagaccaggcactctttcctgttaccacagatgagttgaatgggcgcggtggctcacacctgtaatcccaacactttgggaggccaaggtgggcagatcacttgaggtcaggagttcaagaccagcctgaccaacatggtgaaaccccgtctctactaaaaatacaaaaattagccgggtgtggtggtgggtgcctgtaatcccagctactcaggaggctgaggcaggagaatcacttgaacctgggaggcagaggctgcaatgagctgagatcatgccactgcactccagcctgggtgacagagtgagactcggtctcaaaaaaataaaataaaatagatgagctgtcctgtgggcggcaagccacccaggcaccgaggcaagagacagaggacacgagctgttccagtataataaaatataaaacaagaatagttatactagatatagatcttatatatgattatatatgaatatcattaatcattagtttgtagcaattactttttattccaatattatgataatccttgctctataatcatagcctaggaaaaaccaggccatacagagataggagctgaggggacatagtgaggtgtgaccagaagacaagagtgcgagccttctgttatgcccggacagggccaccagagggctccttggtctagcggtgacgccagcgtctgggaagacgcccgttaccaggcggatcgtggtccagcggtagcaaaaggtgtcaaggaacaacacccgctacttagcagactgggaagtggcggcggcgggaggggggggggtgtctccctttccccaggggagtttagaaaagactctgctcctccacctcttgtagagggcctgacatcagccaggctcgcccacagttatccagaggcctaaccatctccctgtgatgctgtgcttcagtggtcacactcctagtctgccttcatgttccatcctgtacacctggctatgccttctagatagcagtagtaaattagtaaaaatactaatagtccctgatatgcagaaataattgcgtaagctgtctttctctctgtctcctctccctccctgcctcggctgccaggcagggaagggccccctgtccagtggacacgtgacccacatgaccttacctatccttggaggtgactcacattctttaccctgccccttctgccttatatgcaataaataacagcgcagcccaacattcggggccactaccggtctccgcgcattgatggtagtggtcccccgggcccagctgccttttctcttgtctctttgtcttgtatctttatttctacactctctcgtcgccgcacacagggagagacccaccgaccctatggggctggtcactacactatccctgctccatggggcctgattccatatcccctctcctccttaaggacttccatactccactaaaactgctcttccgtccaaagaccagcctgatctccatacctgatgcaaaattacctaagaccatgtttctaccagcagcacagattgcatgaatgacttgccctccttcctgaaaccctttctttacttggcttctgtgactgtcctgtgcttttccacctaccttcctggttcctctttagctaacagactttagggtttgggggccctcagggctccatcatctcccagttctcttatgtttaccaattaagctcatccagtcttatggctttacataccttctctacggggatgactcccacgtatttatatccagcccaaactactcccctgaacttgagactcgatgtgatccaactgcctccacagcacctccacttggatgtccagttggatctattatgtgtcatgttggagtcctcatggctcctttgcccccactaccggttactctcccaatcttcccattttaggaaatgaaaccaccattcaaccagctactctgcccaaaaacttaagatttgattcctcttttcctctttcacctcaatcagcacgtttttggctcaacaagtgaaatatataagcaatccaactgcatctcaccaccttcatctaaactgtcacttctcaggctgggcgcggtggctcacagcctgtaatcccagcactttgggaggccaaggtgggcggatcacccgaggtcagaagttcgagagcagcctggccaacatggtgaaatcccatctctactaaaaatacaaaaattagttgggcgtggtggtgggcacttataatcccacctactcaggaggctgaggcaggagaattgcttgaacctgggaggcggaggtggcagtgagctaaaatagcaccactgcactccaacctgggtgagagggagactctgtctccaaaaaaaacaataaagaaataaatacactgccacttctcagttggacactgccacactctcttcactggtcccatgctctaacatgccattctccccacagcagccagaagagggaggctcttaaaaatttaagttacatcacctccatcattctactaaagtaaacaaaactaaacaagcaaaccctccaatggcttccctcaatcttcgggccctatctgcatgactgcctgcccctcctccatctctccactttccccactcactagctgttcaacacacaggcttcctgactgacttcaggcaagctccactcatttccacctcagggctttaacccaagcagttctcggcctggaaggctcctctcaagcacctaatacagtacctggcacacagtaggtgctgaaaaaaacctggaaacaggaaagaacctagtatatccctgctagaggaaccaagagtgcaccagggtgactcaaatagaggcataagatgagttgggacttcagtcccagtgaagtggggaacctacagttttcaggggccagcattcagagaccagatttgtcttttgaaaagaccccattggctgctgtgtggatctgcggagcaagagatccagggagacctgcaaggagagagaccagactggggtggtgaccgtggagacagacaagtggcagatctgctcacataaaatggagacaatactactttatctgtatgcatgtctgtgccacccctgtctctgggtcacctttgtgtctccagcatgacctggctcagagaaggggtcagcaactgtttaccgaccatatctgtcctcagaactgaatgaaagatccatgagaggggctggcacgtgacaagggtggcaaagaaaaacaacacaaatctgaacctagtctgagtcccagcatttactaatgacccagagaggacccagagaggagtttgctgcaggttccatagccaattaaccgcagaaccagaactggcagccaggcagggctagagcagaggcccctctcaaggcccctcctgggaggggcccggctgtatgggacaatgggttatgccctgtgctgctaagctccacccctccaccaccacatgtccctccagctaaaaataactccttcagtgccctcgaggacactgtgccagccccacagttttccctgggaccctcaactccaaaggcacaggagaggctagatgctgcaatctctggagctaaggacttgcaaaagtcacaggaacacctgtccccaggacaagccaagaggaacagcaagagcccctgtaaacatcagtttcttcatctgtaaagtgtggataatcatccctagcttgctatgcgccttaagtaaagataatgccatatgatcaagatctggcatacagcagggcctccttcctccagccccacccagctaagctccccatccccaaatccagctttatctccacccacacaacccaatggccccaatcctgacccactaatctctccacagtatgacaagcccccattccagctctactattgatgtgaccttcacataacctttctgggttcagtttcagcatccacacaatggagacagtctactctggtagcaacttgatgaactacttcaacagaatctttgcaagtcacctcccaagggcctcagtttcatgctctatataacgggattacgtccacctctatgaagattattgtgtaaacacacgtaaatcaccagatatacagcaagtgtttccataaatgtggatggcattctccagacttaatagtgtctttttttgtttgttttttttttttgagacagggtcttgctctgttgcccaggttggagcgtggtggtgcaatctcggctcactgcaacctccgtctccccggctcaaacagtcctcctgcctcagcctcccgagtagctgggaatgaaggcgcccgccaccacgcccagctagtttttgtatttttggtagagatagcgtttcaccacgttggccaggctggtctcgaactcttgacctcaagtgattcgcccacctcggcctctcaaagtgctgggactacaggggtgagccaccacacccggtccaatagtgtcaaagttacttgaaaagctaccagccaaactgaactggtttttgctgaaaattcactaggattgttccgcgtgtattcgcttgcacacagtggtgaaagggtgcgctcagagatctagatggcctgcgttccaatcttgctccatcaccaccagctgtaagactgagggcaagttacctctgcctcaggattctcatcataaaatgagaacagtttccctatagagccatgagactagaataaagctagaaggcagtgccgatcccacaggaaacactaagtaaacgttaactatccctgtattacacttcaatcggtgggacagcaggatttttcaaaccactccaaattttcttcgagatttctgcaaggctgcccctgctggaggggtgggggaccccacaggttgggtaactggcccaaagtcccaggggagaggaggatcggagccggcctggggctcgctttccaggcctctcctcatacaccctccggggtgccctcgccgtccctgtaggaggcccagagaggggtggacgctcgtcggggccgcccagctggacagggtccggtccaggcctaggaggccgggcgcaggccccccgagcagggtccggcaggtgccagccgtcccaggccgtggccaggtgtgctctcccgcggagcacgccgccagtttgcggctcgcagaccgcgcggcggccccggcgtcgcggggcatgctgggacttgtagtccacggccacccggaacggcccgctcatggccgcgcgagaactccaacttccagctggcttcgcgcggccagaaacgcgccgaggctgcgattccagggggtccagagagccccgagtcggccctgcagcccccgccacgaacaagccccgggcgggtgccgggcggccgcaaccggctgcaggtcctgggactcaccgactttgtagggcagtttgtcagacatgctggcggcactcgtgatggaaacgggcgaagggggctgggcctcagtctgggaacaggaactgggcgggcagcgccgagcagggatatgcgcgtggcgccgacgcctttaaatatcttcctcgcacttgcatattcatgacccgctggggcggggcccaacgcgcagggcggagccggaggggatttcgatccctgaaaagaagcctcagaatttcacaaggcgtggccccaggagtctcactcaccggtccggaagggagcgccgggagaggcctgagagccagccgggccgtcctctcgctggttcagccagttgattcagtgtcaaaacccagcggaactgaaattccgccagttcacttccctgtgcctcaatttcctcatctgtaaaatgggccaaatgacatctgccacacagattattataagtaaagttgcaggccaggcgcggtggctcacacctgtaatcccagcactttgggaggccaaggcgggaggatcgcttgagcccaggagttcaagaccatcctgggcaacacagtgagacctgaactctacaaaaaaaaattaaaaattagccgggcgtggtggcgcgcgcttgtggtcccagctacttgggacgcggaggcgggagggaggatcttttgagcctggagatcgaggctgcagtgagctatcatcccaccacagcacttgagcctgggcgaaagggcaagaccctatctcaaaaaaaccaaaacaaagttaagttgccatttgtcaggtacctactgacatcccaaacattcgccttactccaagtaaccaacaccctgaatttaagtaagtttgcatacatttcttatacttttactgcatccgtatatcattaaatagttctgtgtttagcacctttatatatcaaccgtatttacccttctgcaacttgcttttttctgtgagcattatatttatgagactcatgcatatagcttgagtatattcatttttgctgctgtataattcagtcatcccaggcatgggaaggggaaattggtttcaggacctctgtggactccaaaacccttctatgttcaagtccctcatataaaatgaggcagtattggcatataacctatgcacattcctccgtacactttaatcatctctagattacttataactaatataatgtaaatgctatgcaaatggttgttttgtaatttgtattatttttatagttatgtttttttaattgctttttttcccctgaatttttttttttttttatggagtctcactctgtcgcccacactggagtgcagtggcaccatctaggctcgctgcaacctccacctcccgggttcaagcaattctcctgcctcagcctcccgagtggcttggattacaggcacgcaccaccacacctggctaattttgttttttctttttttgagatagagtttggcgcttgttgcccaggctggagtgcaatggcatgatcttggctcacaccaacctctgcctcccggattcaagcgattctcttgcctcagcctcccgagtagctgggattacaggcatgagccaccacgcctggctaattttgtatttttagtagagacggggtttctccatattggtcaggctaatctcgaactcccgacctcaggtgatccgccagcctctgcctcccaaagtgctgggattactggcgtgagccaccgtgcccggcctctactcattttttaacctaaaaatgagaaaagaattaaactcttctggccgggcgcgtggctcacgcctgtaatcccagcacattgggaggccgaggcgggcggatcacggggtcaggaaatcgagaccatcctggctaacagggtaaaaccccatctctactaaaaatacaaaaaaaaaaaaaaattagctgggcgtggtgtcgggagcctgtagtcccagctactcgcaaggctgaggcaggagaatggcgtgaacccgggaggccgagcttgcagtgagccgagatcgcaccactgcactccggcctgggcgacggagggagactcttgtctcaaaaaataaaaaataaaaataagaattaaggtcttctatgacatagtaaatgtattggtctcacttgatctgtacatctgacctctgtctgagagtcatgagggccgatgtcaagcagagacttcctgagggaacgagggtccacgcctgggaggtgggcagcagggtcctcacgcatccctttcagcattctgcagtgcattgcagtgtgtagtgagtcgtgtcagtctaactaaacgtaggatcatgttactaggttgtcctacgagaacagaaaaatggcttcaaaatattcctgcaaagaaatggcaagttccagatactgtgaaaattaccagcacagcaaacaagtagaaaaggacacagctgacaggtctctttctggtatgaatgctggtctttgtcagccatgttgtaaggaatgtaataaaatttgagaaaacaatgaaaaagacactttgaaatatgaatttacggaccaggcgcagtgactcacacctgtaatcccagcactttggaagccggggcgagtggatcacttggggtcaggagttccagaccagcctggccaacatagtgaaaccctgtatctactaaaaatacaaaaattagccgggcgtgatggtgcacgtctgtaaactcagctactcaggaggctgagggacaagaattgtttgaacccaggaggcggatgttgcattgagccaagattgcgccaccgcactccagcctgggtgacagaacaagactgcctcaaaaaaaaaaaaaaaaaaagaaaaaaaaagaaatgtgaatttacatgccctctcattaattaatgatgactctcatcctcactgtatatcgtgctttgagatatcagctaatgagatatttgctaatatttgtaccgttaagttcatatgaacaaaactttggagactgctggtctcaggagaaggtctaagcaccttagtctggccttatgcaacctctctagcagcagaatgttctagcctatggatatattgcaattgatatagccaatttcctattatttcagcttctttttttttttttttgagaaagagtgtctctctgttgcccaggctggagtgcaatggtgtgatctcggctcactgcaacctctgtctcccaggttcaaagtgattctcgtaccttagcctcccaagtacctgggattacaggcacacgctcccacacccggataatttttgtatttttaatagagacggtgtttcaccatgttggccagactggtcttgaacttctgacatcaagtgatcctcccgccttggccttccaaagtgctgggattacaggtgtaagccaccacgcccagccaggttcttttaatggatgaacagttaaacaaattggtacagccataccatgaaataatactcagcaaaaggaataaactttgataaatgcagcaacctggatgaatccttagagaattatgctgagtgacaaaaaccaattccaatatattacatagtatattatttcatttctataatattcttgaaatgaccaaattatagaaatgaaccacagattagtggttgccaggtattaggtaggggacgggagcaagagagaggtaaatgtggctgtaaaagggcaacatgaggaaactttgtggtgatggaatgttctggatcttgctttatcattgtcagtatcctagttgagatgttttattatggttttgcaagatgtcaccattgggagaaagcgagcaaagggcattgggatttctctgtgttttctttgtttcttttttctttttctttttttttttttttgagacagggtctgctatctaggctcacagcaacctccacctctcccaggctcaagccattctcctgcctcagcctcctgagtagctgggattacaggtgcatgtcgctaccacccggctaatatttatatttttagtagagatgggctttcgccatgttggccaggctggtcttgaacctctgacctcaaatgatccacctgcttcagcctcccaacatgctgaggtttttttgttttttgttttttgttttttttgtcggagtttcgctcttgttgcccaggctggaatgcaatggcaaaatcttggctcactgcaacctcctcctcccaagttcaagcaattctcatgcctcagcctcctgagcagctgggattacaggcacatgccaccgtgtccagctaattttgtatttttagtagagatggggtttctccatgttggtcaggctggtctcgaactcctgacctcgggtgatccgcccgccctggcttcccaaagtattgggattacaggcgtgagccaccgtgcccagccccctgtgttttcttacaactgcacatgaatctacaattatctcaaaataaaaggtttaattacaaatgataatgttcattgttggtgagtgtatggcaaagttttgtcacccattaaattaaaaaaattttttaacttttattttagttcaggggtacctgtgccagtttggtacataggtaaactggtgagttgggggtttggtgtacagattatttcatcacctgggtacgaagcacagcacctaagtttttttttttctaaacctctcccttttctcaccctcatccctcaaatagggcccatgtccattgttccctctctctgttgatgtgttttcattatttagcttccacttataagtgagaacatgctgtatttggttttctgttcctgggttagtttgttaaggataatggcctccagttgcatctatgttcctgcagaggacatgatcttgttcttttttatgcatgcatagtattccatggtgtatatgtaccacgttttctttatccagtctaccattaatgggaatttaggttgactctatgtctttgctattgtgaatagtacctgttaaattttaaaagatttggccaggtgtggtggctcaggcctatagtcccagcactttgggaggccaaggcaggtggatcacttgaggtcaggagttcaaggccagcctggccaacatggcaaaaccgcatctctactaaaaatacaaaattagccgggcatggtggcatgcacctgtaatcccagttacttgtgaggctgaggcaggacagttgcttgaatctgggaggtggaggttgcagtgagccaagattatgccactgcactccagacttggtgacagagagagactctgtctaaagaaaaagaaaattttttttaagtatttgaaatccataattatacccaattttggagagtatcaagactaggaaccaaatttctgaagggtaattaatttggcaattttttttttttttttgacacagagagttgctctgtcacccaggctggggtgcagtggtgcgatctctgttcactgcaacctccgcctcccgggttcaagcgattctcctgcctcagcctcctgagtagctgggattacaagcacccaccacgatgcccagctaattcttatatttttagtagagacggggtttcaccatgttggtcaggctggtcttgaacttctgagcccaggtgatctgcctgcctcggcctcccaaagtgctgggattacaggcgtgagccactgcgcctggccaattttttttttttttttttttttgagatggagtctccctctgctgctcaagctagggtacagtggcacactctcagctcactgcaacctccgcctcctgagttcaagtgattctcctgcctcagtctcccaaataagtgggattacaggcatgcaccaccacacccggctaatttttgtatttttagtagagacagggtttcaccatgttggccaggctggtctcgaactcctgacctgaagtgatccacctgccttggcctcccaaagtgttgagattacaggcgtgagccaccacgcctggccggatttatctatttctatctattagtttttgcttcacatattttgcagctctgttttccatacatacacacttcggagtgctatgttttcttagtggattgaccttttatcattaataatgaaaatgagccaggagttttggtgcgccctgtaacttcagctacttgtgagttggaaggatcgctggagcccaggaattcaaggccagcccgagcaatatattaacagcaagacctcctctcttaaaataaaaaattaggccaggcacagtggctcatgcctgtgatcccagcactttgggaagccgaggctggcagatcacaaggtcaggatttcaagaggaaacccctgtctccactaaaaatacaaaaattagccgggcgtggtggcaggcacttgtaatcccagctacttgggaggctgaggcaggagaatcgcttgaacccaggaaggggaggctgcagtgagccgagatcgtgccattgcactccagcctgggctacaagagcaagactctgtctcaaaataaataagtgaattaattaattaaagaaagaaaaaagagaaaagaaaagagagaggaggagcaggacagaaggaaggagggagggagaaaaggaggtagggagggaaggagggagggaggaaggaaggaaagaaggaaggaaggaagggaaggagggagggaagggaaggaaggaaacaatagaagaaccatggaggtggaggggtgccttcttagtgccaggttgggggtgaaagtccaggctccctatgtggcttggggaaattgaatgatgaattttttttttgagacagagtctcacactgttacccgggctggaatgcagtggcgcgatcttggctcactgcaacctccacctcccaggttcaagcgattctcctgcctcagcctcccaagtagctgggattacaggcgcctgccaccacgcccagctaattatttttatttttatttttaatagagatggggtttcactatgttggccaggctggtcttgaacgcctgacctcgtgatccacctgccttggcctcccaaagtgctgggattacagacgtgagccaccatgcccggctgattaattttatttttaagtttactatcacatggataaaaagtttacagtttaataacatactattggtaagagtgtggggaaacaggcctcctcatactttggttttgggattgtacattggcacaaccttaatgaacaacactctggtaataactaacaagattacaaacccgcatgccctttgaccaagcagttccacttctaggaatttattccaaagatgtttgtacacatgagcaaaatgacgttaagaacaaaagactgtccttccatggaagacttgttaaataaatattggtacagtccacatgatggaatatgcagatagccatttttttgtttaaatgagctgtttatctaacaatatagaatgatcttcaagatatggtggcccagtgcgatggcccaagcctgaggcctaagcgccactgcactctgcctgggcaacaaagcgagaccctgtccgtattttaaaaaaacgacagtcgggcgtggtggctcatgtctgtaatcccagcactttggaaggctgattcgggcgggtcacctgaggtcaggagttcgagatcggcctggccaacatggcgaaatcccatctctactaaaaatacaaaaattaggcgggcgtggtggcacacacctgtaatcccagctactcagtaggctgaggcaggagaatcgcttgagcccggtaggttgcagtgagccgagattgtgccactgcactctagcctgggcaacagagtgagactctgtctaaaaaacaaacaaaacaacaacaacaacaaaaccaacaacaaaacatataatgaaggacaaaaagcaaagtgcagaacggtgcgcctagtatgcgattatttatgtaaaagaaagaaaagaacacacaaacaggtatttgcctatacatgcagaaaatataccaggctggatgtacaagaaactgctaacagtgcttccctggggatccccgcccacgccgctgaaagctgccctggacgttaactgttgatgtcccttctccaggtccaggccccagtggagcttctggcgggaaggtcgaaaccccaggcagaagcaggtcccggtccctcctcccgacctttgtacctgccttttccgtgtttgcttttgcaaacaattaggtcctgggcgcggaggggcggagagggggcggagagggggcggagggcgcacaagcctgccctttggccgcggggctttagcctgccctagcttcagcatccccgctcgcctcccggcggtcctgcgtctcactctggattaactggaggcttcgagatgggatagagaggggtgcaggcgctgagaaagcccgctgatggggatggagccggattaagcagttctgtggagttcctcccttcttgtccaccccgctaggggtctctcctttcccgctgtatccacgcccctccctccaggccccctgggcccacctcgaagtcaccgctgggctggggagtacagaggtgggggacttcttagagaccctgggacagggcccccctctctccctcaatccttctcatcccacgcggctccgctgtgagtcgggcgtcccaggagctgccggcccacccatccgcgggtttcttccgttgggggagccctccagactcgtagaatataagagagcgcccctccctagccgcgggccatctctaagcgacaggctttaagaggcaccccgaaagggggatgtgaggtggtgtggttctatatcattatatcgaaatcatctgattatgtgcctgtcccattacttccaggagggacagaaacctgtatggctttgccagctgctgtgtccccagggtccagctcagtgcctggcacacagactgcacacaatatttgggaatgaattaatgttcccagatgtctgccccggaacccacgctgtggtgccccttggcttcagcccacagtcctggctctcctcagggtggagccagggagtcccctaatccaggtctctgacgtcccccgctgaggctggatcgttccccagtggggctggatggcctctgggttcacttcccagccttgtctgagcttccacgccccttttatcctaatatttgctaagagcctcgtccagggaccttaggagtcacacagccaggggttctgcccctgcccttcatttctcagatgatagaaaagcaaaaggaacactctgagaacttgtaatggggaggagtggggggttggtccagtctgacggggcgggggcagggtgggagacgtccttggagcgagatctgaggcagaggagctcagtccacagaaagggagcacgggctccacgctgcaagagtagggagctgtaaggtgccctccccagacggctccattttgcccaccttcctttgcggatagcacccctggacctccgaggtcagcctgtgccctgcagctggagtcgcccttgactccactgtgccaggagagggcaccctgctcccagctttggcttcagactgctgcagtgcaaactcttccctccaggggcaggatttggagcgctgtgatgataacctcccagctgccctgggagaaagcaaagtacagcttatcgctccctcccataggaagaaactgaggttcagagaagagcaatgaatgttgctagtaagtggtctttggacttgttttgaaggggctttagcccttggaagcatttgtcgggatgtttttgttctgttctgttttgttgagccagggtgtcactcttgttcaggccggaatgctatggcaccatcagagatcactgtagcctcaaactcctgagctcaagcaatcctcctgcttcagcctccccagtagctgggactacaagcatgcatcaccacatccagctttttttttttttttttttttttttttttgagacaaagtctcactatgttgctcaggctggtctcaaactcctggggtcaagcaatccttccacctcggcctcccaagtgctgggactacaggcataagccacattgttgggactgctgggtgttgacagtgacacccaggataatgatactagtccaaatttattatatccaatgctccacacacaattctaagctctttgaacttccctgtaaggtagatgttgccctactttatagatgctaccctataaggtaggtacccatttaacacatggaaaaactgaggctcctagtggttgatttgcccacagttaggaagcaccaatgctgtctgactccagagtcgctgctggtaaccactgggctacccttcctgcaatcatgctccctgctgcaacccccatgccagacatgttcatttgagtgtgctagaggcaaggacaaaaaaacaggacaagacaaagtccctgctcccatggagttccattcagtgaacatgtttacacctacagatacatccatacaaaccttcaaacacatactcattcacacatcccaccatcacacacgaatactcatgctcatgcacctatgtacatacatactacagaaataaggccaggtgcggtggctcatgcctgtaatcccagcactttgggaggccaaggcaggtggatcactgaaggtcaggagttcgagaccagcctggccaacatggtgaaacccgtctctactaaaaatacaaaaattagcggggcatgctggtacacacctgtagacccagctacttacttagaaggctgaggcaggagaatagcttgaacccagcggaagaggtcgccgtgagccaagatcgcaccactgcactccagcctgggcgacacagcgagactccgtctcaaacacacacacatgtatatccacactcatacacttcatacatacattcacacattctcaagtactcacacatattcagaccctcacctttgcacacactctgttaggttagacaaaaatcagctctttttattttttaaaaaatttttgtagagtaagggtctcactatgttgccaatactgatctcaaactcctgggcttaagcgatcctcccaccttggcctcccaaagtgctggggttacaggcgtgagccaccacatccggctaagatcatccctataacattgacctgtgctttaactgccagatacctggagcccaagattcagctagtaatctgagagctgtttgtgacaccactcccttcctcttcccttccattgatcccacaaacattgttaactgcccactcagggcaggcaacacagatgactcagacctgggccctgctctcaaggaatttcctagccagtggggaaaaaagactcaccaatgttcacgacacagatcatggatgccagggcaggtcagagcagagagtccaaggtggagggagagggtgactcactaggcctaggggctgtggaaacctctcagaggaagaggcgtccaccaaagtcttcaaaatgagtcaggtagagagagaactgtgcaggtgtgggaatcacatttgcaaagtcatggcagagtaagaaagtggggacaaaatagctgggcacagaggctcacgcctgtaatcccagcgctttgggaggccgaggcaggaggatcacctgaggtcaggagttcaagaccagcctggccaacatggcgaaaccctatctctactaaaaatatgaaaattagccaggcatggtggcgggcgcctgtaatcccagctacttgggaggctgaggcaggagaatcacttgtatctgggaggtggagtttttagtgagcagagatcatgctactacactccagcctgggcgacagagcgagactctgtctcaaataaataaataaatataaaaactgggggagtttgcatggagccccatatttccagcttctcttgagaaaattatctagcaactagacttatgttgtcatagcaatgggtgggtgagctaaatgttagctgccttctttgaatgatgcataagttctcgaggccaacatatgtccccatccctggcccatatcggttgttgatccctgacttgaagttttctcagtggaccaggatcatcccaatgagcattggttgtcattaaataaccttggttctcatttgcatagcaccaactgagtcattttcctctacattcaatgtcctcacgttgcaggattcttgtgttgcttatgatttacctatctcctccttttgtcttcttcctattgctgatgtcagtgaggccacctcacataccctgctctcttcctaatggagttgaacccatccagccaaaaacaggagtaggatccacaggaaggggctactccaggaaccactaacactgtcaattgccaatttccaggaactaggagggttttctaccttattccagaaatacggggaaaagaggtgttctgagttaaatgatggccctcctcccaaaggatatgttcacctagaatctgcaaatgtgaccttatttggaagaaaagtctttgtggatgtaattaagttaaggattttgagttgagacaattctggattaaggtgtcccctaaatccagcatcaagtgtccttacaacacaaggaaagggaagaagacagacacagagaagaccacacggtgaagacagaagcagattgagtgatgcatctacaagccaaggaaacctgggattgccagcagtcaccagaaaccaggatagaagcagggaacagactctcctcagagcctccagaaggaacccaccctgccaatgccttgattttggacttctggcttccagaactgtgagagaataaatttctgttgttgtaagccaccaaatgcgtggtacttcataatggcagctctgggagtctaatacagatggaaaggggaagagaagatgggggagataggtggggcggaagcctgatcttgtgactctggtgactcagtttcccttgtcctgccttggaggtggagaatatggagaaggctgaagtgctaagggcaacagcaagagtggctcaggcggtcatcccaaccagcaccccagggctccaatgcctcccaggaaatgagtcatcttggagagccatgggtttcttctcaaatgccttttattgtaagcacatggaggaagtgttctaaggcaacagctcttgagaggatggtggagtgagcctttagggaggcaaatcagccagggctggcatcccaagttcaggagttcacaccaggtgcccattccaggcctgggcagaggggcaacccaaaaggggaaggggcgatgggcagggaaccgtaggagcagagagaaggaggagggcagtagtgaggcttctcaagaaataagagttggatccttcggccagtgctgcctgtttctcccttctcgcacctcctcatattcataagcatttattcagtgccaggactgtgttcacaattaatatttcagtttccccttctataatatatagaatgctgaatatgatagtcctgaaatgtctttttaggacattgtgtggttctagttgccaacctggatcttaaaatgcaaacattgacaataaccccttaaacttcagcttcaaggatggctcctcatagcctctgtgtgagtgggcagggctgggatcatcagacagtgcattttacagaagagaaaactgagggatgagcacctgcctaaagtaccacagagtcaactgtggatgagagcctggggcctggagagctcatgcccatatagggagattgctgtgccggtgttcacttgctatgaaggagcccatcatggggagttgtggtctgagatcctggaccttgggggtaaaagcagagggtccagaaagggacaaagattggcatcacctccccatcatggtctgaggctgattgtgggtaattctctgccctggcctcagtgattctttgctgcataacaaaccacccatatttattggcataaaacaattatttatttatttatttatttatttattattttctgagacggagtctcgctctgtcacccaagctagagtgcagtggcgcaatgtcaggtcactgcaacctccgcctcccgggtttaagtgattctctgcctcagcctcccaagtagctgagattactggtgcctggttcatttttgtatttttagtagggatggggtttcaccatcttggccaggctggtcttgaactcctgacctcacgatccacctgccttggcctcccgaagtgttgggattacaggcatgagccaccaggcctggccacaacaatcatttattattcatttcttttgtttcttggggagggagcattgattggactcagctaggccattcttgctcaaggtctctcatatggctgcagtctggtggtggctgggctggagtcagcttgaagatctcctgatagccagttgatgctggctacctgggacctcagatggggcttccagcaaggatatgatatgtggattctccatgtggcctgggcttccacacagcatggtagctgggttccaagggttccaaggataagcatcctaagagagagagccaggcataagttgtatcaccatttatgacctagactttgaagtcatgtggcatcacttccatcatatttagttgaggtagtcacaaagccccacccaagttcaagagaaggggccatacactattgtcttagttcatttatgttgctataaaggaatacctgaggcttggtaacttatcaagaaaagtggttttgaagcagccttgttgtctggggggtgatacctgaggtttgttgtctcacagctgaggaaataaaggacacggacacacaaagagtgaggttaagagcagaagtttaataggcggaagaaagggaatagctttctgctggagagaggggtcccagagaaatgggttgccagatccatggtgaaatgcaagggagtttatagatgcctggtgaggagacagtgtctgatttacatagggtgtgaaagattggttggaccaggtatgccatttgcatagggcacaaatttctggtagcccccacccttatcttttactatgcaggtaggttctttgcctggcctgttacccatgttgcccattcctttactgtacacgtgataacaaaggaaagatggagcctccctgttggatatccctggtgcctaggtagcccaattttattggcacagctgccagcatttccccatgcaagcttccagcttgcttatctatgtttgcagctcaatttttcaggcttctctttgttagaaaaaaataatttcttgagctgctttttgttaaaagggatgctctgtagaggactgttttgccctcactatctgcctaaataattcctttctacctgctgtatcagtttattggctcatgattctgcagactgtacaagaagcatggtgcccacatctgcttctggtgattggtgagggcttcaggctgctccactcatagcagaaggtaaaagggagccatcctgtgcagacatcacacggtgagagaatggatggaggagagagggggaaggtgccaggttcttttaacaatcagctcttgtggaaattaatagagcgagaacttcctcattaacatgagaatggcaacatgccattcatgagggatccacccccatgacccaaatacctcccattaggccccacctctaacattggagatcaactttcaacataaagtttgagaagacaaacatccaaagtgcagcaactagctgttgatgggggagtgacaaggttctagaagatgtaaatcaataaatggttgggagcagtggctcacacctgtaatcccaacactttaggaggtcaagtctggcagattgcttgagcccgggagtttaagaccagcctgggaaacatggcaaaacttgtctttgcaaaaattatctaagcatggtggcacctacctgtaaagataatctttacctaatgtaaagataattgaagtaggaggatcacctgagcccgggaggtcaaggctactgtgagctgtgatcatgccactgaactccagcttgagagacagaataagaccctatctcaaaaaaaaaaaaaaaaggttcagtggctcatgcctgtaatcccaacactttgggaggtcgaagtgggtggatcacttaaggttgagagtttgagaccagcctggccaacatggtgaaaccccgtctttactaaaaatacaaaaattagttgggtgtggccgggcgtggtggctcaagcctgtaatcccagcacttcgggaggctgaggcgggtggatcacgaggtcaggagatcgagaccatcatggctaacacagtgaaaccccgtctctactaaaaatacaaaaatttagctgggcatagtggcaggcgcctgtagtcccagttacttgggaggctgaggcaggagaatggtgtgaacccaggaggtggagcttgcagtgagccgagatcatgccactgcactccagcctgggcgacagggccagactccgtctcacaaaaaaaaaaaaaattagttgggtgtggtggtgagtgactgtaatcccagctactcgggaggctgaggcaggagaatcgcttgaactcgggaggcagaggttgcagtcagctgagactgtgtcactgcactccagcctgggtgacacagcaagactccgtctcaaaaaaaaaaaaagatgtaagtcaatgaaaatgaccaagccaagtctcaatcattttaggaggtttctttgccaaagttaaggatgtgtaccaaggaggcaggtttatgcctttctcgaaaggtgattttgaggacttcagtatttacaggggaaggggtggatattgggggagaggaagaaattttttaaagatgtggctagataagagacaaatgattacatccttttgaatctttgatcagcctttcactgaatacacaatttatatgtgaggtggggtagagaaatagtaacttatgcctctgtctggctcagtggatctgcatttttatataagataatgtaaacaatagggcagaggaagcaatcagatatgcgtttgtctcaggtgagcacagggctgcctttgagttctatctgtcctttgtcaaaagcctgtgaatataatgatcaatttacattgccacagtgaaattcaacagaactgttttagggtaaagatgggcaaattgtgagagaggtatgtagcttttgtctttgtagctttctgatttaggaaccaaatgggagatgggagatgggtttgcgtgacccagttctcagcttgacttttccctttggcttagtgagtttggggtcccaagattttgctttttcacaaagagcatgagggatgggagatgttgtgaccatttctgaaaaatatactttgtcgcaccagataagggggtgagctctggagtcagatgcttggattagaatcctagctttactatttaatgcctatgagtctcagtttcctcatctatgaaatggtactgatagtagcactgctttcaggggattactgtgagaattgagtgagataaagacccaaagtgcaggatatccagcccacgacctatgttcagtgggtatcactgttgttggaacaggtcatcatactaagctctgaccagtgtggttcactgccccaggccattgcctgtttgtatgtgtgttatgaaacctggagaggtgttcaaggatatgtgttcgaatgggtccatgtgcacatgccatgggagctgagcttgagggaatgaatgagtgtgtgtatgtgtttgtcagtgtgagtgggtgtgtaagtggaaacttgggcaggggtttacatacatgagggcacatgcagtgctattgtcagagacgtgtgaaccagagggactccatcttaaagaggaaatgggtaaaatgagaggctgagacctgctgggctgcattcccagatggtttaaggcattcttttttttttttttttttttttttgaggtggagtttctcttttgtcacccaggctggagtgcaatggcgtgatctcggctcactacaactccacctcccaggttcaagcgattctcctgcctcagcctcccaagtaactgggattacaggtgtgcaccaccacgcttggctaattttttgtacttttagtacagactgggggtctcaccatgttggccagcctggtctcgaactcctgacctcaggtgatctgcctgctttggcctcacaaagtgctgggattacaggtgtgagccaccgtgattggcaggtttaaagcattctaagtcacagaataacataggagatctgcacaaaatgcaggtcataaataccttgctaataaaacaggttgcagtaaagaagccaccaaaacccaccaaagccaagatggccacgagagtaacctctggtcgtcctcactgctacattcccactgcagccatgacagtttacaaatgcctttgcaatgttaggaggttatcctataaggtctaaaaggggagggatgaatcatccaccccttgtttagcatataatcaagaaataaccataaaaatgggcaaccagcggccattggggctgctctgcctatggagtagtcattcttttattcttttactttcctaataaacttgttttcactttatgggcttgccctgaattttttcttgcgtgagatcaaagaaccctctttggggtctggatcgggacccctttcctgtaacactatggatgtctgtgagtgtgtgggacagaggagtgagaccttgaggtcaagtgtaagcatgtgtgtctacaactgtgcataattaggactgtgtgtgggtaagttagctggtgagggttataagaatatgagatatggccaagcatgtgtgttagattgagtgtgtatgtgtgtatgagtgttatgtgttttccagaaggtgcttgtccatgcctgatacttgcaaaaaatgagaaaatgtcgaaacaaagaacactttcagagctttacagagatgttcaaagcaaatgaacctctgggtactgtgaccagctgggaagatgaggcgagccaggtggaggggtgtggagaaaagcttttctgaagttcctaatctcactcaggcaaggagccagggaccctattagggtcaagtgcttcccacgcacagttgccttcttagtttagatgacagctgcacatctgggccttcttcctcctcatccccatcataattagtggttaattcgttcattcatacaacaaacatttactcagtactgacttttaagtgaagtttagcctaaacctgactcctcacatattttgaagttcagcctaaaggtttctctgtacattgtgaactataacctaaatggaattgtaaacagactgcagcctactcttgtgccagtcaccgagttttgccaatcaggtgtggccagctattcaaaccgtgttcaaataagacaaaaacgccatgctataaccaatctggttgtttctacagaaacaacattttcctttttctgttcataaatcttcttccaccacgtggctgtgtcataggctatactcataggtcgaaccagagcaacaccatcttgaataggggctgggtaaaataaggctgagaccctgctgagctgcattccaggaagttaggcattctaagtcacaggatgagataggtcagcataagatacaggttacaaagaccttgctgataaaacaggatacagtaaagaagccagccaaaacccaccaaaaaccaagatgacatgaaagtgccctctggtcgtcctcactgttcattatacgctaattataatgcattagcatgctaagaaacagtctcgccagtgccacgacagtttacagatgcatggcaacagctggaagttactctataagggaaggaaacttcacttccaggaattgcacaaccctttcccaggaaactcatgaataatccaccctttgtttagcatatggtcaagaaataatgataagtataatcagttgagcagcccatgctgctgctctgcctatggagtagccactcttttattcctttactttcttttttttttttctgagacaagtcttactctgtcgctcaggcgggagtgcagtggcgcgatctcggctcactgcaacctctgccccacaggttcaagcaattctcctgcctcagcctcctgagtagctgtgattacaggtgcatgccaccacggctggataattttttgtatttttagtggagacgggctttcgctgtgttagccaggatggtcttaatctcctgacctcttgatccgcctgcctcagcctcccaaagtgctgggattacaggcgtgagccaccgcacccggccctattcctttactttcttaataaacttttcactttgtggacttgccctgaattctttgttgcgtgaggtccaagaaccgtctcttggagtctagctagattaggacccctttccagtgacagctgcgtgggagtctctgagcctacactggcttgggaggctgcccattctttgctcaattaaactcttttacgtttaattcagctagtttttcttttaacactactaagggccaggaactgtgctacagcagtgagcgaagccctgtccttgaggagctaatgtcctagaggggggatatatatatatataaacattacacagttattctacacatatataaacattacatagttatactgcacatgtataaacattacatatataaatgtatattacatatataatatatataaaaacatatctatctacacacacataaagatatttgtgtatagatatacacaaatatggtggaactcagtggctcatgcctgtaatcccagcactttgggaggccaaggtgggaggatcgcttgaggccaggggttcaagaccagcctgggaacacagcaagacttgtctctacaaaaaattgtaaaaattagccgagcatggtggtgcatgcctgtacttccacctacttgaaaggctgatgtgggaggattgcttgagcccgggagttcagggttacagtgagctatgattgtgccactacactgcagcctgggtgacagagtgaaacattgtctcttaaaaaaaacaaaaaactaaatatattatgaaccatataatatcaggtggtagtgagtgctatgaaaaaaactaaaagagatgggagtgaccaggaggtaggagacactgtggggaggggtgttgggaggcctctttgcagggcagagaactgagtgccaaagtaagtgtttggagaaagacattttgtgcaaaggaaacagcatgaacaaagacctttaggtgagaacgtgtctggcacattccgggactagcaaggaggttgctgaattagcagtgaagtgagctgagggcagaggggaggaaattaggtcatgaagcagccaggggacagaggtctgtgagcttgtgcagggaggatgatgccccttcctttccttttccttcttgacaccaggatccctataggtcaatgagaaaaagacaaatctcattaaaagaagaaaggaagaaagactgggcagaggacttgaacaggcatttcacaaagcaggatctctgaggggcaggattagtctctgtttcttacaatcaattcgatcttgcttgacacattctccctcttcacatcaaaacttctgctcttgtgacagcgtgagagaccctcactctacaataaaagtaaaacattagccaggtgtggtggcaggcgcctatattgccagctactccaaaggaggtgtgaggattgcttgagcctgggaggtagagcctgcagtgagccctgatggtaccactgcactccagcctgggagacagagtgataccctgtctcaaaaaaacacacaaaaaaacaaaaaaagaagaaaaacagttcttttttttttttttttttttttttgagacagagtcttgctctgtcacccaggttggagttcagtggtgcgatcagggctcactgcaacctccacctcccggattcaagcgattcctttgcctcggcctcccaagtagctgggactataggcgcctgccaccatgactggctagtttttgtatttttagtagagacagggtttcaccatgttggccaggctggtcttgaacttctgacctcaaatgatcaccctgccttggcctcccaaagtgctgggattacaggcatgagccaccgtgcctgcccagttcttttttttgttcttcccctgctctagtcaagagagacaaaagcagttcctgccatcctcccgctctccgtttgctgaggacttcagcccctgccccaaactcttcctttcctcccaagcctgctgtctcctcgggcgatttcacatcccatgaggttgacccatcacacaccttggccctggcctccactttgtctccgccacccactgcaatggccacactttggaccgtatcatactgctggctctagtcagaattttggctacaaataacataaacccaactcaaagtgggtttaacaacagagtggatgctattatcccatgtaacaagaatctggaggctgcgtggctcaagggtatatcaattcagtggacgctctgtggacttcatcaaggacccaggttcttgctgtcattctattctcctgccctcaggtattgactctctcatcaaactggctccctacatgttcacgttactccagacgaaactatcacccctttataacaatggccagagtcagaagataggaaaacttttccagatgtgctctccttctcctcctactcccactacttgtcaatacacttccctaggccgggcgtggtggctcatgcctaatcccagcactttgggaagtcgaggtgggcggatcacgaggtcaggagatccagaccatcctggctaacacagtgaaaccccgtctctactaaaaatacaaaaaatcagctgggcgtggtggcaggcacctgtagtcccagctactcaggaggctgaggcaggagaatggcttgaacctgggaggcggagcttgcagtgagtggagatcatgccactgcactccagcctgggtgacagagcgagactccgtctcaaaaaa
